United States Patent 11,203,620 (CONSTITUTIVE YEAST LLP PROMOTOR-BASED EXPRESSION SYSTEMS) - sequence listing, part 2

SEQ ID NO: 101 - DNA, 879735 bp, Pichia pastoris
gtaaacctaccgataagccaactggtgaacctaccgacaaaccgacggacaaacctaccgataagccaactggtaagcccactggtaagccaacggacaaacctactggcaagcctaccgataagccaacggacaaacctaccgacaaaccgacggacaaacctaccgataagcccactggtaagccaacggacaaacctaccgataagccaactggtaaacctaccgataagcccactggtaagccaacggacaaaccaacgggcaagccaactggtaagccaactggtaagcccacggacaaaccaactggtaaacctaccggtaagcctactggtaagccaacggacaaaccgacggacaaacctaccgataagccaactggtaaaccaacggacaaaccaacgggcaagcctaccgataagccgacggacaaaccaacgggcaagcccaccggtaagccaactggtaagcctaccgataagccaactggtaagcctactggtaagccaacggacaaaccgacgggcaagcctaccgataagccaacggacaaaccaacgggcaagccaacggacaaaccgacggacaaaccaacgggcaagcccaccggtaagccaactggtaagcctaccggtaagcctactggtaagcctactggtaaaccaaaggacaaaccaacaggcaagccaactgagaagccctctggtaaaccgattccaactgttcctacctcaacggtcgttcaatccacacttcacggaaataacacaactacggagacagtcgaatatgccacagaagccatacataagacgattattatagaaggaacttcgacagtcttgactatccctgctcttttggaacctgaagccattacaccaactccagtgaccataacttctgccgtacaccctggtgctgcagacaatgaagctaccgaatatgtgacaggagctatagagaagacagccaccgttgaaggaacaattacggtcctcacaatttataccccgttggaaaccaaacaagctggaaggaaaactagtgatgaattcaaaacagtggttactgatgttttaacaatcaccactataaccagcggcgccgtcccagcacacgctccaattcctggtaccgaatcaatttcgatcagcgactcagttgtaggcactcagtcacacagtgcgcctgttacgccagcgatcgaaccaccaatttccacacaagtggcgggcgccaacgctgtacatagtacggcagtatacggtgtcatagcccttcttattaacatattcttctggtaagatgttagatcctaccactattatttttatttattgaagctgttttttgttttggcactaagtgtagccatatctggcatctttcgcgcatacatgcttttcactcatctgtcaaattgtccagcttttcaacaggacaggagattgacaaaatcgcaggcaaagaaggaaatcaggctcttctagacgaaactgtatcagttaagcctgaaccaagagcctacaaaaagcactgccttatgtgaagatctagaggcaaagtgtgagaatctattcaaataaattaggtctacaatactgttcttttttgtagggaggaaaattgttcaagagaacacttccctaaacctttcctgagtatgagtgcgtcccatggtttgccactgattttagttttcagagcaaaagaattagtctggcaacacggggtgtgggcgttataggtaagacgcatgtttatgcatggaagattaacaacaaactttattgttgtgccccgcgaggattataccctagatcaaagacaaaattaccctttttgcatgtctcgttaggaattgcggacgaatacggctccatatggccttattatttttctctttcaatatggtcacgtgctcactggttacaactttcaaacattgggggtgactacaaactactggctcgtaataatatttgttggggatggcaaccatcgcaagataaacaaggttgaaaggaaataactcgacagatgatgagctccttgaagtgagttgaatttcaacaaccccaatacccaacatctcctaatgcactcacactgatgcatttgtcgtattttgttgacagggagatgccacgacagtatagccgctaaaaagaaagccaagattgtcatgacagtttctctttgttgaacctaagtctgaaacttgtcgtagcacacgtcagcctccatgtttgaccacttaaacttaaaacaagtctaaaaatagcgaccaactagagctatagtacacttgaaacgaccacagttagtttcaagatttcagtacgagaaacctctcaaaatcccaagcctagattcattctttaccaagagacacccaacggctctattttcttagtatactgtttacttttcagtgttgaaaggtgacgctttatccttgctcagcttttgatgatcaataggacatgtcccaatgacgtttcgcaacagtgtagagcctggcccaaactttaagggtaagcccaagctatcaattgaagtcatgcatttctagccccaaatattaactaagaattatggtcaggaatctcgggattagcactttcgcagagtctcgaatcagtttagaccgaaaatctgaaatggggtcaccaattttactgcgccaaggaagaacgctgaaacgcatacgtcccaaaattgcatacagactgttggacggaagatacaaaagcagaaaaaaaaatgtaaaagcctcatacttgaatgccatctacaaagaggcatgatcaaggtattaattaatttgatagtgccaacacaactagtaaagggatcttcgagacgtctaatgaactctcaactctgaaggagtaacttcaagaaaatttttgttccaccaaaaccaggatgttttggcctgaaggtggagcacggtccgctactctcctagtctaatccaccaatgggtacgagactacataccataccctaaaatactactaccgaggggaccacgataagagatgatcttttttagatgcatgagatcgtaaggtaggccccccgtgtttataggtattagaattccctcaacaaacttattatctccttttcaagtagtaatttactttttcctacccaaaaaattatgcgtcgtttaacacttcatgcaggcaacaattcgctagatcgccagattgcctttagttacgagagaaagtcacagaaaaaaatccaaacatctgtgaagcgtcccatttactattgcttagcagagttctttgacaggctagtccttggtcaataacccattcttccttctttattgcaaccacaggtgacgaaaaagactcacctcttagtctactgcaaatgcgtgactatgcataggcgggcatacgaaagaaaaaaatgttcgtaaagggaaatgcgttctttcgctgattactaaaaaagttcttttttttttttctcagcaagccagcgaacgacaaatagtcaatcgctgcagagacggtgcatgtattaactttgacgaatgcatgatgccggcataatctttccacaaaagaaacgagtgcaaatcgaagcacgcaactattttcactttcttcgttttagatgcaaacatgtataaataagatctttttcccaagtttgtcgacccctatttgcattaattgaaactacagtgactgcacgatgttatccctaacaaaacttttcattggtataatattaggtgcctttgtcgccgcagagcagtctgatgtcgaaccagcatgttatgccagacagtgggagaacacattccctccctcaaatatatacgtgtctagtgcaacttgggttcgtgataatgtctacgatgtcactcttcgctatgaagccgagtccttgcatttgaggagtttgggagagctcaaagttatcggccttaactctccagtatctggaactaaagtggtgtactcccgaaactccaagatttatgaaatcaatgacccttctagttggtcaactacaatcagagtgaatgctaaagattctgctgacggctgccatgttgagatgtatcctttccaaatccaagtcgaatggtgtcaagcaggcgctgacactgatgaatgcagttcctggccataccctagtgtctacgattatgacattggctgtgataacatgcaggatggagtttctagaaagcaccatgccgtttacagatggctcaagcactctgtttctggatgctcagccgcctccacagttgccgctatcagttctcaaactacatcaagctctcaaacttcaacgagttctcagtcatcatccagtactgctataagctcagtgactacccaaaccacacaaacaactactagtggggtcccgatttggggacaatgtggtggaaatggccactctgggtcaactagttgcgccgaaggagtctgcgtgtacgtgaacgactggtactaccaatgccaaccaggtgcatctaccaccacaacttcccaagcatctagtagccaagtattctcacagttaactaccaccgaggagtctatttcctccgaggaatccattggactgacctctactgtggaaacaacttcctccgcagaggtcgttgaatcgactacttctggtaaccaagcaatccccactatcgagtttgacgtcgaaattgaatttccagcggcagagataacagaggaggaaactacagaaacagaagaacaagtgccacttcatggaaaatgtggcggtattggtcacactggctcaactacctgcgccaatggtatctgtacatacgtgaatgattggtattacgaatgtcttccaagagaggctgagtccgaagaagaagtcccactttatggtcaatgcggtggtataaattattctggagcaactaaatgtgcagaaggagtttgtacctatgtgaacgattggtattatcaatgtctcataggtcctgcaactggtacaccgcaatcaacttccagcaccgacagtcaaagtgtttctgagtcatccgctgctgaagactctacgcccactgaggaggctgaagaatcagctgaggagtctacctctactgaagatgctgaggaatccactgaagattttgctactactgaggaggttgaggaatctacctctactgaggatgctgaggaatccacctccaccgaggaggctgaggaatctacctctactgaggatgctgaggaatccacctccaccgaggaggctgaggaatccacagaggaatccacatctactgatgaggttgaggagtctacttccactgaggaggttgaggaatctactgaggaatccacatctactgatgaggttgaggagtctacttccactgaggaggttgaggaatctactgaggaatccacttctactgaggatgctgaggaatccacttccaccgaggaagctgaagaatccacagaggaatccacatctactgatgaggttgatgaatctacctccaccgaggaggctgaggaatccacagaggaatccacatctactgaggatgctgaggagtctacttccactgaggaggttgaggaatctattgaggaatccacctccaccgaggaacctgaagaatctactgaggaattgacttctactgaagaggctgaagagtctacttctactgatgaggttgacgaatctacagaggaatccacctccaccgaggaggctgaggaatccacagaggaatccacatctactgatgaggttgaggagtctacttccactgaggaggttgaggaatctactgaggaatccacttctactgaggatgctgaggaatccacctccaccgaggaggctgaggaatccacagaggaatccacatctactgatgaggttgaggagtctacttccactgaggaggttgaggaatctattgaggaatccacctccaccgaggaacctgaagaatctactgaggaacttgacttctactgaagaggctgaagagtctacgttcgtactgatgaggttgacgaatctgctgaggaatccacctccaccgaggaggctgaggaatccactgaggaatccacctccaccgaggagactgaagaatccactgaggaattgacttctactgaagaggctgaagaatccactgaggaacccacatctactgatgaggttgatgagtctacgtccactgatgacgttgatgaatccacctccactgagggcactgaacaattcagttccactgatgttcctcagggaagaccaggattcgagaatccaactgaagaggttgaatcttcttctacagaggagttcgaggaaccaacttccaccgacgaaactgacgaatcgactgaggaagccacttccactgaggaagcagaagaatctatctccactgacgatgttgagcaatctacctccgtagaagaagctgaggaatctacagaagaatctacctccaccgaggctcttgaggagtctacttccactggcgactttgagaatatttctgccgttgacgaagaactcgaggagtctactgaagaatctacgtccactgaagaggttgaggaatctacctctactgaggatgctgaggaatccacctccaccgaggaggctgaagaatccactgaggaatccacttctactgaggatgctgaggaatccacctccaccgaagaggctgaagaatccactgaggaatccacttctactgaggatgctgaggaatctacttcctctgatgaggttgaggaatccacttccaccgaagaggttgaagaatctactgaggaatccacttctactgaggatgctgaggaatccacctccaccgaggaggctgaagaatccactgaggaatccacttctactgaggatgctgaggaatccacctccaccgaggatgctgaagaatctacctctactgaatatgttgaggaatcaacttcaatcccttcttcaacatccgagccatctctttcaacttcaatttctccatcttcctctagttcatttgagactgccactgttaccaccgatgtgtcaacaacagtacttacaaccaccgattgtggcgagcagacttgttacaaatctttaatcataaccggtgttactgagaaaaccattacaaccagtggaagaaccacagtcatcaccacatactgtcctttgcccactgagactgtcattccaactcctgtcgttgtcacatccactatctatgcggatgagacaattactgagactacatgctatgtcactggtgctatcgaaaagactgttactgtcggtggatccccaactgtcgtgactgttcacactactctaccaatcgaagccataaaaccaactccagtcactgttacttctaccatttatgcagatgagactgttacaaagactacatgttatgaaactggtgccatagaaaagacgtacacaattggaggatcatctactattgttacaattcacactcctctttccactgtgcagccaactccagtcactgttacttctaccatctatgcagatgagactgttacaaagactacatgttatgtaacgggtgctatagagaagacgtacacagttggaggatctgcttctgtcgccacagtttacacccctctgccaactgaaccaagcaagacatcaattgtaactttaacatctgtcatctccaacagtggatcccacccgttgacaacttccattgtgaccggagccgtagaaaagacaatcacagttgatggaacagcctccatagtcacagttcacactcctattgcttctgtttactcaagcgcacatgaacattcaaaggttactaaagctattacaccatcaacaactactatcattagagacgtttgcgattctcactcctgcactcaagctactattgagactggtgtagtttccaaaactatcaccatcggacaatctgttacaactgtggtaccatcatatgttcctttggaacatgaacaacaggaagtacacactaccgctgccactccagttgattcaagtgtccactctcaatcaggaagcccagttccacctgccattacaacacaatcttacagcgctcaagcgtcatcagttccagttgcttcttattacgagggctctgccaataatctggtgttttcagtggctagtggagttgcggcattgattgttaatgcattgttcttatgatcacttatgaacacttctcctgtatatttactcatctagactttttaattaattcttattttcaataacataagaccgtaaactccagtaagacctctttcctccccttaggaactctccttatctggtagcttattttggatgggtatttcctcagtgcatgaatatgcagaggtatattcgttggaaattgcctacggaactgagtaccagctgcaaatggtaagggacttttgcagctggaacggcccgactaaaaaattctttgggatacagcgaactgatattaaacaactgtgtgacctttcgcttttgaacattctaaccacccatatgtgtcagctacatgcttcgcctttccagatgcccaaatacgctgattctgttgttttgttgctgacaaaccagaaaattctggacagcaatataggcgtgcatcgacaaatctcaaatgtgacactttctgcagtcttttttcttcacgaatattatgcatgcgtatatgcctatttacatcttacatggaatattagtacttatagagccgagcttttgacaaccaagacatacaaaatcttagcttagtcttctaggtgttttctcctctgaatcacgaagatttgactacctagtttcaatatcgttagctggttgctaaaaaaaaaatgaaacaacgtcagggtctggacagtagtgaattggttgcatgtggatttgttttggttcggttaattttttccctgtatcgttccagtactccggaatgaaattcctaaattgagtttcttttttcgaagggcggtcatagccacttttggtaacccaatacttgatgcacaacttgcatgcttctgcagctctttggatttatggcccgacacaaaacttcgcccaccgctcgacaattttggaagtaattgtttctctggactgaaggcaaatatattattgttttcttttccaccctgccttgaagtaatagacttcgcaatttgtcgttacaaacctacgatttatctgcctgtaagattgacctgcctagtaaaccaggaaaccaaaaacataataaaggagtagctttctcaaagctgggcgtcttattttgaatttttgtttctttttttgaattcattttaaccatgttgtccttggttgccactttttttttgattaggtaaggttgtgtaacgtgttattgaactagatgagtcagtaattctaactagaggttggtggcaacaaaactaccatcgcttcaagtccatacttcttttgcaacgtaaatactagtctaaaagctatatctgaagtatttactggggggaaagtggcactggagttccaaatttcctttaaggcctgagaggacacagtcaatacaaatgtttccatttgtggtatcaaccagaccgcttcatgggccactgaagtcaggtatttgcctgtataaacgctgttgtcaaaattgtgaatctgtgatgtttctggcttgattgactcgaacttcgaaatgtagtatcaacgttggatgcgaaacactggtaaatggaacgctcatctgccaaatctccagaaccctaagcgtacactttcatgcctgatggtccaaaatgaagctgtattgggtgtttgacctgtattagagagatatttcttgagcaagatatagttgagctggtatatgaatatgaagctgagtctgcgaaccaacctctcatcgtctgtgacgcatcgtgcttgcagctactcatgaagtcaatttttgataaagagatatacgctcagcatacatttctttgccatcctttagtagcttgagaagtgacggtggtgtcaaatcattcaatggattagcctcacgaacaatgtcgccttttgagacccaaattgagcctaaatgctttcaaactaccagtacaggaaataggtccaggatccatgaaaactcagttggtcctagctttggattgaaagtccttttaattttgcaacgttcagattcactttaagaacaccctggcgtagtgttagatctcgcattttctaagcatgatcagcttgacagacgcattctgtctcagcgcgaaaaccatttgggattatgactattagtctctcctcgtccacttgcaactctgttgggatggacttgataatcactataatcaagttctgcgacttctgtgttggcagatcaggagcacacgattccaagaagtcatgtatagtactttaggcttacgattgccttgagaggacccgaagtcaaacacatgaaagtgcgagccagaagactttgaaacttgagagccacgtagtccgctacttcaagcgtccaacgtgtattgtcacaactgctgcgatacacgaaatcacgagaaattcaagtcaagccattaaaatacaataaaaaaactaaaaaaacaacaaatcaaacaacacaactttcttaatttatcaggccgagagtctcctccttgatttctccgtttttgttagaatcctgctcctcttcttttcccaagttccccaaactattgagctttcccaggtaagacctggagaggacggccgagagactgctgttgttagacccgatagtgttatctccgtgctcaattagcttgctctgcaacgttaaagtgtaatccctgagagtcattatttcatttttgagattttggataatgtctctgtaatgatccactaattgagccttcttctccagttcttgaaactgttcttccctcttctttcggaatacctgttgcgcctttctattttgctcagcacgtttggtgttgaccacctttttaccactggaggaggttctttgagtggtagtcggtcttgggggtccagaggatgcagttggacctaccaccgaattaacctctactccagcattcttcaataatgcgatggcatcgtgttggtcaacttcttgctttgaagaatgagcaacagcagcagcagctaagttaccaacgtcaaaatggctttcgccagccggtttcgatcgagctgtaggtttctgtacaccgcctttaatagtcatctctttattgacttcttatctactccacctttagatgttttcaattggggacttatgtaagagatgacaaagcaatctccaagttgacggttttcaaggagaaaaaaaacgcgcaaaaaaggtcacatgactggacacataggaatcacaggatggggattacaggatggggattagaggttgaactaggcagacatagtggagttgaaatggcatctgactctggaaggcctgagggtcgaagggggttttttagcaggccatcgtagatagtaatttcttgctaattatgatttattttcttagtaacaggtaatggtgctgaggagtcaagttaacagttgataccatttacgataccaaagtatcaagagagacaaaacgggcagaggtcaacagagtccatacaacccaactactggtcttttgattttttttcttgttgattgtcaatcgtaataacttaactagggcggcctgaagacgacccaatggcctcttcaattgcggcgaaacactgtggcagtgtcgaagaaataaactctaccaatcaactacagctcactattactaatataagtattgtcaaaccattgaaccgggaaaattcccattatcgattttcaattacttaatcgtgtatgaagaaccctcagtttacttccccgatgtcagtcatcttatgacgggtggctatgccaacgagcccgtacaggcgttaactctttaagaccctgaacttcttaattttattgaagacgcaagaagtcaagtacagtgactcatctaccccagaattgaaagagtctggtaatctactaagacctacgttaaaagagagatctctaagcaaccatttacactgaaagtcccctcaaacttcttatctaaagcctctcaattgttctccaagtgactaactctcctcaaattgagactgtagtttatacgagagatagccacaccgcattaagaaggtgatacctgccactcatcgaacttcctatttgggtatgcagatgcgaaaggaccccattagcaagaaaagaactacttcttgagggtcttctatgatcggttgactaattaatttctgtccttaaatagcacactcaattcacctctaaccggctctatagccacttttgatcctttgcactttacatgtcttcggaaaaggagagtccctctgagtcaaagtcctctcaagttctgaatatcccaaagaatgagagagtccgtttgacagtgagaaatcttcaagtaacactcaaagcccaaaaaaagaaacaatctcttctaaagaggctgagaaagtctgaaaaagacaacaccattgatgaggaagcgcttcctcaaaagaagatcatttccaatgtgaaccttgacctgaaggaaggtgaactgatagcgatcctaggtgcctcgggaagtgggaagacaactttgctaaataccttatcacaaaaagtcacaaagaataaaagttttctgttcagtggtatgatcaaatacaatgagaatactgacattgaaagaatcagacatgcttacatgtcccaaaccgatttctttctaccaaatttgaccgtttacgaaaccttggattacgctgccaagctgaaattaccccgtaactatactaatgcagaaagaacagagctagtagaaagtatcttggttgaactagggctggacagaattcgtgagtcgatcatctgtaattcgtttggatcaatttatatttctggaggtgaacagaggctagtaagcatggccctgcagttgttgaacaaacctggattattgtttttggatgagcctactacgggactggatgccaccagctctttcagaattatcacagcccttcataaattgtccagaaactttggtatgaccattgtactcactattcatcaaccacgttatgagatccttgaacagattgacaggatctgcattctgacgagaggttgcagagtcatctataatggctccccattaaactctattgaatacttcaagaatattggacacgatattccaagaaatgtcaaccttactgactatcttctggacatttcttgtaaggactcatcttcccccgagaacgagtctcaaagtttggccagaattgaatatctggcttccaaatgggagaaacatgaaccgtcaactttggatgaaggtgtagaagttatggactcttttacacattcttccaactcggaaaaagcactcacagaaatcgaaaagagaatcactcttatcaaacagattagaattttgactaaaaggacgttcatactttcacttagagatagaggttccatgctcacgtttaatttttctattttaataatgggagttgcttgcggttggttgttcttcaagcctcccgcagacttgggaggaataagatccattgtttctcaagtttatgttgtactggaacttattggtttcgtgccaatgattttagaaataacgaggctttgggatttcgatggtcaagcttttctcagggaaaatagtgaaggttatgtgtctgtgaccggatggataataagtcgaagattagcaaagttccccattgaggatttccctacttccattttctttgctctaataacatattttatgtttgggcttcgaacagacaatggagcttcgaacttcctgatctactttgtcgttaccttatttgtcaatctatgtgctgttgcgttggctactctatgttttgctgttggatctgactttgcttcttcaagtttgatgtgtaatgtgatctaccaattgcaaaattcctcgtgtggttacttcatcaacgccaaaactatgccggtgtatgtcagatggctgaaatattgtgcacatttctggtacgcatttggatgtttaatgtcgaaccagtttactgattggatgggagattgtccaaccgaaggggatgcctgtgtggagtactcgggaatataccaactggaaatctttggatttggagaaaattggattactctaccaatttgtgtcttattagcgttctttttaggaactttggttctctctggatttattctaagatacaagaacactgaagtttcgatgtccaaagagatcacttccaacatgttttccaaaaggagcaaggataggaagaaacatgaggagaaggatgttccagctgatgataattttcatgccatttcaactgcaagacgagagatttccttgaatctttacgttagcaatgtctccttatacgtctatccttccagattgaacctaggtgtgtttacaattctctggaagtacattaataaccggtatttgaagtttggtgttgaaaaagtggaaaacactcccaagagcgcaaaatccaagcgattattgaccaatgtcaatgctaaatttattcctggaaggttgaacgctatcatgggtccgtctggatcaggaaaatccactctgcttaactatattgcaggacgactatctaaggagagcaacttttacaccacaggtgaggtcattgttaatgatattgccatgagaagcatggataaacctttaaaaaaattgtgctcctatgttctgcaaaatgattccgcattgattcctacgttgacagtgagagaaaccgttcactttcaagctcaattgagattgccaaaggagaaacaaatcgatggaggcatagatagaatcatcgatgaccttttgttgaaatttgggttgttggactgccaaaatattcctattggtgatgattacactaagggcattagtggaggtgagagaaaaagagtttccattgtagtgcagttactggatgatagtaaaattttacttctggatgagccgacatccggacttgattcctttacaagctcttccattttgtcaactctagaagaatatgctatagagcagaataagcttataatcatgactattcatcaaccaaagaaggagatttttgaaaagtttggaaatgtcgtgttattggctagaggaggttacgtcgtttacaacgacagcgccgtaaagatcgccgattacttttctagcctgggttacgatgtccctccaatgactaacgttgctgactttgtgcttgatatggtttctaacaatatcgacgagagacctgaagaaagtgatgctagactgagacgtttagtggaaacctggcaagagaaccatgagtctgatttccaaagggttcagactaacaccactatcaaaatcagcaatgaagatcagttcgacgcccaattttctcatttataccaaaaccgggctgcagataacgtttcgttgcctgtactgatcaagcgattaacattgaccactttcagagatcaaggagtcgtagctgctcgattataccaggtgatggcgttatgtgtcatccatgctctattctatgctcctctgaaaaatggtgctgatggtatttccaaccgattgggtttgatctttcaagttctgaacctttattatgccggcttcattaataacatcagcttgtttccacaggtcaagcagctgctgtacaacgaatgggaggatcagatctactctttggaatctttctttgcttcatactttttgctggaaattccattcgaactattttgttcatttctctacgcagtgttcctggtgatggttattgggcttccaaggaccgctggaatgctctttaccaccttctacgcctcgtttgttgctatgaactgcggtgagtcttttggtattctattcaatacactgttcaacaaattggacgtggccatcaacgtgctttccaactgtttgattataggaatcttcatggcaggagtgatgtcgatccatatgccagaattctttaaggcttggaactggatcaaccctttaaagtacatagtgggagtggttgccaaactagggtttgcaggtcagactttcaaatgtgagattggagatgaatgtgccttatctactggggacgatgtattgagatactaccggttggaccataatttttctgctttcatgggagcactagctgtttgcttcgtggtgtatcggttcgtcagttacgtcttccttgccattcggctaaaaatgagttagtattgtcatttataaacgttgcgtactacttgtaattcaattaatagcatcttttgaacgggtcaatcgttagtagatgctacgcagtgcctctgatcgcacctcgcagagccccttgcctatctcgtccagcaacctcccgccaaactactcatggccattacctaataaccaccgcgaattatgctatctaattaatctatcgtaaaagcagcaactaaaacccaacaaactaaccatcctacccctcacaccctgtccaactttcgttaaccaagcaaaacagatattctccaccatcaaatgttagcattagtacgcatttcaaccctgcttctgcttgccttaaccgcatctgcgtctctgataccttttcagggtaaattgacattccccggtcaagacctcaagccagtcccaggtgactcccccatcgccaactgtgacgtctcccagaaacaacttttaaccctgaaagaggtagacttgtctccaaatcctcctcaaaggggtgttaatctgaccatcaccgccataggagatttggatgttgccgtcaccgaaggcgcctacgttgaaatcgatgttacttatggctacattaaattaattcatcagacattcgacatctgcagcgagatccagaatgtcgacttggaatgccctctagacaaaggccattacgagctaacgaaagaagtggagatccctcagcaggtccctccaggcaagtacacagtctttgctcgtgccttcacggcagatgacaagtttatcacctgtcttaccggctcggttgagtttggccctgaaaactttagtttcttctgaaacatacaggacgaaagaaaacggtgttcagccccgacatctcctatcgaaggagtaagcaggtgagatgtttcaatatcggcttccgtattcctcctactggcgtttttttttgcaatttctgcaattaaaccatgttatgctgggcatcgcgaacgttggcgttggaactgagctagttattccggtcactcagcaaaacgagaaagaggggctgaggtgagagagtacgtgagtttgaaaagagacgcgttactacagtgaaacgattgtctagagcatgaaaaagtgaaatgaatttcattatcacaaacttatctataaaaaaagtaaaaaatcacccaattaccaccgaaagtggccatatttcccttcgcaaaaatggtaaacaaaaagtcctttcccctctttctcgccggaaaatctctctcggaaaaacatcttccattacgagaaaagggaacaaaaataagaaactcgcatgcggctctattgctcgactcttctaaaaatatttatatacaacaaaacgtgctcttcctctttgtagccttaaccttcttatcgcattataaacccacaacaaggcttaatgacgttcttcaggcgttctttgcaatcgtccaaaagcaactcaacaaccagcatatcctcgttgtacgccactccaaacagcgtcgacactctgacgcccgagtttgtgccggaggtgatcgatgacgagttgaacagtctgcatttcaaattcacaaactttgcactcgacgatgaggtcgtcgatatcgcttcagaaactgccaccgaggcctccggcgtggcaaccatgaaaacttcgccatccttgcgcactggctccgacgtcaaatggtgtgtgctacttgtcggacttcctgctagtggcaaatccaccgttgttcgtcagctcaagcagtatctaacaaccggaaccaagcaaaaatgcagagttgagatatacaacgccgggaatgtgcgccggtcgcagcacccgaagagagcagatagtggatttttcgagttcggctctacttcaacaaacggaagattgcgagaaacgttcgcaagagacactctggctatgctattgggagacttgcaaaatgaccacgttgacataggcatcttggacgcaactaactcgacgcgtgaaagaagaaagtctttgctggagcaaattcatgctgtatcaccatctaccaatatccaaacattgatcctggaagttcagtgcactaataagtctatgcgtcgtttcaacatcgagaggaaagcccagaatgcagactatattcatattcctcgagacgttgccgttaaagatttcttcaaccgtgtccaagtttacgagtcacactttgaacctgtctctgctcaggagttagcctctttaaaattaccatatttatcaatgatcaacgttggtgaagaaatcatttacaacttcgaaaacgcaaagcaaactgacttttcattagaagatcctatattccttttgatatgttcattcgttacggaataccggacccaatacgcccccacatacctgatgacgttaaaatcattctatgccagtgagtatgccccattagtgagcactcccttagcttttgctgcaacctccgctgagacagcttccacacagtgacttaaatataatagaacgtaaatagagaaatttgattagaaacttcgttatgcttattgcccccattggccttgacctaaaccaggcaaagattccatcctgttttgagttggtgcatccttcctttcttccgttggctgcccctggctgtccaactcgtagtaccaggttgttccagacttctcattagtataagtagtgtctttgaaagcgtaagggtcattgggtctgtttcgacaccagaatcttacactacgatctgttcctgctgttgccagcaaatggcctaagggatggtactcgatacagttaacagatttttcatgtgcatagggaattttgtgataaaattccatgttttgctcttcttgcccacggagggtatcatccagaagataataattcattgaaccgtcgtaccctccgctggtcaaaaggttaccatggatggggttccacgaaatacatgaaacgtcagactcatgggatttgttgacgtagacgtcgttcattttccgcaggtcgaatacacggattgacctatctcttccaccgctcgccagtaatcttttcgtggacgactctgtattttgaaaccttgttgctgtaatcgtatgcttgaaaccatgaagtgtagctatgcattttccgggacttgttcttgggtcccatagtttaagtaggttgtcttttgagccactgacaatcagtcctaggtcaggatgccagtcacaggatttaacgtcccaatggtggccagccaaaacggattcttgtagcccattgttgaagttccatattttcagcgtattgtcatctgaacaactgacaaatttggaatcatttggactgaaacaaacatctctgatagcatcagaatgggcacctttgataatgttgacattgttaaaattaggctgccaatacttgatggtcccatcttgatctgcactaagcagccattctttattgtatgaatattttatagctgtgatggcactctcatgtgcttgcatgatagtttcaaaattgaaggtcataccgttccatagtgtgaactcaccactattacttcccgacaggactctacgaccttctggagtccacgaaatggcctgaatagcatgcttggctttgttagcactcaaatgcacaaacttaccaggtaaattgacggccggataacgaggatacgctttaggaggcaaaagatctatcaaataagaggattctggtcgaactatccccaagtgttgaaactttttgttcggctttgtaactcctaacgatcgcaatatgtgccatcttcccatgggattgccatgatcaaccgttcttctatgggcgaccttacgctcctcttcttctgacatcgagagggaagggcaatggagtatgagctgaaaggggttcctgtttctggggcgagatgttggccagagtcggaggaaaaatagataggtggagcgcgaatcggtagtttagaaggaagggccgccagatgcagcttgaacacacctccttctaccactcctgttgtcgttgatcccatattcatgaacgactatagaacaatggataaggtttctaggaagaatgcacggggtacatttcaacgagatctgacttacaacgagccctccctacccaacggcgggcggatcgtgtacagtaaaggcaagatcgttttcgtcttcctcctcttcttaatttccattgccgcttttgtcagtcaaacggagatcacgtctttcgtgtactccgaaggattcaatgaaccgtttctacttttatatttaactcatggatcgtggtttgtgctctggccgttgcagttcatttctatcgcctttttcaagaccactcgcaagtacatccgacatctacgaggttacgagagcttagtccctggtaccaagtggaaagggtttagacgtacctttgccagttcagtgaaggcccagcataggaatatccatcacacctcagagctcatagctaaaagctgttctccaggcttcaagagttctatgcctctcgactatcaaccgcaaaagcaccccaagacctatagagatttcttcacttccaattccataaagtatatcttgctgaccagtatccctattacactgatattgaatgtggctggatcatcgtggtattttgccctgaccttgagcacaagtaacgacgttacggccatttacaattgttccgcatttactgcctatgcctttgcaattccgcttctaggtgaaaagttttcctttttgaaactttcaagcgtaataattgcagttttcggagtctttattgtcacttacaaccctgctgtgccttccgatgacgatcaatctggaaatgacaagtcatataggttcgtgggaaatgtcatcatatcagtgggtgccgtactctatggcctttacgaggttctctacaagaagtacctctgctgtccatcaagcttaatctcctctcgaagacaggcatctatgtcaaactttgctatgtcagtgattggaatattcaattttggtctcttctgggctcctctggtatttgcacatttcaccggactccataagttcaatctggactacagtgggaccatttggctcctggttggcttgtcagtgttatcaaaccttttattcagttgttcatttttagcccttacttctttaacttctcctgttctctcttcggtttcgtccctagtgacaatcctgtttgtgggaatcacggattggctactcttcggtattcagctgagctggacacagatctttggtgacatggtcgtcgtacttggatttggtctattgatctacgggtcctggaatgagattagtgaggacgaagaggacgacctcgttatagacagtgacgcagaaagtgtggtgagcgctcaagtgtccgaaggaagacgatagactatcaaaagaaaataataggtatacgaaacaactcagagaaactctctcctctacaaccagtcatagttaataagttaatctctcaatgagcaaagttaaatatgtatatatacacttcaaagttcaaataatattatcctgttgcaattacaactgagggccggcctggataacctcagtagtgcactcacttgcgtacttctcaaagttctccatgaaaagttgggccaggtttctaacctcggtgttgaagttgtctttaccgtcaacccagttgttagaaggatccaaaatctcggtaggaacacctggaacttcctttggaatttgtagaccgaaggttgggtagttcttgtactcagccttggctaattcaccactgtggatgctgtccagaattcttctggtgtacttcagtgggcaacggctaccacccttggtggcagaagatccagtccatccagtgttcaacaaccaagcggtagattcatgctgaatcatcttgtctgacagttgttgagcatacttcatagggtgcagaaccaagaatggttgaccgaaacaagcagagaaggtagcctctggctctgtgataccgtcttcagtaccggccatcttagaggtgtaaccggaaatgaagtggtacatgacttgagcgttggttagcttggaaattggaggcaaaacacctctagcatcacaagttaacaacacaatgttcttaggatgggagtccacagtgcatgggataagagcagatggaatgtagtcaattgggtaagcacatctggtgttctcagtaatagacttgtcatagtaatcaacaatcttggtaactgggtcgtagccaacgttctccaaaacggaaccgaacttgatagcattgaaaatttcaggctccttctcaccactcaggtccagacacttggcgtaacaaccaccctcgatgttgaaaacaccgttgtctgaccaacagtgctcatcatcaccgatcagctttctgttagggtcagcagacagagtggtcttaccagtaccagaaagaccgaagaacaaagtgacgtccttgttctggacaccctggttggcactggagtgcaaagtcaagaccttgtgacgaattggcatcaggtagaacataacagtgaaaatacccttcttcatctcaccggcgtactcagtacccaaaatgaccatctccatggatttgaagttgatctcgacggatgtggaagaggtcatacctttggtgtggacgttggctgggaactggcctgcattccagatggtgaagtccggttcaccaaagttctgcaactcttcctcagtagggcgaatcaacatgttcttcatgaacagagcgtggtaagctctggcacaaacaacacgaaccttgattctgtaacgaggatcccaaccagcgaaagcgtcaatgacgtagatcttttctcttgttctcagatagtcgatggctctggccttggaaatcttccaggtcagctcgtcaactttcttgttaacaggtccccaccagatgtgttcggtggaggtctcctcgtcgacaattcacttgtcctttggagatcttccggtcttcttaccggagtaggccatcaaagcaccagtagaactgatggcagttcctttctccaacaaaccgtcctcgtaaagagtaggaacggcagcgttgtggcggatcactgcctcagggtttaaacccagagaggcaatgacagaatatgaaggcgaggtagccttttttattttggtttggtagtcttcatcagacacttgttgtaaatctatagcagtaggagccattgtggataataatctatgagaaggttaatctaattcgtaatggcggccagcctgcccctatttatatgcctatcatgacttgccttgaccccggactagtagaggtatttttcttttttttttgtatgagaccgggggatggcgggtggaggaccttttgtccccacatttttggcacacatcaataaaactatctttaagtttcggcgaacacctgacaaaaaaagtgcaaataaggttccaagtcatcattcgaccaatgataacggatcgatagctaaaattgtctccccatcttgtttcatacaatgttattaattattcttaacctatctttccactcgcaagacctcatcttcggtattgtccctccatcactccggagtcgtgaatccaccaaacttcaacctaccccagactagaatacaatatagtgcactgaacacaggccttcagccgttagcccgggtttttagttcctgattcagtcactttggcactccaaagcacccgggaaattcttatcacccgaaactctccgactactctaacttgacttccgtgaacctacgctccgtcaatcattgagttttccgggcggtaatgacaaccgggtggtgtgaaaaccttgtgttgttggcgcaaagtggcccaacccacaaaagtttgttcaacccgatgcaaggctggtcaactaagaattatcagactagaactctcccctacgtcagactccgttccgtcattgtccgaatcttgtgtctccatcagacggctgagaatagttgttctttttgaagggccctccgaatcaacccgtatcgcatcgtctttcccgcgagcattgtaagcctcatccggggtactaatgtcaataattgatgtctctttgacacttgcagtgttgactgaccacggctcttcctgatgatcatcttgcatgatgatggaacttgatgtccggtttcgtatcggcgaattcaaaattggttccgatgtagcacttgagggtgggtgtttatgtggagagtcatgtagccttacagcaaaggatgtactatgctctcctacgtagtccacttgatctggagtctttagtgcgattgacttcttctccagttgtttcttgaagaacgggagatctaataaagtttgtccattgttgtatttctttttcttgggagtggtggaggctgactggaacccattcttctgatattcttgcaccagctttgaaccttcttttccttccagaatgtactcatgcacccatagagatctgttggtagaatctgctgcggcggcttcttggaaaatgccgacatcttcaactaccgattccaagtactcacacactttttgtggattatactttaacatgtacattttcaactcatggtaatcttctaattcatgggaactctttcgaagaaataaagtcttttccttggctacacggaataaatctgaattgagctctaacaaatatggggtgtaagcttccatgaaatattttaaatcagaaatcttttggtaaacatcctcaattttgattttcaacatttgggaaactggcttccattctatcgttgaaactctgtctagaatgggcttcgtatacaacatgatatagaaatcttccatgaagccactcaggtctccttcatattttcttttgaagattgctttactgtgacttttcacgtatttcactagaaaagatcggaactctttgtgtttcttcaatctctgatcgaacttcaaaggggacttgtagatttcaaaaaacttttcactcaaatctacaagagaattctggttaccattttctttctcgtcctcctcgcttgaaggtgaagctctgccacattttgcaagatggatagaccttttgattccgatatcgttaacaccatggttgtaatcacccccgcgtaaactagcaacaaacaataatcttccagtgtccaatcccgttgcatgcgtcactttatccatgcttatgggggtcacataaaactcatcttctggaatatctctggtgttcgacgcaggtttatcctgaaaattctttgaaaaattgcggagcactagagtacctccaaatatcagcgtatcaacatcatttgttacaatacaatccactaatccctgcgtttgtaggtatgcacattgggcctcgccttcaccaggagagatcaaatatgaaatattccaattatccaacagtttgcgcaattgtacaacttcagcaggaagatcccacttatctctctccaactcacgtatctgctccatcacgttcttataatattgatcatgatccactttacccatcaaatcgtcatccacctccaatgacccataatttctcttgaaaattggcttgaacggcccgtcaaagacaatgacgaactcaatcttcagttgcagaagcaaccgaatacgggacttaaaccctatcaaacatttacgtacttggtcatcaagtctatagacattggagccattgaaggaacgacattcaaagatccattggtagccatcaatggctaaacggggcagtcttccgtgggtcttggagaatgactggatgtagaccacaaaaggcacccgctcagacgctcctggaagtagctcctgccaaaggctatgtactgccatcaatgaaagggtggagtagaccttgttcccttgtagtgaaaatcgatatgtgataagatatcgtgcgaataaacatgaatgtttcatatttatcaattacgctcactattaaattgtgagaatcatattataaatcatgctatatatttattctctcttcattggagatagtagtatgttctctattcctcctaaatcccacatctcataaggcagcttcaacggcgatgttttgatatcatcatagagctcattcaaggttaagccatccgcagttactcttctcgacctgaccgaagacgatgatcttgggctccttaactggtcagaggacctattcggagtttttggagagttcaaagcgctatcaggattcaatgcaaaccgaggaagtgaattatcagtttcttggagtattgtagggctttttgattgttctctgtgcttgaatttcttgttaccattttggatcaaatcttccagcatcttgtgagcccttcgttgaatgttcttgttcaagtcatcgtctttcgctgtttgattattttcagccagggtatccttgattttggtgtgtctctctcttccttctttggtgcgtgcttttacccttgaatgcgtttcacttttcagtcgggctagtagttgatccaccatatcatcacctttatgctgcgtggtacgaaggttatctaggtgatcttgtttctttagtttaaaactctccaccattttctttctcatttctagagacttttcttcttcctctttcctcacgttctccaaatgtgcctttttgtattcatccataaaattggctagcttggagaagaaggttactctagagtctatatcagacggatcttcgccaaagtataacatgacattatcaagtgcagtaaaagatcgtttcaaatgagactgtaataccaaattttttctctctgctttttcaagtaagggtttgacaacttcaataactttgtcagaagagttgatttctccgaccttacgcaagttacctttatcaatggataaaatactattttcaattttcttgccaaaatcttggcattctctctctagattttcaatgtctaaagttgtaacctttgtgatagcttcaagttgatcaataaatccacaaagttcaggaaaatggtttcgaatcagcttctcaatgtgatgtaaaaatgtggtccgattgttgtttcctttcagaaactttagtctattcaaagtagacaacttgaaaccttgggctcgtttattatcatcattcataaagtttcccactactcggatgacatcaaaaacttgaaccaaaagctctccagttttcaagctctcaatagcaaggtctaatttattcaacttcgagctcagatcctgatagtctttttcgaatgtagacacgagcaataatgtacgtgatcgagatttccagtacgatctaagcttatagcaaagttccaggaaaaacctatcaggacgttccaactcattaggatcattttcagcttcatattcttgaaatttcttcaatagatgacctgaaacatcaactaattcatctccattgaagaattcaagtaaactggtattgttaataatctcgggttcacagtgcagaattttagagaccagctccatttctgatagtgatcccagactatgaagattaatttcaaaatgttgagccatttctttaggcaataacgatactttgacacgatttgattcatctgtggggttgcactttggcttagtcttagataatacgagactctttttggcagcaaacagcgattctacctctccaagtaggcctttgtccaatatttcaactaccatttgagagtcagacagattttcccaaaatgttttgtccacattttctattttgtcccaatggatttgtttcagtttcaacttgggtttgggtatctttgtcaagaagtccggcacctttatctcttctttcattgtgatgctaggtttattgagaaagtcaggaatcggaggagcgcctggcagcggtggcggtggaggaattgaacacgaagaattaaccttcaagttttcgggaagtggaggtggaggcgggggaagtgcagtctttgcttggagcaattgtggtaaaggaggaggtggaggcggaggaggaggtggtggcggtggtgcagataacgtactgtttttagattctgtccttgtacgactacccaaatctgaaccatcacttgcacctaagccaggacccaaacctggcccgttaccaggacccaaaccaggacccaaaccaggacccaaaccaggacccaaaccaggacccaaaccaggacccaaaccaggacccaaaccaggacccaaaccaggacccaaaccagggccatcaccagcacccagacccggacctgaacctggcccattaccagcaccgaaacctggacccaaaccagggccatcaccagcacccagacccggacctgaacctggcccattaccagcaccgaaacctggacccaaaccaaggccatcaccagcactcagacccggacctaagccagggccatcacctggacccaaacctggacccaaaccttgaccttcaatcctactcaagcctgaacttggaccaaaaccagggatcgaacttgaacgattactgaccccaagcccataacccctgccagaaccttctcctaaacggactgcgtcgtcaaaatcggaagtgtaaattggatctttgccagcaccatcgcttgtgtgatttgccaaaccgtatcgagcactctgcttactatcagtatcatcctttaaagcagaaacaaaggattgtccatacattcgtaagcctggctcatttaggctactaccttccatggaacgatcgatattatgaacgaaattagtgttttcctgcctctcctcccttaatcgtttgagttgactgttggttactttggaaataaagttagtccttgcagcggaatcttttcgtttaatatcagaatgattccaccagttggtagtgggtggtgtcaaggagttacccttgacagcattaacagcgctgttttctttatcatcgtaataaatctgatcgaaaccttgcagactatcttcaatttgatgtgatgtattctcatttaagccatttttcagaacattcaacagtaaagattttagtctattattttcatcctgggtgaggtcaaccaaatttagagcttctcttacatcctgaatggctcgcgtagccaagtcatcagtgtgaactctgtccaaatacctgcttaaaccaatattgaaaacactttcagggttcaatcctatctttttggactctttgcaaatgtgctgtacaaggtaattgaccaagtccaaaatcttggaacttatgggtgattccaaattcattgtcatttccaataaatgactcatgatagatttaaaatacagtcgattgttctcatccaaactttcccaaataccatccaagggtggcatgtgcacagagtaattagcagagtcagtatctgaatcaacatcttcaaattctaaagcttcatatcgttcgacttgctctaaaatggcgtaggaatcaatattctttagcttctccagaatttcaagcagtccaccagcatttagctgacttctgatatgccgtcgttcattaatatctgtgtttccttccactaacgatagtacaagaaaaacagtcacaagaaagtagttgttcagcaggtctataagttgagaaggggtgtcagattgtttcaggaaatggtagtcttccaaagattccaaaacgctggccagccagggacggaaaagagaaatcgagttttcagtttgtttagtttgagacaccaaacttgccatattagccatgataacagcgcgtcctttgggaggtttccaaaggcttaacaaggctaaaatatctgtgctcacgtttttaacactaattctggtcgatagaagacattgtagtaagcacgatatcaactgatttgactcgacggccaagtctgagccttctttgcgattcgcaatgttcttcaagcaatacagcagtagactttcctgctgcagttcatcattagttttcagtgacttcttcaaaatagctgtgagctgcacagaaattgcaacatggccttgtagcattaaaaaatcctggatccatagatttgtttcattgcgtagctgattctcaagggtgcccaatcgtttaacagtcattctctgggacattaatgcttcgacataccactttggtgagtatttctgtgaaggcttgctgctatatttataaggggcaagatcttggataattgttcttttctgtagctgtcctagtgattccttctccaatagctctatcttcttggtgattgaaaggttatttaactcttctctgctggaagctgaaaactcgtaccgtattagcaaatcgttaaacatcagtgaaattctgctattttcattttcgttctggtccagggaagttgcatccccctttttacggcccttcttggtaatggcatccactgagtgtgagatcaattgaatggatttccgtctagcaatgccgacagatcccagcaactgaaaggagtcacgcctcgttctcctttcatcatcagcattgcgtggcaccctgtccccatctgaatccagtcctattcgggaagtatcatcttgatctaaggaaagatcacgatccagagaagggtcagaattcctggtgtttgatccttttagaaaagaaggaggtcggatgttctcattactatcatcggagaggtttattatccggttgagatccaccaatccgtcttccttggaaacgtctattggagtgttcctcatagggagatcagagacaacagagaagatttccagattaggctttacgatatctagcgcatccagagtttcgcggcttcaaccatatgaaacatgtgagtaggactagaacattttggggtgtagaaaggtattgaaaatggactgatacatatgtggtagatagtagttcctgcctaggtcaaactcctcataagctcgtaccatttggaaaaatcccttcgctctagaagaaacttttcgatgtgaacaatgaaataattcatttgactggtaactgtgtggggaagactgatggtatcaagtgtttcaggttggacagtgctgtcggtctgttccagagaatccacatttctcttcagatcttcagtcgccatcgttgtaaaattgttcataatattgcttagcagcttactcaacactaacatgtaacctttatctgaagatgacgtcaggttagttattattggatctgtcatgattacgtctagtttgactggcttctttgcattggataaataatccttgggtatagaaagtcgaataggcaacgagtgtatgcttttctccatatcttcgatgttgatcacgatggggttgaattgtaaagtcattatataaacggtgttgtagttgttctctttgaatttgcgaatgttgaacggtttcaaacgggcctctaaacgggccaactcatactctcttaggtttcgaatgtgcttgggtatattagattctttctgttctttctcttttttcggttgaggcagggacttttcagatttttgtcccgaactgtcacctttgacgctggtagatttgactatttttattgtttctttcttcttctgagataaaagtttttcaaggtattttcttagcgtcaaaatcattcccagtaaatccattcccacaagttccaggtcgtcatcatcattatttggaagaacgccgccagtaggcttgccctttcctttggggtttgagcttcttgtttttaagttgactgccttgttggcaacagctttaaaaccgctctcaatatttaggctgtagcctcttggaatgtcgtcattcagcacagcgatctctggtctggttgataactttggaggaatacctagtgaaatactcaaaaactccaactcaaaaggaaaatctgcttcaggtcgcaaaagaaacgacaagtagatccattcctctttctcagatagtctttttatgtattccggcactgtctctttcaagccggtgacagctattccgttaattgtaagaggtggaaattgattgataagacgagtgatctgttgaagtttggagggacctttcccgtttcgtggcttccttcttcttggtccttttgaacttgctgaagtgccggaagccactggtctattctgctggggtgtgctcatggtgcttttcctgcacttctaggtatagtttagttgtaaggaatgaaatatgcaaggaaaatttccttcgcggccctctgatatttctgtctaaactagtttatgggctcttctcagatggttcttgccaaggtcccatactcaagggctaggcattgcctggagttgattagaagacagagcacaagtcctccattatccaataagaaggagggacttccaaagaagctgtctcaactacgaagtgagtctttgataagaaatatgttgagagtgacaaaaccagatatggtttggaggtccaaaatgttccccaaggacaccctaagcgcacagtcctcattaaacactatacagaacgctcttgtttctcatttcgggaaagttgcaaacagtttcaaggtttccgcttgtttgcacacccatatttcagttggagatgtgatagccttaactcccaatgtgggtaccagattggcagtagttgtacagattcctaactctccgtccgacccacgttacactttgattactgaccaaggggaaattttgtttctttcttcgttgtcttcaaagttacgatttccacaagtttttccaacaaaatggcttcgtaatctggtgattcccgaagaaatatctgacctaccaccagttggaaacccgaaagcggctttagaggaaccagtggatagttctttactcactgctagctcaagcaaagtaaacacttttatttctgccaaatcacccacaaagatcattaccaaatatctagtgaactttatggcagatgcgtggaaaaagttgcctgaactaaatatgaagttagagtttctacacaatctgttacaatcatccgagggaccatatcagataggtgtttttgagcttcttgatgcctgcaatcgtcttgatttgaacaaagtggccacgatgttaacatctggtgagagtccagtcaacgtgtaccagaaaatagccattgaagtctttggcgaggactacacatttaattatcttccctttcaaaactttcctttaggaaagaatgtacagggatcttttgaatcttcgaagaatatcaacatctctgcatttctttctttggtactatgtctcagaaagaattccaaactttacaagcattctattaccagcgttggactaccattagaagttacgattatcccacttccgaaagtggtggaacaagatcgcattctcttgaaaatgaaagaggataagactcttttgccagaactagtacggtatattgactcgaaggtaagaggcgacactgacttagtacaaccggatctatatcctcaagtcatcaacctgttgaaagattattctgggaacgattattccaatcttcctcttcttgaatcactgattgtcagaatcttaagaaacactcacaagtttaaaaatgattttatcactagaagcacagtatatgaattattgactcttttaaaagaaatagagctcaatacggatccaactgaatggtccaatgaactagcaaagccgcataccaatgtttctgaaactagcacccaagagcaaaactattacgataatctggagtttaaagataccactgacccgcttggcaagatcagaaagactttcaatgacactatatacactattgatggggttgatgctttggaaatcgacgatggagtatcaataactgagaatggtgataactggacaattaggactcacatagctgatcctggttcaagactagatctggattcaacactatccaaaataggcttcagaagagcatatacccattatttcccagacacaaacgacagacacattcctatgttacccagatcttttgtaaaaaatgtcgaattaaccaagaaaggtcagccagtgagaacaatgtgctttgaactatcttataacacaaagaaaaacaaaatagaatctgaaaagactcagatttatgccgcattagagacaaactttgtaaaattaacatatgacgaagtcgatgaaatattgaaggggaatgattcatttttggaggagctctcaaaaaagcatgacattagcaaggagaaactgagtacagatattcacaggatgttcactgtgagtactaatctgaaaaatcatagattcaaaaaaggagctttgaatttctctcctatttcaaaaagacttgtcaaagttgagaaagttggggaagaactcagtctcatttttgacaatcaatcattttccaaatcccaaattctggtgtccgagctaatgattgctacaaacgctagcgtaggtgagttttgtgcacgaagaaagatccccagtatctatcgaattattcagtccaagcaacgtgcacccgaagtcattgagatgttcaggcagtcgcagacctgtgtaaatgtgcctttgacacaacgaatcatgatgatgaattttatgggattatcatccttttcatctacaccacgaccccacgaatctctggggatctccagatactgcacagtcacttctccgctgagaagattcaccgatttagcaatacattggcagttgcagtctttcttactgaacgacaaggaactcctgtttacgcctgccaatttggattacatcattttgcatctcaagttcaaggagcaccagatacgatctacgatggacaggtctaaggcttttttcaccttccgtcacctgagtcagttcaaaggggaccagcagaagtttttcaaatgtgtatttctttccaatgtctccagcgcaggtaccgtagaggtgtcgcttctcgactatggagtccgatgtactctcaaaagatccgacgaaaagagtcaccctggagcccgtatgattggcactctcaagataggagatattattgaagacgcatacgttgaggacattgacctgctggagggaaacctactcttacgatccccatcctgtatatagaaggttgactggacgaacttttcagtcagatccagcatcgaatttcatgtacataaataatactcaaaccgtttctgagctcgacatctggcatcgagtatttatttaagcgtaccgcgttgatgatttacttaatcgttaatcaaccttttctccgcaactcccactctatggccttcaccacaaacatccgagagcatttggggtggttggagaagaccaaggagaacattccgcctaagaatgtcttggaaagactgcagaatgtggcaaaggagagtggttcaaccatacgattaacagcacctttagctgcctctccttctcttaacaaaaattcagctccgttacaaccacaaacacagacacagagtaatggagccactggcccagtagaaaattctctttctgctttacacactgtggactcgactcgtcgggtatctactttgaaaagctacaagccacagatggcccccataactagaaactctgctcagcaattaccacaggccatagatcttacagatgatgtatcggatgaggagcacctagtgccttctaaggaaaatcttacacagaaaagaaccaaaagagccgaacagtcaaaatcggacgccccagctaagcgagcgaaggttactaaatctccattcgtagagccaaccacaaccaaatctaacccgtcattgaacaaattgaaaaaacaggaattagtggacatattagctaatcaagagacacttatggaaatgttccaaagcaaaatacagatacttgaggaaagagatgcgataacgaatagcagaaaactctcggaagaagacaaatgctctaaaagagcagagttgcaacttgagatcgatagattggacttacagataacgaacctaatgacaacaatttccaacttgaagggcaaaaaacacaacacgacggagaaaactacagaacaggaaggaaacaatgacagtaatgcaccagaaatagataaccaccccgttaatcctgaaagtccattgtctcccactcaaccacaacctcacaatccttttagagaaccatatccagactccttactggatgactttagcgatgcagacattgatctcacgtttggtgattcaattgcagatgtcaccaacgagcttgaacacaacgacgactcttcaagaatacagacacaggaacacgaaatactgcccatggacgaggaggaacaaatgcttctccagaattttgtagtgcatgaagatggacgatctaacaaagggagtgtgttcgaagacgaaatgagtgaagatgcagactatgtggagtatacaaaatccgttgatggggatttcactgagcatcaaataccacgcgtttctaaggaagagctggaaaacctcaaagactcggtagacgaggaggtggatataattgacgatagtgctcctcaaaatgattatgacgttctcaaaggagtagagttttccgatgatgaggagatcgaaagtgatagcagcattgaagtgatagatgttgtccagtataatgaagaaagggaaatcaacactcaaaatatcaaaaaggaacttcaaactgaagaactttttgatttaaatagcgatgacgaacatgagctagtaaatctgtcaggtgggaagactgattctactgtcggactctcgtctcataatgaggagttacctcaatttgaagatagtcacaggagatttagtacagaaactcataagtatccttggacagatgaagtcttttacattcttagggagactttcaaattagaatctttcagatctaaccagttggaagctgtcaacgccacattgtcaggagaagatgtgtttgttttgatgccaacaggaggaggaaaatctttatgctatcaactgccggctttagtccaatcaggaagcactcgaggaacaactgttgttgtttctccattgatatctttgatgcaagatcaagtagaacatttgatagctaacaagatcaaggcaggaatgatcaattccaaaggtactgtgcaagagcgtcgacagatgtttgacctgctgaacagcggagatctggatttgatctacttgtctccggaaatgatcagtgccagcaatcaagctagaagctctttgaagcggcttcatagaattggcaagttagcaagaattgttgtagatgaagcccactgtgtttcgtcttggggccacgacttccgcccagattacaaaacattgaactacttcaagaaagagtatccggatatacctgttatggcgctgacagccaccgctaacgagcacgttgttatggacattgttcacaatctaggtctgaataagccacaatgtttcaaacaaagtttcaaccggacaaatcttttttacaaagttcaggtgaaaacgaaaactcatctagatgagattactaatatgatcaatgggcaatatcgtaatcaaactggtatcatttactgtcactctaagaactcatgtgaacaaactagtgcccgtctgattcagaatggtatcaaatgttctttctatcatgctggaatgacgactgaagatcgctttgcagtacaatctgcttggcaatccgacaaaattagagtgatttgtgcaactatcgcttttggaatgggtattgacaagccagatgtccgattcgttattcatttaaccgttcctagaacgcttgagggatattatcaggaaacagggcgagctggaagagacggaaatcattctgattgcatcatgttttacagttacagagatgtgaggactttacagacgatgattcaaaaagacgttgatttgaccagggaaaataaagaaaatcacctaaataaattgcgtaaggtgattcaatactgcgagaatggcacagattgcagaaggcagcaagtactgcaatactttaacgagaactttgataagaaggattgtcaaaagcaatgtgacaattgcgttaaagggaacgattcgactaccgaagaaagagatgtaaccaactttgctcgtgacatggttaaccttgtgaagagtttacaagatgaaaaaatcacgctgctgtattgtcaagatctatttagagggtcgaaaagcaacaaggtgatgtcttcgggccatgatagtaatccctactatggtaaaggtagaaacataaacaaaggagacgttgaaagaattttctttcatcttatatatgagcagattctcatggagtactcagtgatgaatggtgcagggtttgcctgcaattatattaaacttgggaaacatgccaattcggtattgtgtggaaccagaaagattgtagtggcattttcaacagccattgatcgtaccaaggctcccaacaagcccacgtcaaagccggcatccaaggctaagctgacaagagttcaacctgctgtttccaacgaactggccaactttaggtataatggaagcgaaagttcttttctttccgcttcttctatcttgaagaatcaacaatccacttcgcctattgtcttgccaaagagggcattctccattagagaagaagaagcccatgttgaatactgttacagagagttgaatgacatccgcagtcgtcgtctacatgagattggatggaaatcctctgcgacattagtcagtgacgaaagcctaagggatatggcattcaaactgccccaaaatgagcaggaatttcaatcattggcaggtatgaaccctcatcaattacaatatttcaagctattcagaaccaaattgaaggcattaatgaatatacggcaagccggatataaggactatcaattagaaatcctcacaggcaatgctgaacaagatcaaaaccagcataattcaccatattttgcccccagggctcctactgaaagagataagcagatcctaactcaactaagcagtgtattcgatgcatctcaagcttccagcactaaacccatgccagcttccacatcccaacaacgcaccagtgggaatcatcacaatggcaggaaaaaacccttcaggcgacgcaaaaagagctcttccatcaaggttatgaagtgacatctacttcaaggaaagcttcagttctattcgttaaacagtatcatcgtggtagtaaaatgagctatgctgggggttttcaggtgcatgttttacataattgtcgtcgtctggtggcctctggttcaagttgttgcttgcaagcatactttgcacactcatggatatggatgccactgtctgggaaggggtccaatcgttacccaaaatgttcaggcagatatggccattggagtatatatgagggtgtatggggatcttgtcaatgaattgaacttgtggcggggaaaatgggtatttgtcagagaatataaatctcaatctgtaactgtcatcaatataaagtgggttgtccaagactgaaacttggatgaccaaagtatcaaaactatcagtagcttcgcatgtgattccgggtacctgattggatactaggtccttgtattccttagccagtctctttcctttgaaagacattagttcttaagcgagttgaaacctgcaagggtgttgaatgtgtgagtaatgtggccaaacaataagatttcagtggcacacggccctcagatttagcgttttccttcaccgcgccaagggaaatttcattcctctgtccagaaaatcagaaaaatcccttctagctttccacccgacctgttcctgcacgcgatctgtcaactgcactgaactgattctcctttcattgccccaagaacatcatggactacaacttatatggcttttccaagcgtcagtcgatcagtgagggaacgccatatagtaaagagcatcctcatggaactctgggtgatcggcaagctggatttcattctcagccgcagtttgctcttcccaccttcaactctctgccacgaaggtctgcctactacgagacccattacccattgtactattccgattggaccaatattcaaggaaattcgaacgattatgtagctctcagtagttacagtgaagattcgacgaataaagttcagatcgtgaaaggcataagagaaatcaacgaaagagacgatgaggacattcagttctcaaagacaggagaagtttctgtgaattacccagtgaccaaactacagtgggaccctcaggtggcgtctggaaggagttatgaacctaaactggctacatcctcggaatgtttacgactatacgaataccatgaagaaggagaaatatcacaattggtggagacagcaattttatccaaccccaagaataagagttttcatcaacttccgcctatgacttccatggactggtgcagtgccgacccctcctatataattacctgttccatagatacgacgtgcactttatgggatgtttccaagggagctggggtcgctaagacacagttgattgcgcacgatagtgaagtttttgacgtgcaatttttgcacaatagccagaacctttttgccagttgtggaaacgatggttctgttagattgttcgatctacgctgtctagacagatctaccattatctatgaaccacacgcggcagcatcgtccggagatcatgcttcgagctcttcttacaataagcgacatccattgttgaggattagtgcttccaattacaaccaaaaccatataactgccatcgaagcaaacagcaacaggttggtggttctcgacctgcggtatgctggatctcctattagaatcctggaccatcatgcgggcaacataaatagcgtcaagtggcacccgtacaagaactttctgcttactgtgggggatgattgtcaagcgttcatatatgacttcaacgccctggaggggtcgaaacctctcaccaccacaagctcatcgaactcattggcaagtgggaactcacttaagcgagttcacactaatggcgaatccgatatgcctataatggcttactccgataccattgagttgaacaacgccacatggagctccaaaggtgactgggttggtctggtgggaggtaagggtttccaagctgtcaaagttgatgattaagtaaaagtgcgtacgtgttttgactctttcattttgacttcgcgatgacttcaattgtctccgacccaccgaaatatggaaacggagtcaatcaataagaagtaggcgataacgctcatatataggttccacatcaccagcagccaaactttttcaacttcaacaaaaacattcagctggcatgttaagaacccagttctccaaagcattgttgagatcacacagagtgaaggcgtgcgcccgtgtagctacagcaatcacgtcaagaagattcgtctctgacacgacctcagctacattcagatccatttatgagaagggatcaagcactccatctccgtacgatggaacggacagtttcccaagacgccatttaggtcccactcccaaaaatgttgaagaaatgttgaaagatttgaaagaatctgacttggattcgttcatagcaaaggtcgtgcctgacaacgtcctgataagaagaagcttaaaggtacagcccttgaaaggtttcaccgagtctgaaatgttggctgatctagccagaattgccgagaagaatgacttggttaagcctttgattggtaaaggattttatggcaccattatccctcctgtgattcttcgtaatttgctcgagaatccaggatggtacacatcttacaccccatatcagcccgaagtaagtcagggacgattggaaagtttactcaatttccaaactgtcatcagtgatctgacaggcctcccggtcgccaatgcttctcttttggatgagtcgtctgcagctgcagaagcaatgattctcagttttacctcactgaaaagtaagaagcccaaatattttgttgattccaatattcatgagcaaactttagccgttttaaagagtagagcccacactctcaacattgaggttgtcgtggcagaccttactacagacgaaggttttgcaactttgcaagagaacaaggatcagttatgtggtgccatggtccaatatcctgccactgatggttcaattaaaacgttcaaggcctattcaaggattgctgaacttgttcatagtgttaaaggtctatatgctgtcgcttctgatttaatggctcttacgttactccacgcaccttctaagtttggtgccgatattgtcttcggtagctcccaaagatttggtgtccctttaggctatggaggtcctcatgctgcctttttctctgttgttgaaagcctacaacgaaaaatccctggaagaattgttggtgtttcaaaagaccgattgggaaacaacgctttaagattagctttacagaccagggagcagcatatcaagcgagaaagggccacttctaatatctgtactgcacaagcattgttagccaatattgcggccaactatgtcgtttatcacggtattgaaggcttgagaaacatcagtaagagaattcatggattcactactcttcttgccaactccatcaatgaatcatcaaattacagggtgctgaatgagaaatggtttgacactctgagcgttgatgtgggaagtgcggatgaattcattgctaaggcactttctaagaatttcaatgttttcaaggttaatagctctactatccaattgtcattagatgaaacagttacaaaggatgaactgacgacgttgattagtctttttaccggtttgtcagaagttcagcttccagaaacactcccttcattctatgaggaatggaccagacaggatgatattcttactaatgaggttctcagaacacatcgatcagagacctccatgctccgatacctttacaacttgcagaagaaagatatatcattagctgattccatgatatctctaggttcttgtaccatgaagttgaatgctactgtagaaatgatgccgatatcatggcctaagtttgcaaacatccatccattcgctcccaaggatcaagtcaaggggtacactgagttgattgttgaactggagaaggatctggctgacatcaccggcttccattctactacgcttcaacccaattcaggggctcagggtgaatacactggccttagtgtgattgctaagtattttgagagcaaaggggaagcccacagaaatattgttttgatcccagtatccgctcatggcaccaacccagcttcagctgctatggctggattaaaggtggtccccatcaaatgtttgaaagacggttctttggacctgcaggatctggaaaccaaagcatcgaaacatgccaagaatttggctgctatgatggttacctacccttccacatatggactttttgaacctggtattattgatgccatcaatatcatccataaccatggtggtcaagtatatttagatggtgctaacatgaatgctcaagtgggattaacatccccaggagacctgggagctgatgtatgtcatctaaatttacataagacttttgccattcctcatggcggaggaggaccgggtgttggccctatttgtgttaaggagcacctcactcccttcctacccagtcatccgataatttctaccaccaaccagactgagcagagtattaatccagttgttgcagctccctttggtagtgcttccattttgcctatcagttatgcctatattaaaatgatgggtggaagcaatttgcagtattcgtcaataattgcaattctaaatgccaactatatggtagccaagctaaagaaccattatgaaattttattcacaggtggcgatgacaagtactgtggccatgagttcattattgatcttagaccattcaagaaattcggaattgaggccattgatgtggccaagcgtctgcaagattatggattccatgctcctaccatgtcgttccctattccgggcacattgatggtagaaccaactgaatccgaatacaaagaagaattagacagattcattgactctatgatctctattagagaagaaatccgtaaagtagaaaacggagaaacagatggtgcaatcttgcacaactccccacacaacctaaaagatattattagcacaagtgacgctgagtggtcccagagaggatacacaagagaggaggcagcctacccattgccatttttgaaggagcaaaagacatggcccactgtttccagggttgatgacacttacggagacatgaacttgctgtgtacttgcccttcggttgaagaggtcgctgctagtcaatagattaagtaatagcaaggtaaagtaatacagggagttcaaggctcacccgccagccatattacagtaaagtagaaaagataaatcgatcaaagttacaaacaataacagtaaatgaagaaaacatcaatgttaacgaacaaaatacaaatatatcatgcttgtattattattatgttaataaaataaattaaagcttcaagcaatctatttcttagcggccttttgagcagccttggtgaccttaccagccttgtcagtcttgacaacggacttgataacaccgacagcaacagtttgtctcatgtctctgacagcgaatcttcctaaaggtgggtagtcagtgaaggcctcaacacacattggcttagatgggaccaacttgacgatagcggcgtcaccggacttgatgaacttagggttctcctcagtcttcttaccggttcttctgtcaatcttctcaatcaactcgtcgaacttacaagcaatgtgagcggtgtgacagtccaaaactggagcgtaaccagcagagatttgacctgggtggttcaagataatgacctgggcgttgaaagattcagcggcctttggtgggtcgttcttggagtcaccacagacgttacctcttctgatttccttgacggaaacgttcttgacgttgaatccaacgttgtcacctgggacaccttgctccaattgctcgtggtgcatctcgaccgacttgacttcggtagtgacaccagctggggcgaaagtgacgaccataccagccttgatgacaccggtctcaactctaccgactggcacagttccgataccaccaatcttgtagacatcctgcaaaggcaatctcagaggcttgtcagttggtctggatggtgggtcaatggagtcaatagcctccaacaaggtcttacccttggtagcaccaccagccttggtctccttctcccatcccttgtaccagtcacagttggaagatggctcaatcatgttgtcaccgttccatccggaaattgggacgaatgggacagtcttagggttgtaaccaaccttcttgatgaagttggaagtttccttgacaatctcctcgtatctcttttgagaccatttgacggagtccatcttgttgatggcaacaatcaattgcttgacacccagggtgaaagccaaaagagcgtgctctctggtttgaccatccttggagataccagcctcgaactcaccaataccggaagcaatgaccaaaatggcacagtcggcttgggaagtaccggtaatcatgttcttaatgaaatctctgtgacctggagcgtcaatgacggtaacgtggtactttggagtctcgaacttccacaaagcgatgtcgatggtgatacctctctctctctcagccttaagcttgtccaaaacccaggcgtacttgaaagatcccttaccgagctcttcagcctccttttcaaacttctcgatggtacgcttgtcaataccaccacacttgtagatcaagtgaccggtggtggtagatttaccagcatcgacgtgtccaataacaacgacgttaacgtgcaacttttccttacccatgttggcgaataactaaaatgtatgtagtgagaataaaagaaaaaaaagaagagtcacagcggaggtcctgctctccattttatatctgctgaaaatcttgtgtaaaaaaaaaattttcgtgaaaaagaaattctttagggaaatttcagccaatcatgtacgagtgcgtgtgggactgcgaaattagtcctgagtctcttgatggcaattctgatagagagaaatcgcaaactttgagaggaagaacatcgcagaggataagggacagtctacaacacttatatccgacaaggattgtttttacgaccattatgaagcaagttgtaggtatttttcccttgctgtcctccagggttggctcagtactctttcccactaaggggacacctcatgcagtgcggcagataaaagaggcgacagttattacctgattgggttaaagatttaaaatttttttttttcacttgatacgcaatctgacacgagttggaatgggcaagatggttaaaaggtgaaggaggccagacaggattggaattaaggatgtgtagtgtcaatggtagtaccgcaaggtagtttagtgttgttccaaaccttaagcgtgttactggttgccagagttacgtaaccagatgctgagattaagtttgcttcttgatctagagcctgtatgacgggtcaagtttttgataaagttggactcttgggcatgagcgcatcctcacatcggccatagcagataaacggtagcagtttttttgaacgaggctgtaagataggggaatctccgttttaggctttcagtgacttgttgcatcgcaatgggtagatatgttcaccagtggcaaaagctctggatgctatgaaactgaccaaatgtggattagaacttggagtctaactatttgactctaagaatttcaaatttttgccttctactagccattttctactttcatgggacatcatcacttatttgctccccaacctgtcaaatacccaccaatgttcaaggtcgtactctgcaaccaccttgaatcactgacactctctaacctttcttctgtctaccttttgtcaccattttcaaagtccaactcctctgaaatctcctatgaaatgttcacctcgctcgaccatctacagacatctgaaatatggaactaccacaaaaccagtactctttctacttcttccagtaatgagtgtcagtactcaattccactccctagatgagctggatcctcctatacttgaccatggaaccctcaactctgaacattcaactatcaacctagaacaacttaaatctcagctgtatctcatcgatcaagacatacgagcacttctcagccaaaaagaacaattaaaagagcaattcattctgggacttccaactgcgcagatagatacatctaacactctaaatgactccagtgttccagatttcaagtacaaggaggctggagtacagacagagccgaaaattgaagttgaaaaacgaacagtttccttcgccgaagcagatgaagtactacatttcagtaaagatgatacctgtaattctattaagcactcgaagaaaaataaattggatgcgatagtgactctcctaagaaagtccactattaagcacgcattcagggagttatctagctttgacgatgtgaagtcctcgatattccatccagaacactcaaaaactcaagaaatcccaacacaaacagaagccgtacagccatcttcccaatctgtatccacatcttctaacatcagctatggagacatattggaatcactctcagcgcctctttctatcaaagagtcattaaacgaatctctcaaatccagatcgtcatcgaccagtctaatacttaagctgactggttcctcagaaggctccaggcctcaatcagctgaagaactcgtatttgagcctgatcatggcccgtctataaacgatatccctctcatcgaggacaaagcctttcagtatgagccatcgcctcttgctactccaacaaatggtataaaaagatcatactcgatcagaaagatgttgaaaactgggtcaagtcatccaagatacgttggcaggatcaaaagcatctttaaacaagagtctcccaactttagcaggtcctcgactcatacatgcgaagattgcgaggactgcgactacgttctgggatccataaaatcggcatctcagaactctagatcactgaagtcacccgtcatgacctgcccaacaacatcttcactctccgaggcatcaccagcgactccatttccaggtgaaaacttggatcaaatggtgaaaaatcagattctttacgacgatgatagaatatttgcctggaaggaaatgagaacgggctcccaaaggatcaatgatcaatacgtaagtgtttcccctatggtcaagcgtggctgatggaagacacaattcgtgacaaaggattaccaaacaacgagcagttatcatgtatggcatcatctatactttgttgtataattccgtcccagtctgacagccatataaaaaagctttccgacgtcgagactaaaattaatgcaatcaccattccataccataatcccagcagttccatgcctaagtggaatccgcagtaccatgcaataggtaatgccacaacgtagtaagaaaaaaggttgagaaatcccccaatcttttgtcgtccttgacctcttaacaccccactagcaatgcatgagataaaatcgttgacctgatagatcgacccaacaataagaactttactagcaagttcaatgacttcagtatctgaggagaatagacttgcaattgtatgtctaaagttgaagagaaatgcggcattcgttaaccccaaaacgagaccaactagcatggaaaccttcacagctaaaattgcagcgtgtttagacccactgccaataaaccatgcgactcttgtggatgaagcaatagagacggcaaatggaatctggtacatcagaacacaagttgttgagactaccgtttgacttgctaaaacagtaggaccgaaacggctggcaaaaaaagtaatgatttcgaaagccaaccattcagcttctaccattagaacacccgggcctgcgagatctagcattcgtttccaattcttgaaggcttccctagaaaatccacaccagcactcgtggcctttgaccttggcaatataaactatcaacatggcagccattagccaattagtaaagacaacagctaccggtgcacctatgtaccccaatccaatctttttgtcccagaccaacaaataattaagaagcatgttcaggggagcacagaacaataatacataggttgaggcatgaaatataccctgggcctgaagaaagtgcttgcagttttcaaacagaatgaatccgggaagtccaaaagcaagtaccctgaggtattgacttgccaaccctgagagctctggattgggaacaattctcaagagaagaggttttgatccccagaaccaaaggcagaagattgggatgtagagtaataggaggaatgtcgtacatctaagaaaatgtacccccaccatgcgatgatcatttcttccaaatgcttgggggcaaagcgtgtccagacacgtagcaattccctggataatactgtatgctgtgacattggcagtcattgatgctaaagacactgctgccaacggcatctctcctagatgacccaccgaaaacaccgaggacacagtcaatgaatactgaagcagaaaagttacaaccaatggaatagaaaacttggttagcattttgatctctgtaatgtaactagtggaagactcatgaaacgtcccatgagacatggcatatcgcaaactctgccccctaatactggtcaacgagggccttctacttgaaaaagacctaacatcagcaccatctagaatcgatccgtagttcacctgagacatggcatccccatccgactcatcgagggacatgcgctttggaaacgtgcgataggtcaaactaggaccattagaaagtatgatggacccccttctgggggcgctgctattgggcaaagcaagagcctgcgaggtcaaggagacgtaggagtcatcgtctccttcaaaagtctcctcaaaagtagacattgaaaaatattgtgtagctgatcaagggtgcctggaattttgataagataaattaaggcatcccaacgttttccgccaaggaaaaatcgcgttgctttcaaaagaggaaagttaaaaacatcaattatagattaggtctaaattatcatactaaatttacgtcacattagagttctatcaaaggcgcatcaggctctttggcttcgactgtaggaaccggcggtggactattttgcggaacttgaggccaggtagtagcttgttccctattgacagcattgatttgatgttggttttggttctggttctgatcagctctaggatatgaataaccactgtttgggtagctaggtgctggattatatcgaacgctgtcatgcctttgaacttccctctgatcgtatttatcgtaactgtactgcggcgaatatggctcagggtgagcctcatatggtggttgtgggtagccgagtggagtttccgcagactcaggaatatttgagtactctgggctaaattctgcgggacttctagtatctttaggggagccttcatacattggtacattttgctgataacttggatatcctggttgcggataaggaagttgctcaggcggataattagagtgagatgtgtcccgtgataaagtcgaatcgatcctagcaagcagaggtggagccgggtagactgagtttgatgcgtgttgcggtacacccgagtctatctttgctagttgaggtggcgccgggtaggaggagtgactctgatagctttgtcttctagacggtggtgatacctgatattgagcaggctcagaaggatactttaagtctcctggaggttctgaactcagtgctaatgcaggaggatgctggctatcattggatggttcgtaatatggttgctgaatgtgatgagtaggatcctgtagtggatgctgagaggaatgatcaattgatgaaaatcgagaacctggttggcggtaatgaatggagctccttccagtagattgtgggtgtagcggtctccccgtcacatgagctagtcttatttctaacaattcatcgtaaagcctggtaatcgtgtcgatctttgaatacatgtcaacaaattggtcatacttttgaaccgaatccgcaacgctcttattcaacttgggtctcataagtgtaactttggaatgtaaatcttgaagttcttgatcctgcagcactgatccagtcggttgctccctcaatctttctactaaagtactgaacaaatggatatctgccacttcgcctccagtaacttcgttttgcctgaacctcttctcttcttctgatatgggaatctcattagctggtctataagttacaacttcaggctgctggttagaaatcggagtcgtatctacacttgcagttggaagaagatttgcataataatttggtgtctcatcttcagtctgggtatgtggattggatggctgggattgcttcaaatcttttaaacttgcttcaatcgcagctttcatttcttcatcgtcgtcatcaactttaacggtggaagatacttttggaccagcaacaggcacaggatattgtgaaccaccgctatcctttaatgagagttcgattgccagtttcaaatcagcatccatatccgcgtcagaaggtgcggcagcggtcgtcactgagtttgaattcttgtggcgttgttttcttgacttatgctggtcatagcagttatcacatactctgaccggtagggtgatgcccagttttggcagcttgcatctctttgcagaatgttgtccacagaatactcccccacatgaacggcaatggtgtttcctgtttatcatggtgaataaatcggagcatatcatacaagcatctgagtccatccattctggtgcaacctcagattcaataaaacttgctccaatggtctcggtgtgatatattgagggaaattcgaatatcttctcatcttggagcttattgtaaatggttgtcacgtactccaatttggggttagtgctgaataaaatcgaccagttttggatggagtctaaaattagagccttcacctcagagtttaggctcttatcatgtagtttcaatacaatgggatccagaaactccttggtactgatttcttggacaaaatgtattcccccatttttgatacaaaagtcaataagtttgatactggatttctgtatattgggattgttggaacccatgaatcgacgtttcagagctctcattgcatccctaggagtaacctgtttggatcgtattatatcggtgatctccagagaaacctctaggtcgatttctccgtcgggtataaactcggatgttgcctcattaattttgttttccaagggaactgagttctttccactgaaccaggacattcgttagaagtatgggactgttatcggggaaaagccaaattacaaggttcagttaaacagtaggaggatggcgaacgcgcgaacatcgattgtaggtgagaccgtgtgattatctaagatacgtattacttaatacaggaagtagatggtggatccagcacccatcagaattgccccaagccaccaccatagagtgtaattcaaagaagattccttgacagcgttggtcctgtatctgttctctagtgatctttttatcttggcagaggcaccagtggcggttgcttgggcctcatcacttgctgcagtggggtttagtacgatcgtaggcaacatgttgggaggtctgtacgctaagtagaggggaggctgtttcacaccatcactggcatatagctgcagctggatacgaccgtggtacgtattcagggacacttcatagttacggaacacctctgtttggttgtaacgagaataggttgaaatccctttatcctcgcatggttgcgataaaagctgtcttccgtcgacatcatatggctccaaaacgagagttccgttatctaactctctgtaggtaccgtgttggaaaattaaaacagctgtgggacaatgatgatccttcgcatttcccgcaacctggtaaagggcctcttcaaagtatccgtcatcagtgaaagagtaggagatcccaggcaaatctggttcaatcaatagctcgtccactggatcataaaagcctgatcctgtgaacactgtgttggatttggatgaccatgttccgacgatagtaagctcggattctgggacgctgtcatcagcaagggcggcccgctggttgaagaacaaagtgtacgcaaacagcggcaaaaaattttgtatcaaaaccatattgtattatttgtggctgactgatcacagatgtaggaatgtggctgtgggatagtgataaaaaacaggcggaaaacaaaatgaaaagggacctgaagctgaacaatgagtggtaccagaaagttgtatacgccagttaaaaggacagtaataaacgaaggggcttgggtagcaacacgttccagaacacttggcagatagtggaaagaggaaaaagaatgttatgcaaggaaagacagaaactgaatttttgccaggatgtttcgcgtctggctatttaaagtcgggcagtagattatgtaagaaaagtttggcacctcacaggagggcagaagcaagtgaacaatttatttggatatacggggtatctggtacaattatgaaaccttgcggtaacgagaagctacttgtgataaggtagggctcttgcgaggagattgtgatatccaaggctttgtaatcgaaattgttggtgaatggtgttctgtgggtgatgagctcacagagctgagtgaatggttcttgaatttcatggtgggaggttcaaaaatagaatcgaatgactcgtctccagactcccagtaggtgtcttcggagaatatgtcttcttcttgtcctgttaaagagaatggagagtgtgcactaaattgtctggatttcaatgacaccaattgcatctgggccatcttttgaaactctttgactggagagtgtgcacagtaagtggatactagagtatcagtagcatcgactatgcattgtaaaactgtgatagtagtgttcttattgatggctggctcttccagtttgggatgtgaagatgtatgaggaggagacaacaatggtaggtttgggtttagagatgctatttgatgagatggagttgttgtatatagggttgattgtttgctttgctgtgacattaatctgcgtccttgactgtgtccttgtgattgtagtttgtcgtaaatgtcattaattgaagctgccacctgggccggatgattagaaataagttcagggttgtacagggtgcagttgatcatgaactctttgaggctgatggctgcttctttgtctaaaggaaggaaattggtcatgttttggctgctgtccacgtccataatccattcatcgatgccaggctcggtgacgctccaacttaaagtgtccaaaatgtgtcgttccatctggatgaacatgccctcgtcgtaattgcaagaaggcccacataattggcacaactcggtcaatcttgggatacgggctctctttgtgggtccttcgaatctacctccaattggacatgaagaagacgaaagacagtggttgcagccaccgtccactttggcgacaatccatagacaggttgaggcaactaactgagcctggtcgactaggacgattctctttgaacagtatctatccaacaaacgtacactcctatagaaaagatgactgcaaattctggttttgatgaaaactttgaacagaaagtccagaagaggcgatctcaggtccaatgtaagctggggctgctggctgatcagattaatgtcaggtttgaacatgttagcgtcctcaaaagaggacatggaaagttccttgacgtattcccctacaacatctctatgagtggtgacttctttgaacaccagcgagttgggatactgcttcggatcgtgcttgtaacggaacttgccattaaaagacatggtctgacggatctggtggtgactgacggagaaaaaaaagttatttcttacagagactccacaagaggaagctggtccaatatttattagatctgggtcgactgtgaggaaagggttaaaatctcagttgaggcacaggaacctgcaccgagggggttccttagagtgctgtttgtttacaaacaccataaaaacacgtctggtaaggatagatgttggaattacctagttagggatgagccgcacaggtggcaggagtcaaatacctagtacctgttgcgaatgcgcgtttgtggtgaggcggattggcgaggataggatccttaccttgcatgtgcggcgctagagaaggagagaattagacgtgaatccacgatgttggtgttatgggttgacttcgtttgggtgaaactgtggagctcacaacgtcgtctcacaaatcttctgcaaaagcgagatcgttgtttgaccatggacacactgcacacgatagactcgtacgggtcgcagattgtcccaccaaagacaccagatcgaaaggggttatttacgagggcttttgattttgcctggaggaggagtccagaaaaagaatcatcagccaaagataggtatgatgaacatagtaccaaccgcataccaagttataattacagacccacttctccctcgatatacgatgacaggaacagctgggttgatgacgagccggagatcaatcagactcttgactttatccgtcagcagaaagagaaccattccagatctctaatgtccatgtatcctgggaagtttccccaaaataaacatgaaagtgctcgtagcatgttcgatacaacaaaaatgaacactgagtacaataaatcgatgtacccatctgggcaacgatctacttctcaattggaagaatcgatattgagtcgtttgaaccacaataatcaagcactaagagatatatccatccagctggaacaaacgtcggattattctcaattacagcagaactatattgaagaactggagaaatgccaaagggtttatgatgcatactacgatcttgcttccaagtatcaagaattgaaaagaaccccggttagagaacataatatttcagctcccccagcgccaccgcctgcttcatcgttctctgcaccttcttctgaaatactttccctcaaaattgagcaacttcaaaaagatctagatcgtatgactgaaaaacatgactccttgagtaggttgtaccaaaacagagattcaagggcgtttaatacagacacgcctgcacggccaagaacagaggaaaagttttcttctgcctatgaatccaggtttaaagacactccttcatccagaaggtccgtcagttcaagcatcaatgatcctacttggcgatctcaaaggttatctacctctagccttccaagaagccggtattcttggttgaaaaaggaagaggatgattcggctacagaatcgttgattaaaaagtatgctcaaacgtaatgagctacggttgtaaataaatagcatggtaaatccagagaacatggctactgctcatttactgcatgtaacctcgctcgccgaccttgtgctccctccgcctaatcctcctcccgatactgctcctagcatggggttctggttccgttgggacacacactaccttatcgttttgacaaattcttcgataccaagtagtctccagttcagttccatcaatcgatctcctttcgggaatcaatccaactcagaaaatcgatggcttccacagaactggtggcatcaacccccatgccttctcgaaatggtcagggatctcaccagaagcttaatggtggcaatgtcaattctgccaccaacacacccactgttgccagcactccggttaaccaacctcggaaattaccatcagagaatttttctggtcttggaggagctatcagaattgaaattgaaccactggttgtggactttcaacgaagactaggaaaaaattggggccgatatcagatagctgttagtttgtttcttgtggggaagttgtccagaagagagctagtagatgaattggatgacatactggatagaaataccgtgaaaatgcataaccaactacttttgggcaatttggcaaactctctcaaagaatcggccggtgatagagttggttccggtggttttggtggttcgatgttcaataagagagtgaaagactcccgtaaatcatcacaatacgaacgacttaaaagagatatactagcacttcctgtgcgagaaagaagaagaataaaagctatcaccagagagtccggaaagaaaggtatggtcaactctgtgataactcaaacacgtcaggccttaattcccaaggttcctgtagtgacaaggcctaccaacgtcccaggaaattctgtacagtgggctcaggatgtcattcatggattccaagcactgctcgcttcagagatatacgaacttcctgagatggataatcttcgaactagaatgactggaatcagtagagaacatgggctaattggaccagtagatgattctgttattgaaattatgttgatagggttggagcagcatcttaaaggcattgttgaagccgccattgacattgtcaaatacagaaggacaaagtacactaataactccgtggtagatacgttacaaaaggagcaaactaatacctcagacacatcttcttccaaggtctctaggaaaagagatagacatacattgacaatcgaagacatgtacgacacgctagaacagtatccatatctggtggaaccaggtggaactttacttcgactgcaaagcgtcatgcttcatgatgaggacgagctttcggatgatgagattctgaaacatattttgaaacctagaacttcagactcaactgatagaaaaccaaagcaattacaagaaaatggtactgcagactctttgagcaaggtaaccaagtccatcaccaacggagcgaatgccagtggagatgcagtgcccaatggtaaagcggaacatatacaaaatactatgggaaccaaggaagaattaaattggttcatttatgatattctatctaacaatgaatagagtgttgatcacttacgaattgaataatttagacatcaattgaagccactgagcgagatctggatcgtttttaaggctgaataatgcgattgtgtttgtagccagacttccagatgatgccttgtgatagtctgcttgtttataggtaatcagactagtgaatgaggaacataatatttttaagcaaaagccagtttgcaggttgatttctttttggacaattggagaaaaagtcactccgtctatactgtactctaaactcattccagacgatttgaactgctcggattctagctttgattgtaggtggtctatatgttcagataggaacttgtcgaacatttctgttgttaatgaattgttaccagtaaataaaaactccatatcgatttttctagtaaccattttgttgaggaagaagaaactttggtcaacaaagtcatctaaactggtgaatgtcctcaaaagaggaaacttgtcgttctcatattcaatttcaccaatgctccattctccaactgaattttcaaacgaaatgctttgatcgtcaggcaacagagagtatatacgacgaaattttttgtattcatgaatctcatgttcaaccctgttgtacttgatctgttgtttgcgtaactgggttttttgagactcgataatcaatttctctttggctatttcttccttcttggcttctttaatctgtttcgtctgttctatctgcttctgtagctcctccagttgggcttcaagttgctgcttctgctcattggcctccacttctgtttttgcatacaatttcatttcacttttcattgtcctgatggcttcttcgtaagattcggtttcttttctcaaagcttctttggttgcaaatagttcatcagcttccttcgttatcttcttcagttcattttctaactgtggaacttttgattcatttctcacggattccagtttctcttcaaagatgttttccttttctttaaaaagattctcatagtaatccttgcgttcttcaatttccaagagtactaacaagttttcgtttttcaacttgtttattgcatttatcttttcattatcttcgtattccttggtttcatcaacctgaagagtcaactctttctttaagttatcaaactcttcaagtaagctcaattggtactcgttaaactggatagaacaccactcttcgtattcttttacttctttctccatttccagggtttttgttctcaaagtctcttccaaagtgggtaagacctcattcctgagagtttgtactgatgcagcgtaggttctggttgtgtcgctgagctcttcgatctcctcacgaatggtccttattttctcgttacaagagtccagttctttcaagacctgctcggaagcctgtgactttctatctgcttgtattttctgaaatttgtcaaaagattctctattaatttccagtgtgcttgtcgtgtttgatttaggtgagatatcattcaacggcattcggcctagtatttggttcggctttacctttttcacttcaatcgactttatcgggagggaagacctttttcctggcctttcaatgccagaaagaggctttatcttttccatgtgggtcactcctggggatgtaatcacaggacagtagatcaacaaacatagagggcgtcgcgacgtttaggcggagtcttatggggaaggttcgcagtggatatctgcgaaatcttcctggcaaggttcttacctatcactaaatggtcaaacaccactgactataggatctgataacagatagagtgtcacttctttgctttaaatagcccttttgatggatatattaattcaaataggtaaattttttagagtaatctttctgatcaattttcacccatcatgcaaccttatttcacaatctcctcaaactacttatagctgcaaagcattccaaatgcagtcaattactttgccacagaggacaaatcatgtcaagtaaccgttgcttcatttctatgagcttaaatattatatacattaaatctcccactacaacttcaattcaatcaaaatccgaagactgcaagtttctggtcatcgcaggtaaagcaacccgaataccgtcgagattcttcttcataaacacctggcatcccaaacgagatgtctctgtaagtccgaacgccaaatcaagcatatcgttctcatcatcatcgggttcggggatttcatcataaaactcgggatctataattacatgacaggtagaacatgcacatgaccctccacatgctccttccatatccaaatgatttccctgggcaatatctaaaagggagtcaccctctgcaacttcaaaagtcttctgtgttccgtccttggtgataaatgtgatatgcaactcctctccgggattcggctttttgagatgtccatgaaaacgaactggtattcttggtagccgcaacaccggattatgccgatatttgattgcactccccaaatagttcaaagccatgcgcttggtaaagacgggtttgaacattgtttctacgctgttggggaagattggttagtaagtaacttttttttttcttgggcctctttaggaaatactacagagtcatcgggcgcacctcgcaaattcatgagagctgccggcgctgcaagagccttgaagagaatggcaattagaagtttgcggtttcgaaaaagaacttgctaaaaaaactcactgcattcaccatgttcactagaagctactacagacgtggactaggtctgacctattaccgtcattgcactcctaatttatcataactttgaatgacatttttcgctaagtgcccttcatttctccttctaagtgcggaggaaaatcaactgatcttctatcgtctcgtctccaaacatccaccagttcaaatgttcagactattaagatctagaggtttcacctccagtttcaagttcagattacttgcaacatcgtccgtggcttcggtgggactttttactttcctccaagttgtccctgaaaggtctctcatttggagtgatgcttccctttccaaattgcccctaccagatatcacagagtctatatccgtggacaagtccgttcccgcttttcctaagaacattggtggcaaaacagattttactctgctgggctacggtacccgatctgtcacatttttgtccttccgagtttacgctctgggaatttacattgccaaggaggatatacccaaagttcagactgttttagacagtaagttcatgtccaacttcaccaacaaaacaaagggaagtagccattttgagcacgtcagtaatgctctcaaagatgcaactttatcttccatcctagttgagaatctactggatgccgatattaggttcaaagtccgaattgttccagtgagaaatactgatttcaatcatttaaaagacggtttgatcaaatcaattctggctagctccaagacaaaagaaattcagagagaacagggcgatcttgcaacccagttggaccaaggattggacgagcttcgaaaacctttcaccacaagaggctcttttgccaagggaaatgccctactcctagagagattacccaattcatctttggaattgagctctgaaacgtacgataaacagggactccttctgaaacaaactcatttaggtgagatcgaatctcccatcattagcaaattgctgctgcttcagtacttgagtggagataaacctctttcacccaataccaaagaaaaatcatgcgaacaactttcgttattggtttgaaacatgtacatattgccgaaggtagcccccgtatataaaaaatgctctaatagcaatttccctaccaataagtcccttgaagtttataagagtcaacgggtccagtgactcgagtcgcaggacaaaatctcagcttgtagattctcgtctgccgcgcctggtgtccttcccccgcctaagagcactcgtcccataatctgcgcgcagcgcgactatcttcaaaaccataatattcaaaccgtcccattctttctcttctctactaatcgtgtcaagctttccaccatgagcaccacaaccgtcactacaactaccattttactcccagaatatctggagaacatttatgcagaggtggaaacgtcttttggccgatttctgtcattggtacgtgagattcccggaggtgctataatcatcaattacatccgagcctcttacaaaaatgacccgtatcgttcgttgtttgagctggcattggccctctttgcgatcagatactttcttgcctccaagttctcctacaatgaaaaagatatggtcaagttgtctgataaagacattgacgaactggtggaagaatggaacccagaacccatagttttgccggttagtgacaaggagcaatggcaagctgattctaacccgctggtaataggtgcagttgcttctcgtgttgagttgcaggttccaaatggcgaacatttaaaaaatgttgccaaccttgcttctaatgatttcctgaacatgagccaacgtgaagaaacaaaagatgctgcaaagaaacagatcgccttttcgggaattggagcctgcggtcctccaaacttctatggtacacaggatgctcacgctagattggaagaagatctagcccgatttcttggtgctgaacgtgccatattgtattcccaggatttctgtactgtgccgtcagttatagcatgttttttgaaaagaggtgatattgttgtgtatgactctggtattgctttggcaacccaaaagggaatcgaattatccagatgtaccgcctaccatttcaaccataatgacatggataacctggagaaagtgttagctgatctgaagcccatgttagatgaaggacctttaactaggagatttattatcacagaaggtctttttcaaaactttggagactctccagacttgcgtcgtatatgtgagctgaagaaaaagttcaagtacagactgttcttagatgaaactctttcaattggtgttctaggtgctactggtagaggattgccagaattatacggaatccctcgcacagacgttgaggtgaccaccggcgctttatcctacgccctgggttcttctggaggattctgcgtcggtgaaaacgccatggtacatcaccagctaatttcctctagtgcctatgtgttttctgcagctattccaccttattttgccagagttgcatcggtatctcttcgattactccaagaagatgactccgtgtcaagattacaatccagtattaatttcctttactcaaagtttaaagaatgccagaaactcaaaaagctggtaataatcacttcatctgacgtatctccaatcctacatctacgattgcatcgtgacttgagaagcagactcgatcttccggtgagttatggtggtcccggatctgctatggagaaaatagtacagaggggagatgaacacggttacttcgacgaaaattacaacagggagtctcagatcttacaacaaattgtagacagagttttaaacaaccataatatcctaataacgagatgtaagaggatacttcaccatgaaaagctaccattactgcctgagcttatgatccatattaatgttgcattttcggaatctgagctttcagaagcatttgaggccgtctcctctgagatttacaatgttttgcaacagctttgagtttgtagtaaagttatagacaataatagtaaggatgtgaactttccagtttctccagtatgggttattggtgtgcgtgttatctccagtagcatttctgtctggcgtagggatgatctccaaaccacttatgccaatctcccaaggctcaaactgctcttagtttccccaatctctgctatcacaaaggttcgttaagcatcatctctatacttgtaagatccgttagagagctaggcacgtgggctttgaaactgcagcatcgatgttgtttcaaagctgctattgccgagtactaacatgttcaatgctggtatgcgttctcaggtggaaagctgcatgaatcaagcacagcaaattcgtctggctgatttttgccaaattagtcacgaatgccaggtacgatctggagctcggattgcaacttatccaaggatgggctttcaatgaagtatccttaatgacataatatcatgtactatcaccgtgaattcgaggagacacacattgacattgccggtcctctattcttccgaaataattcacccatgcccacaacaattttgagatgtcctttttcgtcctgtagaagccgaataatcaaaacggatgacgagaatacgaacatcaagactgtcacaggaaatggcggacccagacttttgcagttttcagatggagaggtgtccctgaacagttccaccgagaacttaaagttctaccaggtcaatgatatgtggacttttgataatattggagtctctaagccaacttccatggatgatgagtttagtataaccatcgatggtggttctgttccagtccatatagaacgttacctgacatgtgccgactgtgacaaagggccaattggaatcgccggttcagtcaacaaagaagcattggaagacccaagcggatccaagttgatgtattatctttacactggctcagtgtttcaagaggtttctccttctccaattgacacatgacatgcgactttcttcactggagtcatcttacataatcaacgcgttatctgcattaaattaacaaataaaatattacgtagtcaatacccgttgttgccagcccacaatgtacaaaaagcccatgaatcggccgtttaaaccgccgaggatgcaagaggccactaataaaccagtaaaaccagcccagcctgcgaaaattttcaaaagaaaaccagaagttttgtctcctgggacacctgaagttgcacaaacaaggactacgaactccgtcaatgttctatggagaaaaaagaccctcaagaagaataagacttgggacggtgatgggatcttagtgattacgggagaccagttgattttcaaatgtgacccgttgggaggttccaacttaagagaacagggtagaagatccaaatcttcaaagagtcttgaaggtgttatagccataggcaattacgaaatagaacttgatggcgagatttctgacgtgaagcctgcttcgaagaaacatagaaaaatagaacatgaggttagttcggaaaaagaatccataacttcagcagataagaaatcttcctcccttcccttcaagagccccatgacaaattcagtgactagacaaccacagaagaaaagcgctccaccatataaatcagattatgagcattcgattgtactatctcaagaatcggagacttctaaaatggtagtagtggatccgttgctcagccaacatttgagacctcaccaaagggagggtgtgaaatttctttacaattgtctggatggctccaaagagttgccacataaaggatgtatattagcagatgaaatgggacttggaaagacattgaccacaattaccctcatttggactttacttaaacaaaaccaggttgatcacaaacgaccagcagtgaagaaggtactggttgtgtgtcctgttactctgatacacaattggaaaagagaatttcgaaagtggcttggaatgaatagggtcagtattttggaaatgagcagtgcatcaaatgtagaagaagacaaacgaagtgtgatcaactttggacgaaccagagtgtaccaaatattgatcttaggttatgaaaaactgcaaaagttgacgaatgaaatttcccaaattaacgttgatttgttggtatgtgatgagggacaccggttgaagaactcaaacaataaggtgatgaaaagtttgactagtttccagattcctcgtaaaataattttgacaggaactccaatccaaaatgatttgaatgaattctataatatcatcaattttgttcagcctggaattgttggagattttgctagttttaacagggactacatgaggccgattcttcaagccagggaaattaattgcttgaaccggaaaatcattaaggcaggcaacgaaaaatccaactccttggttgaattgactcaaaagtttatcttacggagaaaagctaaagacatcaatacgaatttccttccgccaaaaactgaactgatactgatggttccaatgactgaattacaacaggagctatacaaggatataattgaaactaaccaagccaagcttggcttgatcaacgacagaaacttttttcttcaaaaaattttgattcttcgtaaaatatgcaattcaccctccctgctgaaagacgaacctgattttgccagatacaatctcggcaatagattcaatagcggtaagatcaagctaacagtactgcttttacgaaagctgtttgaaaccaccaatgagaagtgtgtgattgtttcaaacttcactaaaactttggacgtacttcagctaatcatagagcacaacaattggaaataccaccgactagatggttcgagtaaaggacgggacaaaatcgtacgagattttaacgagtcgcctcaaaaagatcgattcatcatgttgctttcttccaaggcagggggagtggggctcaacttaattggagcctcacgcttaattctttttgataacgactggaatcccagtgttgacattcaagcaatggctagagtgcatcgagacgggcagaaaaggcacacctttatctatcgtttgtatacgaaaggcacaattgacgaaaagatcctacaaaggcaattgatgaaacaaaatctgagcgacaaattcctggatgataatgatagcagcaaggatgatgtgtttaacgactacgatctcaaagatttgtttactgtagatcttgacacgaattgtagtacacacgatttgatggaatgtttatgtaatgggcggctgagagatccgactcccgtcttggaagcagaagaatgcaagacaaaaccgttggaggccgttgacgacacggatgatggttggatgtcagctctggatttcaaacagttatcacaaaaagaggagacaggtgctgtgtcaacaatgcgtcaatgtctgctcggatatcaacacattgatccaaagattttggaaccaacagaacctgtaggggacgatttggtattggcaaacatcctcgcggagtcctcaggcttggctaaatctgcattgtcatctgaaaagaaacccaagaaaccagtggtgaactttatctttgtgtcaggccaagactaagctggaagaacggaactttaatcgaaggaaaaattaaatgtcaaagtgggtcgatcaggagataatccatgcttcacgtgatttttcttaataaacgccggaaaaactttcttttttgtgaccaaaattatccgatctgaaaaaaaattacgcatgcgtgaagtaggatgagagacttactgttgaactttgtgagacgaggggaaaaggaatatcctgatcgtaaacgaaaaagttttccagcccaatcgggaacatctgcgaagtgttggaattcaacccctctttcgaaaatgttccattttacccaaaattattgttattaaataatacatgtgttactagcaaagtctgcgctttccatgtctcagattcggcagataacaaagttgacacgttcttgcgagatacgcatgaatcttttggctgctttttgtgaaagagaaatggtgccatatattgcagacgcccctgaaagattagtgtgcggctgagtcttttttttttctcaaccagctttttctttttattgggtaccatcgcgcacgcaggactcatgctccattagacttctgaaccacctgacttaatattcatggacggacgcttttatccttaaattgttcatccattcctcaatttttccgtttgccctccctgtactattaaattacaaaagctgatctttttcaagtgtttctctttgaatcgctcatgcatcataaagaaagactcatagatcatatttcttcggagtctaacttctccctttccacttcgtcgatgccgtccttcagccatgaatcaaatcaatcgccgaacccaatgctgatcgaacaagcttgcgattcctgtcgtaagcgcaaattaaggtgttctaaggaatacccaaagtgttccaaatgtgtcacccacaaatggagttgcgtttattcaccaaggacagtgagatctccgttgacgagagctcatctgaccaaagtggaaaatcgtgtacgaatgttggaagatctgttggaacgagttttccctactcagagtgtcgaccagttactggaaaagagaaccagtctatccggcaactccacggggcattctccatcttatccaaatagtaattccgtttccccccagaattcctccccaaaagttagcgactcttcctcaacgactgctgaacccgctccagtccttccatccaaacccaaatcttcattccgtccaatagttccagatgactacttcctgaatgatgaaatcaacggtttcgattgggaggaggaagacaccccagatcaattgttggtaatgcagcaacctccgacatccgtcgattccacgaatgtctcacattcttactggaatcatagccgaagatcgcagaaaaattccgtgacttcgttgaactcacttgcggagcacgaacaatccggttgctcttcgttgataacgtcccccagcctacagccactttctcagacaacaaccaatgattcccaccccgatggaatggctgctctttcagttaaccttaagggtggatctggatattttgggttctcttcaagttctggacttctaagggcattgaagctgggtcaatttgattccgcttccatatctcctatgagctctgttaggaactcggtctccaagactaatactgaacctactgaaccacaatcaattcgttctttactaggagatcccaatgactttttggaacccgaaaagaaggctgaattcccaggctacgattctcacttaaatgaccctaacaaccaatcccaatatctccaggcctacttcaagtattatcacacatcgtatcctttcatccacaaaggatcattcctcaaacattatgctggggagctaccaatcaagaatgagaaccattggcagattttgcttaatgtcgtacttgctctaggatgttggtgtttgaatggagaatcttcctcgattgatctttgctactacaatagagcaaagatgcttttaaagcaggtgggtatttttgaatgtggtaacattatgctgttagagtctttgattctcctttcgaactatacgcagaagagaaataagcctaatacaggatggagttacttaggtattgctattagaatggctatgtctttagggctttacaaagagttcaacttggaccatacagaaaaggaccactatctcaacttagaaatcagaagacggttatggtggggtttgtacattttcgatgctggagcttcaataacttttggtcgtcctatcactttaccaagcagagattcgtgtgatattcaactgtgttccaatatcaatgatgccgagttggaagaattgatcgaaataaaatcggattcaatcactactgaggaccttaacaaaccatacccaacagcatactccggtttgattcagcaaacccagtttactgaattatctatgaaaatttacaaccgtttggtttccaaaccagctccaactgttgaagaatgtctagacatgaacatggaaattgaaaatttcataaagggtcttcccgcttacttccatgaaagcaatgaaattgcaatgtctcagttctacaaggttacgccgtccaaatattacgattatgacagcaacaaacaggtggactatacccgcttaccgcaatggtttgatctaagtcgaagtagattgatttggagatacaagaacctgcaaattacccttttccgagcatttatttggcaacgagtcattggagtaaccaatcccaaggtacttcaacagtgtaagactagcagaggtaaggaatgtcgaactatttgtttgagagttgctcatgaaacaattttgtctattcaacagttcgtgaatattgacgatgatgatgacttctctagactatcggtcattggatgttggtatgctacgtacttcctattccaggctgtcctgattccaatcgcttgtctttgttctgaaccggatagcaaatatgctccaatttggatcgaggatattcaaattagtaagaagatcttcttgaagctcaacaagctcaactcgttggcatctaagtttgccaatgttattgacagatcaatgagtcaagtaatgccacagttcgacacaacaagcgccaaggactctccactcaacattaacgatttgatcgatatgcacggtctcatgggtaacagccccgctcctggttctaacaacaatagcaacaccaaaagcagccccagcactaccaacaataccaggacccccaacactatcaacaaaaacaacagtaacatgaacaataatagtatcaataactattttaacaacaacagcaacaacaataactccttctccagttcgaaggctggaccagtgaaacaggaatttgaagattactgtttaaagctggaccctgaagacgaagacatgtctgccttagagtttaccgcagttcgattccccaacttttcagctacgacaacagccccgcctcctactccagtcaattgcaacagtcctgaaaacatcaagacctccactgtggacgattttttgaaagctactcaagatccaaataacaaagagatactcaacgacatttacagtttgatttttgatgactccatggatcctatgagcttcggaagtatggaaccaagaaacgatttggaagttccggacactataatggattaatttgcagcgggcctgtttgtatagtctttgattgtgtataatagaattactacgcgtatatcccgatctggaagtaacatggaagtttcccattttcgcgcagtctcctactcgtatcctccccaccccttaccgatgacgcaaaaggtcactagataagcatagcatagtttcatcccttgctctttccttgtaccaacagatcatggctgggaatctcaaggatattctatccttgtcgaggaagacagcaaggaatctgaagcaggctctggatgagcttgcggagcaggtgatcaaccaccaacggagacgaccagctctggtccgagttcctatcaacaacaaccttaggcgcaagagccagcagtcctttttgaatcgcaggtcattccatctttggaccagcaagtacaacccatacttttggaggggaggcagaagcaacgttctggaccagcttaaccgtgaagctttaaggtacagatcgtcttttgcgaaacccggattttatccaagtgggctgtatcagtcaactttccctcaaagaggtagtaggatgttttccacctgcgcctactcatgtcagcaggaggcagtcaaaaacttgacttccgctgttcgtgctttgttacaaagtggtgctaatttcggcagtcaaatgaaacaaatgaaacactgttcgcaaaagaagaagcacttctctaaattttctaagaggcttacttcttccactgccgctgggtctggcaagaatgctgaacaagctccttctggtttggccgaaggatccgctgttgtttttagccttgaacgtcaaagtcacaatactgagttggaaggaatcttggatcaagaaacttcttccattctcgaggaagaaatggttcaacatgagcgtcacctggctattattagagaagaaatccagagaattagtgagaatctaggatcattaccattaatcatgtctggtcacaagattgaggtatttttccccaattgtgacactgttaaatgtgagcaactgatgagagatttggctattacgaaaggggttgtgaggcgtcatgattctactgctgagcattcaagctccaggtcatttgttccagaagattgcttgtattcctcagggtcaagttcaccgaatcctttatcctcaacttcttcgaaatcatttgatagagtctcattggactacatttcctctcggtctacatctgatcaaaccactggttctgagtacacatctctgtctcaacaatatcacctggttagcaattacaaccctgtactatcctcagccccgggttcttcgagggtcttggagctgaatactcccgagtccactatggaaggcagtacagatctggagtatttaacgcgagacgatgtgttgctgttaaatgtctaatctagacctatccttcattctatatagcttagttgagttttacgtaagccctagtttttgttaattcttatcgatttatggttagtgtaccactcaactcacgatgatatatcccaggagctgtttgtgcattataactaccaatcctggcctcaaaccacgagagctcctttaagtcaccttagtctatctcatatcgagtccagattctacaatgagtacttctgacggcaaagaatttgaagaggaggtttcgcatgacaactcagacgctggaacatctgttgcctctgattctcgacgtgagacacaggataaggagccccaagaggctccagagccgaaagaattagaaattaacgaggctggaaaggaaaatgaagtgccagttttagtgaaggagagtacagaggaattggaggagagcaaggaaccggaacaagctaaagagaacgttcaggaggacatttcactggatattcctgtgaacgaatccgaaactggagaggaggctcaagaaaatgtaaaagacgagaatgtttcaacgatcgtcaatgatcgatctgttgagagcacaagtggtaatactggcccaattgaggctaccgtaccaagcactgcttctgaaacagacctccctgttgagaaggatgttccagatcagaatttcgacagctcggtagataccccccaggaaccaataactgagtctcctcttacagaaagcaacacaattcagccccgagagattgatcctgatgctgataattcaaaggtcacggctgaaggccggtcaccaccagatctacctccacgatcacctaagattccaccttctcttccaccccgatcacctgtgatacctccatctcttcccccgcgcaacctttcatcagaagcgatacccataataagtccagcatttttgacagaggaggtagctggcgagaggttaaatggattgcagaaccacagcagttacaacttattaatatccagagcacacaagaacacctcttcggtcaacgaaggatcagacgaacacagacaacaagttgtttcgggtgccaacacgcttagaactactttcaacgagatcaaagttgggattgagtactccaataatgaattgatggagaacattgattgggaattctggtcagatgtcgtgaatgattactcatcagtggtggagaaagatccagaactgctcatttctcgtgtgtctatgggtatgcctaaagaaattcgtggaatgatatggcaattgataaccaactccaaatcatatgttctggaagaactttatgccactcttaaaagtgaagaaagtttgtttggaaaagctattaagcgagacttgtgtcgcacaagttttgtgacaaacagtgacatgagacacaagtctaatgagctttatcagatcattaaagcctactctatatttgatcctgaacttggatacactcaaggtttagcctttatcgttgtcccacttctgatgaacatgaatgaaagcgaaacattttgtttgttggtcacactgatgaagaattatggatttcgtgacttatatctgcccgaaatgcccggtctccacttgaaattattccaatttgatagactactagaggatttgacaccagaaatagccagtcatttgaggaaacaaggagttcaatcatccatgtatgccacacagtggtttttaactctctttggatacaagtttccacttgagatcgtcattagaatctatgacgttgtaattgcagaaggactagaaacaatcttaagatttgctgtcaatttcatgatacagaacaaaagtcacatattgactttgaagtttgatgagctcttgacattcctcaaggatgggttgtttgacgtgtacaatgctgaaaacaaggcttcggcagtaacttcgaataattatcggctggacgatttagtatccgattccttaaacctgaacataattcccttgagtctcaaccaatacgagaaagaattccatcaaataaatcagttggatcaagaacgagaccaagagattagcaaactccgagctattaatggaaatctgaatagagacatcaagaagattgaaggggagtatcttcttttgaataaagaacacattgaaattgccaacgaaatggtagaaggaaaggtgcggatcgccaatcttgaagacgagaataaacaattgaaacatgactcagaagagttaaacaagaggttagcaagtctttcctcccaagataaagttgagaaggattttgatttcaaccagcaagatctagaactgaatcccgaactggctactgaaatccaaagaactatggaacggaatgcccaagtaatggaggagaaccggttactagaggagcagttggcctcgttagaggtagagtacaacgacataaagcaagagtatgagcaaatgaagttgcgtaaagggaagtggggatcctctttcaagaaggtgtttggttctaaatagaaaactcagcatatatttcaatgatacattattcagttaatataccagactttctacaataacgaactccctgaacgggagtttgaaagggtgttttgggcggaggttctgcaaggtgcataggaatatgtatgtccttcgcgagagggatgttactgaaaagtttactatcttcatcgaacttgagcttgacttccacaaccaaatatccgaactaactacatgattaccgggttaaggttattctctaccagcacacttgcttctgcaagacaatacaagtatgtggtgacgagaaaagttgcccgtaagcctgatttgaaggttggtgacgtcaaaccgagaaaactggccatccctcgtaccgcacccaaattcccagaatacaagtatggtgactctaaaatatacaaacagagcaacaagggattgtatggaggtcaatttcttcaatttggtaacaagatttctgagttcaagaacaagaatggaagaaaatggtcattaaatgttcacaccaagtccctatggagtgagatattgaacaaatcgattagggtgaagttgacagcccgtgttctgagaacaatcaacaaagaaggaggattggatcaatacttgctgaaagacaagagtgcacgtatcaaggaacttggacctactggctggaaactaaaatttcagcttcttaccaagaaggagaaccaaaagaaacgaacttactatcaagatttggaaaagatcacagtgaatggtcaggaaaagcatgtttacttccaacagagtggtaagaaattcctggttggaaagagaagactactgaaggagttgtatccgttggtcaagggagactctgacctcacctggaaagagtaccatgatcaacacaaaagcctagcacaggaggaagtcatagaaaagctgcacaagtataactatgacttttccgaagtggcccaaactgcgtagataggttctgcagtcctgtcccactagatgtcatgtatatagagaatgtctaagattgaggtactaagtgcaacgttgtagatgtaataggaggaaaagatgatctcaaaagaggtaatcacagtcacagaacgcctatgtttctttcgcgccaatggttcccttccaccaaacccttcagcagaaaacttcgttaggcctcccagaagcactactaccacatcctaacaccctcgcgacaacttgggtttctctcactgaggtgaaaattttgagaagtcatttacattcttcatattcaactacagagatggctaagtcaggtaagtcgtttggacacttgaaagtgaaggagtggaaattatacatctttgagatggcatgaatgctgatcagatcgaacaggtttgtcgagtaattggtgaggtcatcaaggtcactcattcattcaaagtattcgatcatccgttccaagtcaaagttatctattccattccgaataatgagaaatattgtactaacaaattcaggtattgcagtaggtgctaacaagggacacaaggtcaccccaaaggccgttgctccacaaaagagagtcgctatcagccaaagaactgactttgttagaaagttggtccgtgaggtcactggtctgtctccatacgaaagaagaatcattgagttgatcagaaactctggtgagaagagagccagaaagttcgccaagaagagattgggtactcacaccagagctaaggctaagttggaagagatgcaaaacgttatccaggaagcaaagcgtcattaagcgatatagctgttataatatacttactgtaccaaatgatcctaattcaaatgttcatgactgggttttgattgctccctttgaagactgtagtttgatccgttgaatctagcagggttacgccttggatatctcgcgcgagggaaggaacgaacctagtgcttctataagtctctcgtgcgcacttatcactctctttcttccaaagcacttagctttatcgaccatgaatgtctctagagttaggttcattcaaaggcgactcttttcgacaaattacttttcagatggctcaactccgaagacattccaacaattgcatagcgatcctcaactaaacacttccaggtccagctcgtcctcatcgtccaagatagtaccacttcttcgttggacctgtatggtccttctgagtgtaactttattcgaaaactacaaacgtacttgggagctagagcaaaagcttgagacccagcagcagggatataagcggaacatctctcaactacaggccaacttcaagagcttccagaagaaacaatcttctacttactcctctttaaagaagaccaataacgaaagggaggtaaaaatggcattacacattggaattcttcgacaacagctgatcaaaaatggcatagaacctagtggcatagacgaggccttgagagaatttgaaaacaaagttagaatcacagttgatccctctttgaactacatttggttggaagatgagtcagctttaaagccttacactccagatatccatgattacgacaaaagaaaaattaaaaggctagagcattttattcgcatttgcaaacattattctaatcaattcttgtgattcttgatccatttctggataggaacgtctccattgatcaaagttagagtcttgtggatagtactaggatgctccaatgactgaagaattacctcagcgacgtctgctctgctaattcctactgtttcgtaggttttggtttggaaaatttcattctctggttgtaaagaacctttttccgggatgtctttcaaagcaccaggttggaggatggtccagtccagattcgttctcctcaattcacgatcagcatactttttacagatatagtaagttctcaaagatggaatattccaataccaaaaatctctatcatcagcgccaattgcactaaccatgatgaatcttttgatattattcaattccgtagcctccatggccttcacagcagagtccaggtcaacagcaacagttctgtcagctcctcccttacctcctgcaccggcggagaaaacaacagcagagcatccttttatagcctctgcaatctttcccaaagtgtcatcttccagactaatcagtttggcatctactcctccagcaatgaaatcatcaacctgctcctgcttgcgcaccagggccaatggttcgtattttgagcttccaagcttggaaatgagcaattgggccactttaccatgtgctccgaagattgccactttatttgccattattcgattacggagtgtgtttaggggattctaccgtttgtggcctggtaattgcttatcgagccccacgattcagcttaggtaatgttgcgttactatgtttcaacggtccagagacaacagaattaccctcccaataaaacggttccaaccgttacccgtccataagtataaattgatattttcagtttgaataggattttcttacccataggcacccattagagtcacggctcgtatcctcttccatatgcgagtttttgccaacgctgttggacttcgtgctcgggtttccttagatagaatcgttttttccggccttaaattgtcgtgcttatgtgtgtaagctatgcggtcctaaacgaacatgtattgcaggttgactgataaggaatgaacctcagcagttggcttcgaactgaaatagtacgagcagatgatgtaatttgttcgtcatttgaaaactatttatttacctgtagttgctatgtatgatgcagttggattatagatctatgtgctctcagttaaccaaccgagcatcctttttttcttgctgacgctgtttgattttcaaggaaagtagacttggatttggacaacaaactgttcgactttcttccccattatccttgtagaactgagagcaacatgcgtacagttcatctataaatttggtacattttgattcgtcgtaacgattacttttcaggcaatctgtgaaggttagattcgtgttgaacattgcattgttataagactggtctacttaccttgtatggcacaagcttgggctttgcaaggttctggcatagtaatggctatttggctagttggtaggaagaataaattctttgggcgcgcaatgtatgattgaggactgaagtgcttactagaggccaattagtgtgtaattcatggtcttgtcaaactattgactggctccaggaacttaatagagagacattggcaactctatctgaatagagagattcacaagatgagaagtattcagaggctgatcttgaaaacctccaatcagcctgttcaacttgttgcacaactctgagaaagtactcattccaactactcggactatgtcaagctgttcgtgaccgtgccagaaattgagagcaagaaggcctcatacaggtgaatcgagaagatatactgatgacatgtcataattgaaaagatactactaatgtatcatgaactgaatattgttttatccgctgttcaaaagactctctctttcctgatatatagtcaagttcatctggtaaacatcacgttttttccggaagcacagtagtcagctgtggtatccttggacatccactcagctgtcatgttttaagttaaaaagagtactagagctaccgcgatataaatacttgtggggatggtcctgtcaaagtctgaacaagtactcttccaaatacccctggaattatgcaacaatcctctcaaaatctgtccgagaccgccgaatccgattctgaatttgtctacaaacctcccattgagacatggacggtcaatggaaaaagagtggacgggttctttgtccctggaggaaatgtgcatattggtagtgagaatacctggggtgtaatggtctataacataaactgtttgcttttgcatgcaaccttctggttgtattcctattatatcgttgctcaggagcagattggattctttagggaggttctatatcagctgttttggtcgacagtccaggatttaacaagtggatttcacaatccccaaagcttcctttctattccctataaagtggcctatagggcccaatcgaagttactggcgcataaaattccgactagccccaatgagatcagtgtggcattgcccaaaaagggggttcctgctcatattggattggaactagagtttcagcaattggttatcgggctaccgcctccgatgcctcagccttatctgacagctgacaaaattgaagtaaaaccctctgaaagagagatccaacgaattcatgagctccgggcaaagtacaagtcacaaaagaaggctcactatgtggaagagaaattacgaattctcacggattgtgccaaacttattgcctggagtgcttacactgaaattaaaacccttagcttgtatgtgaaaaatgacgagatatgggacttcaatgacttgaccaacatcgtaaaagcagaactgaacttcctagatccttcacaggtacagtcgataaaattgctcaagctaaattcgaatgagtgttttatgatcgatgatgtgaacacaatcataagagttccagatccagatcatcctagcactttctgtgatctgacagtaattctactatctgaaaaagactctattgtgtcgattctaaaggagaagttggttctatcagatggagagcttgacttggagaaagaatttgaaaaatatggcctaccagtcctaatcctccatccaactccaaagaataaacccgcaaattgtttgaatgggttcccaattcacgatttctccggcaaaattacattgtacgctaaaaacgaacctctaacatttagctttttcactagagccatcaatgattttgttcaaactgaaaagacccaccttctgttggagtcctattgaattcttgctgaaagtagtcagtcccacagttgttggcgatctgcaaattcgcagttatgcgcgccctcaatactattattgtttttctcccttataactaatctcaaacaagaacaagagaacagaatgataacagagccccagataacagaacttttagatgtcacggaggagtatccgataagggtggtagctattaacgatggcgttcttttgtccagagcttccgcgaagaggcaacgacttcccgcaagagataatgctgtgtttgaagatcgaaaccttagcaagcatcacgccttccttcagttggaaggcgattacttgagaatagtggatggcgggtccgtctacggttcttgcgtttttactagtacagggcatgagtttatcaacgatggaggattcgcaaaagttgacatttccaagactccacggatcatcctggggtgtgtggtcaaggacatggatgctccggctctgaccaattgcaagttgcattggtttattgtaatttcgaagggccaacttataatgatgaaactgaactcgtcgaagatttacgaaggacttgatcccaccattctactactagatgaattgcccgttcgattggaatacacagcaactaaaaccacacttatcgagaagccttattcgcaacaaagtatcattcccactgttttattagggatcttaacggggtcttttctgacctttatgtctctctctatttacgggtatttagtgagaacccaaacttagaccttgctctatcattactatggcttttctctcgcctctctatattactcccttaagtaggttcgataagaaagagaattgcgcgaaattttggggctcgcctgtgataagcctgttaccgaatttggagtatcataaacacaataaattagaattgtttagtaacctaacaaaagaaaaaaaaagagggcaacagaaaaagacaatctcacaaagaagaaatagtaattgtaatggcagacgatctagagaaaaatctgacaatttcgtctgattccgggtctgagggcgaggaaggtctggaaggagggctgcaatatctctcagaagaaaagcaatcaagggatgtggtggaatcttccggagaggccaccacgggaaaacttgaccaggatgaagatgacttagaagaagacaaagatgaagaagcagacgttgaaggcaatgatgagattgttgaagagcaaatagaagtatccaccacagtcatcgattgggaaacagatgaagagaatgataacacgtacagtgaacctaatgaacaagatccagaggatgagtcgaaggaattggatgatgacactgctcttgacgaagacactatgaacgaagacattttctttattgcgctacaggaggagaaagttgtcagtaggaaacgagccagagaagaacagaacgacgacgatgagggcgacaataccagtgaaggaacagaaaagattaaatcagacaaagtgcccaagaaaaagctgaaacgttccaagaataccttcaacttcactacttaccaattggccaagtttgcgttgttctggacagtgattggctctgcaagtacctttgctgctctggccaagataggctccagccttcaataatgatgataccttttttagtttaatagtttacattcgttagttaatattgttttgaattacctacgccttccgtatatgctgtgtaatttcgtcgaacgtctcggtgattatgttttctgtgaataattttgtgataaagtccagaatttggtcgttttctttcttgaaatgctcatcctctaccagcatattgtttagcttacccctattcaacgatggggagaacctctttggcacttgcacggtgatacctcctaggactacagctctatggttaggtaagtttggaggtccgtgaacaaatttacacttgttgccattccgacacttgcctgtggtagcatagaacctgcaaatgcctggattcttctttttgggcggtgaatcggcagaagaggtggagtgttgttttgaactctcctccttttcaagcattcttttcctagtaggccagtttttctttctttcctcgatccatttttgtatatcctcttctgtctgtaggacaattgaggtccctggaattggtattggcttcccagggtcagccgaagggtccacggagttactgtcaacaccatcttccacgagattatcatcacccggagtgtctttgacagcttcactctctttcctcaattctatctcatccaaatgctcctgagaatcctcattcggtaaatgggttggtagatctgctaaaaaatccattcctagaattgatccctggctaaccccaaaccagtttttttttccccaatttaagttttttttctcgcgatcggggtaatgatcatggagaagctccattcgacaaccttcttttcatacttcaattaaacgaccatgtctgccgcatctggtgctcaaaaggcaacgtccaagttcttcgacagggtattcagcaaggagtcgctccgttatctttgctccacacatttctggggtcctgtatccaatttcggtattccactggcagctattgtggacttgcaaaacaagccaccagacatgatcagtggcccaatgactggttcattaattgtgtactccttggttttcatgagatattctcttgctatcaagccgcaaaattatttattgtttggttgccattttgttaatgagattgcccagttgggccaaggttatcgttacgtgaggtacacctacggcgatgagggcaagagagcacaggaggtctcaccagaccagaagaaggttggcaactagagaagttttaataatttattagtagaagaaatgttattcagagaaataaagtggtgattgtggccccagttgctaatcaaaaagaccttgcactctatcgatctgagtgggacctaactccatctcttcgtctgattcatctgtgtttctgtatagtcttggacgtttacgtcccgtgttatcatcaccacagttcatactttcttgaacttgaatgtcgtctgaattgatacttatttccttcaaacggttccatctcacttcagtgacttctccgtagctaaaagtatcattttcagtatattcttcgtcttggggaacaaacaaaggctcagcgtattcacctccattctcttgcggctgtggcggtggtgcgttctccttcgaagctgtgttggtttcgggcatgggtgtgtttctctcctgttccctttccatgcttagcagtcttcttcccttgaaatccgcaacgttcaactctttagtttcaatttctttattcgtcaagttcacaatctcatccgattctgttaattgaaccaaaaccagccggcaaacgttcttccaatctttctcaaataaaatgggccagccttgatctctgaacaaaagatcaacgtcgttgtttacattcactccctgtgtggtaccattttccgagctggtggttttgaaaaacttatttctatcattgaattcattcaacagggaaacaaacgctctgaactctttcagaggaaaaattattgacaatttattctccagttgttgatcaatgttatcctcattaaactcgttcaagaagaaggcaacactcagtgagataggctgtttgagtagactgttaactttattactcagtaactgctgtttgtcaaacccttgaaatgagcatttcctaaggtcgggataaatatctatcttgaaatccacaacgttgttcggcaacatatcgaaaaattccttaagtatggaaacatccatgtttatgtgacaaatactatcatccgtctgaacaacatcttcagctcgttttcggcccctgctttcttgtcgtttcaactgctccttataagcctgaattatattggtttcctggattttttcattaccgacatagttcaaggcatagagctttttggtctgggttttctgaacaacttcaacaaacagcttattattcacggtcctcaacctttgttccgtatcttctacctctgctagcgagaactttaatagatcaacatcatcaactctgaaacttttgaaaagcaagctgaaacttcggctatttaacagtattgcaacctcgctaaacttctgcttagcgttctttgatattgggagctcaccattgatgctgaacttggagaaaaaagacttgccaaactgacatctcaataacgtggttctagagagattgagtgattctaaaatgatttcatccgagccgttcgcatacttgcgaattttcatttgcacatgttcagagatctggctcaaactgtatatggttcgaacccataactgttggttttcttgtgaagaaataactcccaagaaggagaacatgtaatcacaaagcttaaatctgataggaatgatatgttacaaggcgcgatatgaatctatgtaaatacatacataccctctaccaaccaacgactggagatgcccaagagagggccttgatatatatactttttggcctctctattcttggattacggccttcttctttttctttttccttttaagtttctttggctcaccctcaacatcttccaacccgatcccagtttctttcttcttctttttctttactttagagctgcttgtgccttgctcagtctgcaatcctttcatctcctctactaattggttaacttcatactctccgtaagttccccctccattagtgcctttattgtaagcgtctgaatcagcattgatatcgaacttgtccaggtttgaagagtcaatcaacaatcctttccgactccttccgctattacgagacacgctttctgactccaagtcaagtaaaccgacattaggagtcagatcatcatctaagatcaataccttttctctgttgactctgactttcttcttgcttttaccggaactgggctttttcttgattgctggagtgtcccttgagtcaatggagatcaaatcctggcttgggctttcagagttgggaacggtgtccattcctatgtagaacggatcatccctgatgcgttctaacctttctatatcatcttccggatatttttcctgtggttcactttcctgtgagtcgctccaatagttgtatatgctctcatgatcagactcttccaacggtttgtgtttggcgatgaattcctccaacgcaccagggtaaaacggtttgtccagatctacatcctctggtattgttattttctgttgggtcaaataggacaccggttttagcgtttggccgttgaaaaaccctaacaatacgtcctccacaaacccagagggtccactaggacttaagctttctggaattagcttcagaacttcaataaatgaggcacttctttcttgtacttctgtattcacatgtgattggaactgctccaaccagtcgagtaatatctgattcaagttagttaccatttccacagtagattcgttccaatcggatttcaatgaacaaacaaacttggcaaaaactttaaccaagttatgaattagtatcgagagcgtagtaggatctgtttgagcaaaaaactctacctttgttagatcggttataatctcaaatccattgagtttatgccctccttcatcatcttcttcgtgttcaaactccgattcaccttcggtgtattcgtcgtaatactctccaactatccatacgcaatctttaagcccatcttcaaatgtcgaataattgtttgaatctctcaaagttgccaaacacatggacaccaactcaggtcgaatacttggcacacgtaatgctaagttaacgaactgctccgaaatgagcgactgaacttgttggatgtctaaggaggcatttagcttgatgaaatcgtatagcacattagcataccaagaaaagtttggaattagttgatagttcttttcacaacaaatggaaataattttctttataacaagaagcttgaaagatttcgggatgattgccatttgctgtttttgaaaagattcaaatcgtgacattgtagattctgaagtatcgtcatcatttggtaatagcaaaagcatcatttttgagacaatcttggtgatattctcttcggtgacaagagcatccaataatgataaagctttttctctaatagccaagtctgtgtcatttattccgtctagtaccaccttagaatgctgtgaaataaaggatctatgaatagtcataattttgatgaatgcagatagggcgacgtactttaaattggcatcatccgcttcaaagaaaactaagagcctttcaaccattaattttgcaagtttgtaatcatcttctgcaagcattttacctgttagaatacagtcaatacattcgtaaaccaaagataaagcttctgttttggtcaaaatattcaagatcgctgggagcattttcttttttaacctaggttctaccaaagataaggacgaaaacaatttcaacagcctgataaccatccaattgttcttagacgacgtcagcagttcataaagttgtggtgccaactcgacatagttcttagggttcttgttagccaattcacagactacattcacagtagcactgaccacagacgtgtcgtcatcactcaagcgttctatcaatcggggatagaaagacctcaaaaagtctgggtatttgagaaaaattttgaacatggcgaggacggctttcttcctgatgaaaggagacgaatgggataacattctgactatatcctcacatacatcgtgggccaattctgtggttactatggaggcaatcccacttaacgcaagacctgcctcaacttggttggagctggtcagatctttcttcagtaaattggtcattaacatcaatgcgtcgtcattatcgtttcttatcatgatttgcatagctgccagataccctattcttttgtgctgaaaattactactgctcatcacctccaatatctgaaatgaacaccaagacatatcaaaaccgtacatctccaagtaagctagtttgagaactgcggtggatttcagctgcaggtcgttcgcccttagttcttccctacactcttggattgactcctccaaaaaaagaagcaatttgtcgggatcctcattatttgatcgaattcccttaatcaagtcactcagtgacttttcgaaagatattccgaaaggccttagtcgggacttgacgtcagtcatcagtgtgtttggctagaatgagtagaagtaaaatgatgagtttatcgaagaatgtcgcgggattggtaacatccgaaatcgactgtataagaaggtgaatcgaaggagccaggaaaagctactgtcatgagattcagggctagatcgtctgttgtcgcttggcctcaactatctaccatacattgacagtgaaattatcgtataaagtcgttcttgcacaccttttgtctgctacatttagccactttcttataagttcccctcctagggggagcgaatatgtcacttggaaggaggaatatctggaaatacacttaggagtgcacgagattcttccagggtaccatctcccaagcaatgcccaggtcaccttctgtcgatagtgcctcatttgcattagatcctgtagaatacagctacgatccaattgatgatcagagcgattccgatagcagtatctcttcccaaaatgattttagggctttccgcaacaacccatcttcaagagaacaaagaagcgacctgaataaatactccaaaagagatggatctgactttagtcccgtcgactatctgatcaatagcattaacgcgtctctcaaaagtgttgcattggacaaagctatggtcattcaatcccagctctccggggaactcaacaaccaaaatgacttggtcctaaagaagctgctggaattggagacgcggttgaaaagtcacctggtcaaatatcagcaggccaagaaagtcatattgcagataaatcaagacttagcatcatcgaagaagagaatcaaaaaaattaccaagtacgtcaagatagaatacccgattgaatactccaaggcttacaacaaagttaacaataatatcacaaacgatgaagaagatctttacggttaaattaagtgcacagtttggtgatctgcgatgttcctgacggattgtttggaggaatttgtaaccagttcaattcgtcgtattcggcagtcccctcaatacaatgaaaagtataagcatatctggattttccacttgtgtttttctccgatttatgaaccaccgaattgtgaatcaataccagagatccagcaggtatttcgactttcacaaactgagactcatcatttttctggatatagctttcagaactcgtgtccagactccaatcttcaagagtttttgggtccacaaattttgttcctgaacccttcttcaagtctttcacaaatctcttttcgacaggaaatactttatgggacccaggaataaaactaaggcagccattatctactgtacagtcctctagggcaaaccaaaaccctatgcaagactggggctccgtaaataaaaactcaccatcttggtgggatggcactttccccccaatttcaggctgtttaagaatcagcatgctctgcaacactcttggatcgtggaacttcaattgtctagcaattgaacttatacgttcattaatggtgatcgcagcatatttttcattcaaaaaatgtaaaccatgaccaatcttgttaattgccttctccacaggcttggttaattttccatcttcatcaaacgcctccacttcaaaaaagtaatgaattctgtcgctcgactccaaaaaatacttatctcccacatgattatcgtcatcctctgcggtgctgaactttgtaagaggatgagttttaatatctatctttgcaagtagccgatctgcctcttggactagttctgacacttgctctttactcaagaaattttcaatgacaacgcagccttcatcgttaaatttattgagctcctcagaactcagcatatttgatcgcacaatacttgagtagtatagtaaggagatcgttaatttcgattctggtgtgaagatgccaatcagtgcacttcgtctgacgctagataagagacaggggcatcgcgaatgctacgttagccaggtaaacggacattcagcatcgaccaaatccggataaaattccgcatgtcccgcaattaactcaagcttgcgcgatccctctacctatattagacccaccacttcccaactttccactcaaaacgtttcatcaaccagaacaaaatgtcattgagaattgccgttgtcggaactggaatctttgccactgatacccatttgcctgctttgcagaagttggacaacatctaccaagttgttggatgctacaacaggacaaaggctaaggctgaaacttttgctaagaaagctggaattactaaggtttatgattcattagacgagctgctagcagataaggactcaattgatgtcattgatgctttgctcccggttcaatataatcccttaatcgttgagtctgctctttctaacggtattcccattgccattgagaaacccatcgctgccaatcttgaggatgctcacaaagtggttgaattatccagaaaataccctgatacgccagtatttatcttagagcaatgggcctactacaaatcaattgagttgataaaaaaagagttgccaagaattggaaaactggtgtcatttcagtactctagtactggtgcattcaattttaacaacaaatatctaagcactggatggagacaacatcccaaacatattgggggttacttgtcagatggtggtgttcatcagctagcacttttaactggaatattaggccatattaagtctgtttctgcaaaaactactcaaatcagagagctctctggaaccgttgacactctttattcgttgatggaaactgagagtggactgatcgggactttcacctatggttcttgctttggaaacactgagaaaaagggtattttccagattttaggagacaatggctcaatctaccttgatttttccccaacccttccaagcccaaagattacgatcaacacaggaggcttttcagctgaatcggagagaaagactgaagaaattcaagttgaaaacgaaaattttgatccggtgagagaatttcaagtttttggtgaagggctgttaaagaaggattattctggatacatcacgactccagaagtcgcctttcatcatttagctatcgttgatgctgcgttgaagagcaatggacaatcaattgatgtcgaaaaggcttagattatagaacctttgtttaattactctaaataacgtaaaacattatttcgtgtcctcttcattcaatgtcacttccttcggttcagaataatctcctaagaagtattgtagcaaaacacatgcgaaacttgaaacaatacttacgcccacaatcagaactagcatcatgttactgtacttgtacagtctagccctgtcttcgggccatccagaatacagggcgtaagtacagacgacagaacctaagtttcctagaccagaaactagcgcagcactgacggcacatccaacgtctccgtgtcttcttccaaaaatctctgcagtccatgccatggtaattggaactgtgggtccaagaccaaatccacagattaaaagaccaccgtaccggctccaactgtcatcagcataggtcatcaccatgagtccaacaataataataacacatgagcaagagaagaaaacgggacgatacttcttaaaacggtcagcaattggagtgatgaggagaataccggcaagatcgaataaccaaataggtgcgtacaacagagatacattaatagacgacagtcctggattattagctctgatgatagtggttccaaaaacggccaatccaaaaccagcaccgacgactccaaaatacatcatgaccaagggccagattctgaaatcgcagaagattcttacaacatctttcaagccccaatcgatcttggtgtattttgcagaaaggtctttcctatgcatgcttcgttcttgctctgtgagtggtttgggggatgtaaagaaacgggaatgccagttgtctggagcttctttgtcgatgttggtgggcctatcaggtagccaccaaatcagggaaataccaacagccattgtaatgcatccgtacgtaatgtacatccatttccatccctctcttcctccgttcatattgatcttttgaaaaccagcagctaccaaaccagcagcggcagcggacatctgggcagcagtgaagtagtaaccaattcttctggcgcttctatcattaggataccataacgtgacatagtaggagagaccgggccatgtacctgctccacaagtaccacttatgaatctcagagcaatgatgccaccactgttggtagcagcactataacaggtgtagaccagaccaacagtaatgacaatacggctcagccacatctgaggagagactctggtcattgccaggttcattgggacatcgaaaataatgtaaccgacgtaatacaatgctgaggctgtagaagtgtcatgggtagtcaaattcagggtctggataagggaatgaccagtttctgcgttcatcgtcaaagtgtttccgtacgcagaagacccaaatgaagtcaaaaagtaaagacaccacagggcaggaatgattctataatctaaatgacgataaaccttatccagctgcttagttgttggggtatcatcaccagccacgacaacttcggtatcatactcaaagttcttcgagtctgagtcttgtgaacttgtttcaagccttgtctttggttcttcagccatgaattattaaggtttgtggtgaagagcaaaagtctccaaatttggtgctttaaatattcgcagaagttgtcaatcgaagatcggttttttttttttcagtcctgagaggtgcataattgaatcatcgaggtggcctaattaggaaattttttgtaagtcatctgctaaataaatgtactaaaatcaaagtttgaggtgacgtactcagtatattattggtgggaagctgatttccaggactgagagtcatttgttgggaaatcggatgagttgttttattgtctaataggcaattcacgatgattcaaatgactaactattgatattttttcacgagaaattaagttcattggacagaaattttcttatcatttactcaacgatttggcaaccggttcggttgggaaatgttgcatgacggtgtttcttgatcatcgatggttcattgcaaacttctcgcaggtaattcctttactatcgttattcagttaggaagtgtctccacccttcgacaattgtcgaactgaaaaaccagatattacgtaaatagccagaatacttgagttttacttgcattatagtactatgccattaatgttttaagctcggttattagtaagactatatctctgttggtgccaatatctgtatggcccgactagtgtgccctcaaatcacctaaatcgtcctcgctaacccttccccagattttcacatgacattggagtacattcaacatggaaaccgaatcttaacagaaaactcctcctctttcagcaaccaataaccaacgtacaatgacttgggagaactttgaggtaaagactgaagactttattgcccatgtcgagatcaacagaccccgtgtttttaacgctttcaacaagccgacttggagagaatacagagaggtattactccatcttgaccaatcaaacgatgttaaagtgataatcctttcgggtaaaggagccaatttttcatcaggattggacctaagagacgctttcaaagagtttgtcgacattggtagtcacaaggacggccggactcaagaaaggttactccttgaacatgtcaacgagtttcaaaaatgcatcggaaccccagcagagattaacacgcccgttatatgtttgattcacgggattgcctacggattggcaattgatattgcgtctgctgtggcaattcgcttggtcaccaaggatgcaaaacttggcattaaggagatcagcgtcggaattactgccgacataggcactctgcaaagactgccacatattgccggaaactcatctttggtaaatcagttggctctaaccggtcaagaatttgactaccgagttgctgaaaagctaggtttggtcagtgaggttgtagcctctaagcaggacgggttgcaaacatgttttaagattgctagggagattgctcaacatcagacttggtgcatctcaggcaccaagcagatgcttcaacaaatgttagatggcagcaataccgtagatcagggtttaaagaatgtggccgtttacagttctaggaacttgaaaccagaggcctttatcaaattattatcgaatatgtttggcaagaacaaatccaaactataatactataacaccttcttatttatgaaataacagtaattcagaacgacagcaaatcaacctcgccattgtttgcttgctgaggagttgatggcttcttcggagcctcagaggtaaatgccccgaatgaatcatcgtcattagcagcggattttgttgctgttggctgcggtttttgactgattttctttgatcttgcattgctcaacaaagaactaaatgcgtcagcttttggctttgaaattccattgctcacattcacttgagcagatgggaaagagcccggaactgcagacgaggtagagtaggtaggtgtagatgtttgagtagtggtgtaagtagaagagaacagttggccagattgaccaccaagcagatcagccaaattactggattgggcgctactggtgggggcaggttgagtttgagcagcagagctttgaaaatcgtcaaactcgtcttcatcatcactcttctttaaaatatcattgtcatcccctagtaaatcaggttgggcattgtagtttgtagatgcagtagtgggttgtgcatgtgcagttcttgaagtatgagattgtatgtgaccatggctcccgtcttcaatgtcatactcttcaaagtcttcatgatctctggtaccagaatgccctgcatcaacgctacgacgaccaaagtcactttcatccaaatcatcatcagcgctgatactaattccatgtgatcttcctaaaccaccagaagttgaaaaagaggaaccagagtgtctaccgctagacccactgtcatattttttggaagaaggaacgtttgtaacggcaccgaacttctttgcagactccctagccttctttcgctctgtacgaatggcactttcatctttgagtagtttggcaagattcttggctctgttacgtacgttaacacctctatcaacgccacgagaatcaatgtattggaagtttctaagcatagtcaccaaagaaatattacctctggcatcgtccacgaatcgctccgacccatgcttaatcagatactccatcagctgaagagccttgtatatttgtctccactcgttggcgcccttctcagtaaatctcctgaagataatgtttgcgatttcactgcgttctctataattgtaggtaccttgggctatttcattcatcaaactggcactggtgccccatggctcgttattagtggcctcacggactttggcctccatctcactgagattcaagacagcattctgagctttcctgacgtatgccttgacttcatacagggacaaattacccagcttcttgcctattccatccatgctcatttttagtgttgcgtgctggtgttttgaagagctaaactttgatgttgagagtcgtcatttatcggacctcgcgacaatatgagaaaagaaattggcttatgtaatcggcaaagaagcatggaggcaaaggtttggagatctaggcagttaactatcaatattcagtatacagtactttatacagattactcggttagctcgccagactcgacaatagtgacctccttgcttggtctaccactgttagagccaacagcttcaatagcctttacagcctcggaaccttcaataacctctccgaaaacgacatgggctccatctaaccatgggcatggaactgtggtgatgaaaaactgagaaccgttagtgtttggtccagcatttgccatagacagcaagaatggtttgtcatgcttcttgtcgaagttttcgtcagcaaaacgctcgccgtagatagactttccacccattccgttgaaatgggtgatatcaccaccttgaagcatgaagctcggaatcactctatgaaaaatagagttcttgtatccaaatcccttctcaccggtacaaagagcacggaagttttcagcggtcttcgggacaacctcatcaaacaagttgaatacaatacgtggctgctgggctccttcaattgcagtgtcgaagtaaacctttttaccaaaagcactggagatggaggaaaactgacgagtgttagcacggatagatctgaacatttgggcagtggtgtgaaatattgatgggtaactttttatgatttgcgatgcctattaattgggtccaggatctcacccttacaccattagtgattagcgagagagagcactagtgatggactccagcttatcggataagatcatgagccatttgacggtctcttcataattgacctcatctattgcttcactgaggccaggaaaaagaatggcttggccagtgagtctatctgaacctaggatggtatgcttcatccaaggcctttttggtagcccctcgtctattaacatgtggttatctaaactaaccaattttaaatttgccagttttatttgaacggcaattttgatttttttgtaatacttgaaccatggatagtcctcaacgatttcttcctgaagatctttcatatatttgtgaaagatgagagatgcagaattccatttcaagaaattggacttgaccaaatccaataaatgaacaaacttgattcctgaaacctgccccgaattcagttgtttccatacctttttgcaaacagggtgctcttgctctaaaatgtagtaatttttccacttattaattgttttgcagttgattaagttattgtaaaggtctgtagtgagggtactgtaagtgtcaacattaaagtgtgccacctcgctttcacttaacatcaacgttagcattccaatgaattttgaaatggtatcaagcttttttccttcaggatcaccgtatttttccatccacactttattgtcaaaggatgaatgtttatggaagaccgcatccccgggcccattgacgaatccaatttggactgaaggaactcccaaatggttctgaaaaacactaaaatcaccacccgagcccaacgtttccacggtaaggttatcctgttttaaccaatagtcatacaaatagtcttcttctttaattgaactgggggataaaactgttctcgaagcgtcgatcactaaattctttaacattgggtggctaccaacataaaaggttgacccacttatggcagtatctaggttgaaataacataatgtgtttttcctgatgtacctctgatgatcttctgcgtattcagtagatccaattaggccatacttggacgcatcccaggatacaaactttatattccgcagtggcttatatccaagatccagcaacttactgaatccctggatcatcgaaagcatggtctttgtgccactgataggatcgccctctccaaatttagtccacgagtctctatgagatccaactataatctcttctgttccaaggatacctggaattgtaccaacaacattcgtgatgatcttaggtttgtattcttgaatgttttctagcactacggtgtgcttagtggagttcaacggatatggaaactttgtgattttcttaccattcaaagtatccagcatgggctttgctgcttcaaaacttatggggatggaaggaactgaaggtatttgttgattgcctaattttctagaatgtttcttactagcccatcctggagttgctgggtcgcctggtgaattagcaatattatttacagtatctctttgtgtagattgtggattcctagcggggccactgggaaatggttttccgtcaatgtgatcatcagcagggtcgttaaaaagtaacaccccagcaacaccaaacttttcagcaatttccacttgcaacgagggaaggataaggtcagagtatttaatcaagactaccgatccttttagggcttcctctagctcgcctctcaaagtttcaaagtcttcaaaagtaccatggtttgcaaataccaagggaccggtagccgttccattggcagaaaaggcatggaatgcaaccctaccctcatcaccttcaagctcgggtgtgtatacgacattttgatcgagaatcaaactaacggatactttttttggctcatttaaagtaacatagtattcacttagtgatgttttcagcccatactcttcaaatttctccctcatgttgcgcgttagatcctcctcgtataaccattccaaagagtctggacttgctagttcgtttaggtatatcctcttcagatctgagtcggttagtccatcaccatgcaatcgtctcaggtccctacttagcgaggtccggggcaaaaaaatcaggttgaaaacaattattacaaatgctccaaagagacaatagtgccagaatcgcatcctctgttgcagcctccttccccgttctattttagaccaaacactcttcgtactagcattactaaggcgacgaagtacggaaccatatgaaggatttggattatccaaggttaaacaatctgattctgagttactgtcacttgacatattatggtggaaagtatcagacgttgaagcataagaacaataatgcgtaatagtttaggtaaataacagaagcggaagagcccagaaggatggggtttttataagagataaacgataagatggcgcgcaacaccgcgctcccgtaaacgatatctcaaagaggatgatgggatgtgctaatataaaaatacatgggatgactgaactgtctatagatacaatgacggctggcaatgttgaaccagattgagactactcttgctttctcttttttaggacttcttcacttggagtttccgcttgaggtcgctttttttcgctcaatttctttaccacttcctttccggatatgccgtcaactgggcggaaataaggttggcatcgccaatacggcacttccttgtaagatcctccccaaaactctataggtccatcctttatcgaatcgagctcctcgatgtcttcctgtccgaagattgactctactattgattcaatttttcggactactttctcctctatttcatcgagtgtagtccctttatgaatagcagcaatttctgctctgacatctgtgtggatgggaagaaaggttcttaacaatctgaaaagatgcgatttaagggccttccttgatgcatatcctggagtggttttcaggacctcaaaatattcacggacaatcctgtccaacctagggaactgtttctctttatcttcagtggcagtccaaaacactccagggttgaacagattgccttccgctgacattactgcatcagcattcactttctccaaacatctacccagatcgtcactgtataagatattaccattggcgaagaagacagtgtcgtctggcaagttatctcggatgtactttagcgtttcccagtttgccaagccggtctgttggcctttcatttctcttgttctaccatgtatcgttaaaaactgagctcctgcatctaataccattttggcgtattccagagatttttccttatcatcataaacacgaatcttggcagtaactggaattgacaaattctcgtgaagatgttttatgagtctatggactagtttccagtcgtccattagaaacgagccgtagtttcccttcttggcgattccctgtggacagcccagattgaggtctacagcatcacatttatcggcgacaagcctagctgcctgcagcagatactctggatcattggcacagaactgaacaattaatgggcggtcaaccttttcatctccgtctagctctgacatcatgtcttttctgtatttttcctgggtggcgaagagctttgcatggaacattggagtataacagagatcagctccatatcttctacttaaaattctccaggcaagttcagactggtcaaccatgggagcaacaatcgtcttgggcttcccaatagcttcgtaaagcgcccttccactcagctttgagagaactgtcatcttgaacagacttttgacggtattcactttggaaaatggtaactcaagtggagattagcaggacgatagtacccagaataatttttttttctgatttttcctcgatccaaaatgcaacctgcagggagttttatttcagaatatcaacatctcaactttgctagttaaactgcacttgacacttgctaaagccttagcacagcggaccctagttggcatatgactcgaggtatcaagaatagcgaccaaggtgtaatttcaaccattgtttctaggttgcttcccttggtcattggttcatgggttattatatatctgcttagaaaacagggtggagaggcagatgtgcagaattccaggatatattcatggatagcattctattggaacaagttaagagagagaaatactggaaatcgtgatggttccatactgggtcctgctcagtttaacccaactgaaaggtttgagatttataacgtggaatctctttcactgatagctgttctgagcatatgcttagtttatatgctgagctgagtagaacgatataggtactgtaggacagttagaatgtaatataggggagtagttattccagaaagtggatgcaaaaaaatatcgacaacggcaggactcgaacctgcgcgggcagagcccaaaagatttctaatctttcgccttaaccactcggccacgttgccttattggggtaaattttgagctctacgggtgacgacacgttgaaaagtttttcttgcagagtattaaatagtagaaatgattgatatctgttgggtttgctgtgctggtgtgctgattgtacatgaagaaggtgagagtaaagacattaaaacaaaaaaaataccgacaacggcaggactcgaacctgcgcgggcagagcccaaaagatttctaatctttcgccttaaccactcggccacgttgcctagattggaatcaaaagttgcacagtccaactcatcgaaattatccatattgagtattgatattagtttatcgtaatcggaagtgtttttatggtgactgtgtttcttggtatatagtgggtgtaaaaaaaagagatacaacattgcagttcaaaaagattgactcgaattgatcactacaactattaccctataccctataaactcagatcactggaaattcaaaaactacatcaaaacttggaaatggtctgcgctccacctcaaatccaaaatcattggaaatgcccacgcccctggttcataaggatagtaatggggtgatagctcactccgcactgccactcgagcgacggtaaaaccggggtacaatagcaagaaagagaggtgaagacggttctactggggttctcgcctactagaagggacttttgtggtaaacgtgtaccatggaagggctccacgagggaccacgaaagcacgagaggtctggaagatcggcgagagtcagcccatcagctgtagtgaaatctagaactttaggaaaagaaaatgcttctcgacctgacaggcctgtcaagaaatggtggttgccagtaatgacgaggatgatgacaatagattgtgaaacgaaaccaaatcaaaacacacatattacgctagatagactaataataaacacagtcaacgttaccacggcagaaatgtctgtctcagcaacccacagttgaccttaatggagctaaattacctaatacgatccacggtatcagtcagatgacgtatcattcgcgtaagtttgaaaattttgcaaactctgataccacagaacgctccaccaccggaatactcatctcgtcaacctgataagtcacgtgaaatctgctattccacataggtgatgaagacaaaaacaaagaagcaaaccagtgaggcgaggcgggggcttatccgagtgaggcgcccgagttttgtacaattgagctcacccagagacttcctgagcacagtaagctaggtctggtagaccacacgtagcaactactggaagaatggtctggacgacacccctcatactcaacctttttttctcccaaaccctgctgttctcgtaacctacctgctccacccgaaaaatgctcatgtcgtagccatccacgtgactaaacaaccaccacagttccgaaaaaatgactattgtatgtgccataatcgcgtattgtagtatgattcataagttatgtggcctggtcatataaatagacaacagcccgtcggtgtcaagccttaagaaaaaaaaacggtaaattcttttggaactcactggataatgtttactctagatgacttttgtgtgatagacggcaacccttgccagcctgggtgcatctactgctccaaggagtgccgagagcaggactcctccacccagcacacctgcgatctatgcgacatgtgggacctccaatcagggggccatgacaaattcagaaagagctctttgttctctacgccggaactgagcgactcctgccccaattcccctttacaatctttcgaagacgagattttcacccccgttgatgataagggaggtttcttatacgagttgacgcagttctctcggaacaccaaggattacactttacaagagccattgctacttgatctgaacagctccaacagccccaacgataccgccaaacaaaaccagcagcaacatacacaacagcagacgaatgtgccacaatctcttaccccagacctttctacggctcaccagaactatctgatatggctacagagggctcaataatgggttttagtttgcatttaatctactttttaatatggtagctgcatttcggttcagggatttgataggataggtttttacggttatggttaggtataggaatacaatttatagtgataatagagaaagcatgataattacaaggtggaatttttccccccttagatggtgtattagcctccccagcccaatatttatctcgcaccgcgcggcccttggctatttcgctgatcccgccgagttaagcgttttgcgcgtttcaaaactctccctctgactcagaaaaaaaatcttgggcgcgcgcgcgtcctccccggctttcctcctatccgccgcacccaaatattcactatctccgtcgtggaaaaaaaaaaggaaccactatcatttcatctttgactaacccattcctcccacttgaaaaactgagaaaatgtctgccaacacagagctgaagaaaaaacctgtcaacttctcaaacatcttgctgggtgctggtttgaacatgttcgagtaagtcacctctcacgcagccaaccatagttcatactaacatgatcagagttacctctttaggtcagcctcttgaagttgtcaaaacaaccatcgctgccaaccgtcagttctccattttgcaggctttcaaacatgtctggtctcgtggtggtgtcttcggtttctaccagggtttgattccatgggcttggatcgaagcatccaccaagggtgctgtactgcttttcgtgtcctctgaagtcgaatatcgggcaagaaccttcggtgctggcaacttcactgccggtatcactggtggtgttttcggtggtttggctcaagcatatctcacaatgggattctgtacatgtatgaagaccgttgagatcacaagagctaaacaggcagttgttcctggtcaagccccacagtctgctttccaagttttcttggatatctaccgcaaggaaggtattcgtggaatcaacaagggtgtcaatgctgttgccattcgtcaatgtaccaactggggttctcgtttcggtctgtctcgtcttgctgagcaagccattaagaagatttctggaaagggtgaacacgacagtctttctgtggtggaaaagattggctcctctatgatcggtggaggtctttctgcatggaaccaacctattgaggttattcgtgtcgaaatgcagtccaagactaatgacccatcgcgtccaaagaacttgactgttggtaaaacttttaaatacatttatgaacagaacggtattaaagggttgtaccgtggtgtcacccctagaatcgctttgggtgtctggcaaaccgtctgtatggtcggtctaggtgacattgctcgtgaatttgttggtaaattgacaggtgacatccctcaagccaaaggtcattagaattaagtacaatagcgaaataggatcaacttttcttctcactatccattctcaatgtttcctcaaatagattacctgatgattttgtgggatgtgttgcctttcctggaactaaagtcgctgtcaatggcgtgctaacggaaagtgtaccatcatgcactccagaaaacacagttgtagacggaattgatgataacagcggagggttactgttaaactgcgtagtggtggacaaggcaggtaactcatttgctcggatcaaatgtctaaacgaactttcttctagccggatagtaacgtccttcgttgctttcgttaaagtagccattgaagatctcacatcatttaacattggaaggtccgccatggcactcttagtagaggccaaaatattgataataacctttaaaaagtaattggtatcgtcccaaaacttgcgcacctccactagggactcttcttgacgaatggttgccaatcgggaatgtagtctcctggtgacatccatggctgaaacgcatgtactcgtcagatccttcaccttgagggcaactacattacttacagacccagactcctctccttgggcagaggctattgcactcttcgagatggcagcatttagttgactgaaaacaacttgagccgctgaagtagcgttgccaatgtactcaaagaggagttcatcttgctctttcaggtccttgacatctgtttgtggcaaatcttcacctgctgtagcagtagtatcaatgcggagaggcttagttcgggctggctgctttggaggtatagctttgaaacttggattgagaatctgataacaattcactaactcagcacaagaaccgaaaagcctcaagcaagcctggcgtaagaccaatacgtttgccttgtccgtaaacgaatccagccttgatctcaaaaatacaacgatttgtttgaatgaacttaaacagtgggaaacggatgagatgacattgtcagttaggctcgttggagttggagatgggacctgctgcaatagttcaaggtagcctacgaggccaccaaaatgttcatctgaactattcaaataccattccattcttgaggatagtttggcatcttcgcaatagtcacaaaatctttgaaccacattatgagcttcggttagggagaacacgatcttgttagatatttcaaataactttgattgagttagggaagagcccttaccctcaggaagggttgaaaggcgcttaaaatatgcacttgacttcttctcatgattgaaaatagttccatttccttcagaggtgccaaaggtgtgagatctgtttcttggagtgacattggactttttactgcccgaaaaatccttgggggataatcttgctgcaatagttgggttaatagctgtgggaatcgtaggagtagttatagactgagcattgctcacagagcttgtcgtattaatggataagggaggaggaggtggtggaacggaaggcagagcagatgtgctggccgtattattggtgatagtggtagttgtagttgtgttattattctgtgtgtcctgttcaacaggttttgccgtttgcaaaggggctgattcactattaacgggtttcttgatgacaaaacccattctcttagcagcccgcgttgatatatgattttcactgttgctcctactgcgtatgagtagcccatcatctgaatcattagagtcttccttttcttctccatgaccactcagaaacgacctcaagctatcaagccaatctctgttcgtttgttgctgccatatttgaatattctctagagttggaaacttcataggatttcctgacaactcaagcacttttaaattgaccatcttgctgacgctactagggagggtctccagggcattatcctgtaaagagagaacttttagggatgtcaaattactaacattcttgggaagtgttctgatttgatttgagctgatatccaaaacctccagtttctgcagtagacacaacaccaagggaaactcttgaaagctatttccatgcagatcaaggcaagttagctgggacaaacggttgaaatacaatggaagaaagcttagtacattatcctgcaaagacaaccgagtagttctatccttgatcatttcaatagcctctgtaggaaaagagtgcaagttgcagtttgccagtttcattccattatcatcgttgatactccgcttgaattcttcagatatgagggttactgctctggaccttgacaactcgccacttgtttgaggatccgtagtggctcttgggccagcattctcatcatctgcaaccataaataaacgtctttctctttgaacgaaactaatagtggattggtctttgattggaggaaggatacggtgatggctgtagggctgtctggatcaggatcaggatatagtaatcgatttggcgataattgggattcgtgaaattagaacttacactacaaaagtggagatcgatgagggttgacatttcaatgagatcttacgaagatttggtttagagtaaacataattcaggtatatctggtaaatagggaaatacctgaagaagggtttttcgaattttcctacgatgatgattattataaattatgcttttttaaagtgaaaaatgaagaacaaatcaaactgcatctctgtaatcatgaaatgcctatgtggaccttttattttgtcatcagagaaaacgatgatatcgtattaaaagcaaagactatggggttttgctgcgaacgtgtgttagatatgttgttggaaaattacatgtggaacattcaaataaataacttctctccagatgagtcggtgtttcctgaaaactctcctgatcattatcaaagtgaagacaaattaagaatatacaatcaagcagaacaaaataaaattgaactggattatgtctcttatcttaatgcagagagtgaaaaagatgcatacatgaaagaattggatcaagaccagttttgcaatagatattttatatacgtagaagatggtaagtcttacataaaatgtgtgactaagaccatggattggagaaaagaaattaagtggtgtcagcctttattgaaaaaaatgttttttgatacagatgataattatgaagaaaactactatcaagattttgaaatagactcatgatgcatttacgtttaagtaaacctcaataatgatatgtgaaaaattcatttcagtcagaatcggcataggttaccaattggtatgctagtgtggatactgatatatgtatagaagcttagccaaaaggatcagcgctaccatagcaaatactacacagagaacactgtctcttttgctcttgaactccgtctcaactatttttacttgctccataacctgggtacgaagagccacttcttgcactactgttttctgttcattcaaaacatttttgtacccttctattacttcctgaagattgctcaatttagtcgacgaatctgtatcctgctcacctctctggacagatttcgttaaccttggaactgtgttctcttcaagggttctcatctctgatttcaagctttcttttactatcagcagttccttattcaacctggttaactgatgtaatttctcgtcaatggcctgcatcaacatagttttctcctcatctgctttaaaaatctggtatttgagactctttatcagatcgaattctaatttgcgaaccgtctgtagcatataatcgtcaacctcttcaaattttccatcaccgtcctctgtaagggtaagctgttcgaaaatattcatatccacattcgatctacttggcaatttgtcagaatcttcgaaaacacctccacctggtgattctgtacgtgcctcttccacctcttggtctccgtccttatagaatgattctaccaaactctgcggtgtatcgctacctagttttcccaaagatgtgaagctgggggtctgtttgtgtttgcgtgtaagtgatgctattgggttggtgaaactgctggatgcgctatgactgtatctctccggggtcgattctcctgagatcttcgcctttggagttctggactctgggatggcgataagaggttctgagccgtttctagtatgtctgaaaggagataacaggtcctgctgtggcaccgtcaatccagaggaccttgcggtggacgagacgttcatcccttaatatgtgtgatccaagagcaaacagtttcttaccaagcagaatgagttcttgaaattcctcctctgctatctgtgcgagaggttcggttcttcaagactcagggcggcgggcgagcattcgttccaactaatcgcccttccaacatctaaaacgtgccccaaccaatacaaggggacgcgacttgaaatcagagtgatttggtcaacatcgaaacaaacatcacacaaactcgttgtttcatggtcaacagttgtgctcaatatctgatctacccacctttttgagtaccaatcgtataactggacacgcgtgtttgaaaaggaaaacagtgatacccactttttgtttgtttttgtttttaatttgtaattagacatccacttctgaaccctcgtatattattaccatgtctactgggacatttgaggttggcactcgatgctggataccagatgagcagttgggttggtgtggagcagaagtttctgaaatttcagaggataatggcaaatatttattgatttttaccaaggagaacggggaatcccaacagatcaaaacctctactctagaagaggacaacgacgtggaaccaaagttgagaaatccccctattttggaagcacaggaagatcttacaagtctttcgtatttgaatgaaccctctgttttgaacgccatcaaagtcagatactctagactcaatatttacacctattccggtattgtcctgattgcaaccaacccctttcaaagagttgatcaattgtattctcccgacattatccaggcgtatgctggaaagcgtagaggagagcttgaaccacatttatttgccattgctgaagacgcctatcgttgtatgaagaccgaccatgagaaccaatctatcgtcgtcagcggtgaatcgggagctggtaaaacagtttccgccaagtacattatgcgttactttgcttctgtcgattcaagcaatcactctcacaatatgtctgacacagaaaaacaaattttggctactaatcccatcatggaggcctttggtaacgccaaaaccacgagaaacgacaattcttcccgatttggtaaatacttagagattttgtttgacggaaacactgtgattattggtgccagaattcggacttatttactagaacgttccagattagtatttcagccacctactgaaagaaactatcacatattctatcaaatattagcgggactatccaaggatgataaggaaaagttgggattaacgtcggctgaagattttcactatacaaaccaagggggcgaatccaagatcaaggatgtagatgacggtgaagaatttagtatcacatcagatgctttatcgttgatcggaataaacaaagacaagcagtttcagatttatacgcttcttgctgctcttttgcatattggtaatattgagctaaagaaaacaaggaatgatgcacaccttagttccgatgaaccctccctggtaaaagcatgtgaattgcttggtttggatcctgtcaactttgcaaaatggattgtgaaaaaacaaattactacccgaaccgagaaaattgtttccaacttgaaccaccaacaagcgaccgtcgccaaagattccatagccaagtatatatattccgcactcttcgattggttggtcgaatatgtcaacagtgatttgtgtcctcctgaggtcgaagcaaacatcaagtcgttcattggtgttttagatatttatggattcgaacattttgagaagaactcatttgaacagttttgtatcaactatgctaatgagaaactgcaacaagaatttaaccaacatgtgttcaagcttgaacaggaagaatatgtacgggaagagatagagtggtcttttattgaatttgctgacaaccaaccatgcattgcccttattgaacaaaagttgggaatattgtccctgttggatgaagaatcaagactgccatctggtgatgacaaatcatggattgagaaaatgtaccagacattggacaaggaaccaactaacaaagttttcaagaagccaagatttggaaataataaattcatcgttaagcactatgccctagacgttccttatgactctgaaggtttcatagagaagaaccgagatactgtaagtgatggacaacttgagaccctaaaagcttctacgaatgaacttctttcggaaatattagcaacggtagacagaaacgcagaaaagatttcatcgaatcaaccatcaaaaccaggaaagatgatgaataaaaaaccgactctagggtctatcttcaagaattctttgattgaactaatgaaaacgattgattctaccaatgtacattatattcgttgtatcaaacctaatgaagagaagaaagcatgggagtttgatcctgtcatggtgttatcccaattaagagcttgcggtgtgttggaaactattcgaatctcatgcgcaggtttcccatctaggtggacctatgctgagtttgcccaacgttatcatattcttgtaaaacccgatgcttggacgaagcttttgacaggtaatgctgatgaaaaggcaatcaatgagctttgtgaactgattttgaaggaaaccgtggatgatccttctacttatcaaatgggtaataccaaagtcttttttaaagctggaatgctagctaagttggagaatctcagaaccgagaaactgcaccaatctgcagttatgatacagaagcatattcgtaaaatttatcatcacaccagattcttacggattaggaacgaaaccatcgagttgcaagcggctatcaggggaacgagtgtacgaggcagaattaggcgggaactggagcaacaggctgctactttgatacaaaccatttctagaggattcttagtacgaagggcattcaaggatcaagttgaatctgcggtagcaattcaatcgagtatccgcgggttcaaggctcggaaatctgttatggaaataaagcacaagaagtctgccgtagtactgcagaaaaatttcagagcatatctcgccagacggggataccaaaagcatttaaaaggcattgttctagtacagagttacgctcgtcgctggaacgcacggaagcagttgaagactttgaaaattgaggccaaatccgttgatcaccttaagaagctccaatacaatttggaaaacaaggttattgagttaacccagtctctgacagataagattgccgccaataaagatctcgtgaaagagattgaccgcctcaaggaaacagttgcagaatcaagtgaagcacatgaaactcttaagaaaagggagattgaattcaaagatattctcagcgagaaagagaacgatcacctcactaagaccgaatctctggctctggaattggcagaggcgaaagccacttatgaagcctcgttaaagaggacagaagagttgttggagcaacaagagactttaaagaaggaagtggctgaaaatgttgccgccttgactaaagcaagggtggagttggaattaaagaatgatgagaatacctccctgaatgaaactgtaacaagactgaaaacagatattgataacttacgcaaagagctggaaaaggccagatctggctccgtattccagcaaggcgttctaagtggtaataagtcgataaatggcaggatcgccagtgtatccagcgaagcagactttgaactgaataacaaaaagaacggtaccacacgtagagtttctggagcatatgaagggattgaaaatgtgtcaccagacgatttggaccgcctcaacagtgagctttggtcgttgctaaaggattctaaaagcctacacaaggaaatcattgagggtttgctgaaaggactcaaaattccaggtttttctgttgctgcggacttgaagagaaaagacattcttttccctgcccgcgctatcattattattatcagtgatatgtggaggttgggattaacctcagaaagtgaacagtttttgggacaagtgttagctgccatccaaaatattgtttcttctttgaaggagtcggatgttatcgctcatggagctttctggttgtctaatactcacgagctgtattcatttgtgtcatatgctcaatcaaacattatcaacaacaaggaggccgcagccagtttaggtgaggatggatacaacgagtatttaaagctggtggctgttgtcaaagaagattttgagtcgctctcgttcaacatttacaatatgtggatgaaaaaaatgcagaaggagcttcaaaagaaggccatttctgccctggttgtctctcaatctcttccagggttcagtaccccagatcaatcacctttcttgtccaaggttttcaattctggagattcttacaagatggaagatatactaacattcttcaattcattgtactggtctatgagaacctacttcatcgaacaaccagtaatcaatgaagtattggaacaattactgagatacattgatgctatttgctttaacgatttggtgatgagaagaaactttttgtcctggaaaagaggactacaagtgaattacaatattacccgcttagaagaatggtgcaagactcatggaataaaggatagtcttacccacctcattcacatggtacatgctgccaaacttttgcaactgagaaagaatactgtcgctgacattggaattatctttgagatttgttatgctttgaagccagctcagatacaaaagttgatctcacaatactatgtcgctgattatgagactcctctagcacctggcgttttatccgcagtggctgaaagagtgaaagctgcgggtagcaatggtgagtttttccagccagtaaactccgatgggaactttgaggatcctttccgatctgttggggtgcgacctgtctacaaagttgaggcttatattccagcatggttgaacttgccaacgttgaaggagatagtcaatctcgttgctaaggtggctatgatgaacgaaatcatggcccaaaaacaagacaacgaagaaaatgaagttcaaccggagttcgtagcccaatagaggagcacgtacaaaagaagaacaaaagaagcatacaccattagatactaagctacgtacatcaacgccaaccagttatatatatccaagaaataatacacattatccttgattgagacagactctgacaattatgtgaaatgaacaacaataggaacgatgataacaatcagcaaaatcacgattcccaggatgatacacatacgcatcttcatgtctttccaccacatttgtttacgcaccctgttagcacctcgtctgaaaccttgagcattaacagccagactgtcagctttgtcctggatcgactccaaacgttcgcctcgttgtgccactttgttgatgttgtctttcataatgccgactgtagcgtcgatctgattctggatgtcctgtgtcttaggggcggccgcttcggagccctgtgcagggatatatgggtcatatgggactgaagaagacatctttctgagttgattgtgtctgtgtgtaactgataacttcggtaggaaacagcgatttgatagttccaggagtggccgagctaaatatggaatttgtcacactggggcgaagggttctgcctcttatcaatcagtacactactattgtgaaggatggttatataatcattcgaaatcatcttagacggagttagaatcactgtcacagctgaagattgatgataaggagcatgagtaagccgatagaacaggccatcaagacaaaaattactggtgcctttcagccggtacatttggcagtgaaaaatgactcgtccaaacacgctcatcatgccggcttgaggggtgctaccaatgtaaccgaatcacatttcaggttgacgatagtgtcagatgccttcgcaggaaaagcgctgccagcaagacacagaatggtttacacgctattagacgaagaaataaaggagaaaggagtccatgctgtgcaactgaaaacgaaaactccaacggaatgggaaaaagatcctaaagatctgtaatttaatataagttagataattaattatacagtaaaaaacttgacgtttccccattagctttcctcctgcaaaaacttgacgtaagcatcgatatcaaacagttcagcgtccagcagttggtcaggatctgtgactttgagcttggctatccatccctctcccaacggatcgctgttaattaatgcagggttgctggtcaactcgtcgttggcttccaagatctctccatccacaggggtgtaaatttcactggctgatttgactgactcgacggatccaatagagtcaccgacttggacagaatctccaacttcagggacttccacaaatgtagcatctccaagcgcatcagctgcgtatttggtaattcccacaaatgcagttccatcgggatgacttgccaaccattcgtgttcacgggtgtaacgaacagtgacagaatcagaaaacttgaaaggtacagcgcttggattaagagagtttgcttgagcaacggtggaattgaaacgcaaaattcgggagcccaatgcggcagcaacagggcgcattgggcgcacagctattcttagtggggctaacatgttgtatggtattggcacgcttgtgtgtatgtgggtgcgatcaaaggtgataagaggttctgtgagtggtctgtgttgaatatatataaatggtagcttcctgttgactcggtgagaggtgactctgttatgacttggcgacaactaatcgcgaagggttcggtctgacgcagcgactacacggtgagctttcctactcttcagcttgatgaggttggcaacttattagcctcccaaaatgtaacattttgatctaaagttgcggggagaaatgacaattctggcgccatgttaccaattgtatggaaaaagtctctcccaaacgtattgatgaaaaataactgagagtttgctaacattgggaaccattcgatagcagtctcaggtgtaatcgatctccaacgatcaaccagtaaaggatctctagcactaaaatctttaaatgccttcttctgtaaataaagctccaactgcgctagctcgccaaactcgtcgttgagggaaatgccccacttgactgagataggtaggggacgtgcaacgttggaaatatcagcagccttgattagcaaacagacaagtagagaagacgagatcttagtcgggtctttagtatcctttgccttctgtaaatattcaaaatgacatgacatatctgtggccaaaattgcttctttcattactttgccacagtcaatattctcaattgttcctaacaaatcagggaagtacacttgtaaaatttggtagaactgagtaacatggaagttttccagtacagattgattgttaaaagcttgtgcgactggaacatcgtacttattcataaactgattcgtaaccgcaggatgaccgatatcatggcccaatgaagcgaccaccaaaagtaatgcatttaacgaggaaaacgtattgaataaagacgtcgacgctttcagcttggcaagaaaaaaataagaggcctgcattacgtctgtagcatgcctgaaattatggaaggggtttcccaatcggtagttatctctaaggtggaaaatgaaactccacaatcgatgtttaggcatcaaatgtgacaaatgtgggtatgaagcagtaaggagatcaatagaagtatcaatcatgatatatgcgcagcgtaaaagttcatcaatagtcaggtccaccgcagcaaaaccccatttatggattaattctgaataatcgaatgatgattctctcaatttcaagtagtctgtataaggaatttccttcgataacagatcgacaaaaagttgatattcgtctaatggaacagtttctgtgaaaacattatctttacatcgttgcatggtattcaactccgagggaagctcagggagagacttgttgggatgttcgcttggctcataaattggatgcacttctgtccacaaccgcacacgagttaatcttgatctcagataagggtctataccggccgttctcgtcttcgcttcactacaagcagccttccaagcaggtccagcaccttctggatcagaatattgtataaccactggactgaggtggtggaagtgggccttaacaagtgctgcttggcggctaagatctatagagtccaacgaaatcttttcactatgcgttgactttttgccactggcaacatcagggtcaaatgtattgattagaatggcaaatgaatggagaaaatcgtcttccgaagtgttagatcggatctggcccgaagcttcatcgtaggagtacgatgccctagtagtaagataacggagcagggaactgaaagaagaaaaatctgccctaatgcagagattgccgccctcttttacaacctttggtgaaacacagggttttgctttgtcaagcgttatcaagttgtaaatcatgatagataagaaaagaaatggggagggacaataaacctgtagccttcgtcttgtcgcagcaggatgaggaaacgtcgcgaggaagtaatctggaaggagtaagtagtaaatttaggcgcacgtacatgaaatgaaacggcctgaaacgagacaacattgtgtttagtagttgtgagaaggaaaaaggttgagtctctttatataaaaatagtctactctatgtgccggacatatgtatagcgtgtggatctaggcgatctcgcctgataactgacattcccgaaccaaggcaaaagctttgagcagcttacggcgagcaccaacggtagctatgcctagctgggcaagatcttcgtcattgagagtcaccatcaccttccaggacaggtgtttcaaaatctctgtatacttgtgtagacggagcgcttttaaccaagctggaatattattgagtaactgaagagtggtaatatcaggaggcatgggagattttggaggagctggaggagcttgagggtgattcacgctgttgagtgacgctaacttgagaagggactctgttttcttaatgtcttcatctgaagaggcagttgatgccatcgttgttgatgattgggccatgggggttccattaacattgacagcagagactggtcttggtgcagcggggacagatgctgacaccccatgagattgttgctgacgttgatggagtcttccacgagcgtgtgcatcatcagaatgcaaggggggagaaggcttcttgagatcagacgtgcttctggaggtgatggtattcaatgcgttcatcttgagtacattttgattggtcaaatcgtcaaagttcatggtatgacctatggaagagtgtccataatggccatgtgtagaatcagtttgcagctgcaactgcaaagctctcctgtggagatatgatgggtcagccacaggggagaagagttggtagggctgctggagagggcctgctgagtgcggtcttgagtcccaatttagctgctgctgctgttgttgttgttgttgttgctgttgatgtgactgctgattttgagagtgtaagttcaaactacctagattattggagttggatgaaaactttccctcgacataggcaaggacatctgggttcaaatcggacaataaaagatccacagcgacgatctgctcgttggaattcaaagatttgatccacgaattgaatcccaataagtcgcccgaaaaacctgaattcgttgtggtagcaccagctacattaccagttggggtacccccaaacctatcaaatccagccagacctccaaaaccatgatcgtgcaagcgactggtggcaagccccacggaagaaatgggtctttgaggcggcgtatccaagaacacagatcctgatgaggccaacagagggcttgggaggcctatgccatctcgaggttcaacaaaaggaatgcccgaacctagtgatgccccaatgttcgcctgagattggacatcaggtgaaaggagcagagacgacgacgaagctggtaccgaagtggcagaaggatgctggatctctgctgaagcgttgttatctgcccattcgtcctcagtaaagcgaagtttcgactctttctggcacatttggtggtttgtactccggggaggaaaaaaagagagagggacgaaagaatccatctcaaggggcatggatggatggcgtcgcgggtgatgagtggtgttgtagcgtcgatcctcggtggaaaaaattactaggcacaacctctgggtgggaagtgatcactaggagggaatgaaggcctgcaacgtggcaatttattactctactgcaagaagggttgaagtcgtatgggagtgggaagaaaactttttttttttccatttttttttgctttgcatggacagtgaaagtctagaaggtggtggaaattgaggaaagtatccccgatgcatctagtggatattattagggcacgcgataatcttataggtatggctttttttgtgagacgaaggtgagtgagcaggtaaatggcagagcatcgcaacgagcggaggacaccaggacggaaagctaattaaaatgactattagactcatatattggtggcagcaagtgtcccacacataacggcaatcccctcgtaaccttgttcctgtgaccggtataagaagtcacggcttgcctccctaaaactacataattaaacagcaagagtttgtcttcttggcctgcttgtaaaacatccgagaactggaacttagagcttcggacttgtccaccagagaatccaatttctcccctctctgcaacacactctcaatagtcttatgtaagacgatcttggtttcgtctaactccttctgcactctggacaaggagtctgcctgagatgggtcctggtaggtgcgcaaatactgttctagctcgggatatgccaatgaaggtgtggtgaccgtaacggattcccattgcgatggtggatgcactgccagatactcgtcggcgactttattcagcaacgtatacgctggtctaactggatactctttgtctgttatcaaaacgcaggcaataccttcagatcgactgtaaacatgtccaatgtagtttccttcctcgacactctgtctctgtccggctggagttctcttggccaccgtttcagcaaagaaggtcataaattgtgagactccgttcttttcgaagaaggaaaactgagagagatccttagcgtggctcaactctactgccttctcactgttggtcttgatcactcctaaataatacagtttcatgctgtgctactgttttgttgttctctgtgtcgttgctgtatagatgggtgtaggttattttggagataggtacgaggcgcgatttctccagagatttaatttttttttctttttccctcttcttgagtgtaacatctctgatccaacatatactgcccgtcgcgaacttatcttcacttttagcctttccttggaaggggctcagggcttaccctcacctttcgaccagatcacctggacctctctcctcctttcctcgtcaaagtctcgttctccttcttccgccttttcctttcattcttcagagccacaagcttctattctcacactatagaatgtcttttgatcctgtgtatgacagcatcaagtctaacgatcagcatcgggactcgatgaaaattgatcgtctcttggacgacgaaccagtcacggatagcggcggtctgaacggggcttcggaacttgctactcataacgtaagtgctaactcagaaggcaagtatgcttcagcttcaagcacattgccaactgctctgcctcttcgtgatccagttgatcctctgacacattcagaaatcgcagaggcaccagcttccaatgcagcggggaaagtcaaggctctccaccgtcagcaattggctacaaccaaggcaaaaaatttgaaaaaggctgacggggagccactgttgcggaaggacatccgttttgagtttctgatgcatcttttcattaacaaccaccgaattttcaccaatgatgaaaatttaaaactccccagtttcttccacagatacaaggacccggaatctggggacataatagaacatgacggtcgcagtttgaacttttttgagctctacttggccacattgttgaaatcagatcgtctcagtaaaacacttaggcaaaggatcgatgaggatattaactacgccctgtgtgtcgtttgcgtttgcttcttggtcaactttggccgtttcaacacaacaatcaactttgactacgagatgcgctcgcaactacggacataccactcgattcccccattgcaagttaccaagttaacgcaatatctgggggaatactatgttttagaccccataaaaactgaacaaaaaccaaatgaagctgaaattgtatcaactccaaatagcttagattttcacagtttttcacctgaacctgattctcagaacagagataccgaaagtcctcaatcttgtgtcaacctccccgatacacctcggttgaaatctatattgaagtcaatcaatgacaccgcttcattccagcctatgactctagaggagctctttactgggataataagccgcgttcaggagcgtgagggtattactccttctgagactgcgattcataatggcttgaacgttataacgttgatattctccctatccagcatggaaattcagatagggaaattatttcttaaaggtgataacactgaaccaagcttatttcaagaagtgtttgcgtcggacgatatttctcccgaggttaaagtgaaaaggttcttgtggattctaatcattttcatggagtcggatctatcattcaagtcaattagaaaattgccattcacgcagcatgaaattttaaacctaaaggatgatggaagcgaagactattacgttcagctttcctcgggagccaaattttacgatctgtcgcagttgtactcttccacgcttgaaaacgccgactacagggccgaagtttatgctatcatctcatcgttgatacctccagtcgaagcaccagcagacggggaaagaaatgaaatagacgctgatacgccgttagaggtttcatttggagagtacatgcgaaataagagaaaagtctttttacagaatccaacggacaagatccaagagcgcaagaaacgcaaaacggaattcaaagagaaacggaaagaaccagagaggcgaacgcaaaaacggaagacagagaaatcatttgaagaaggtaccgaatcagcagaagaatttccatcagaatctcctgcatcatcccctgtcaagactgaacccaagaccagaacggacatttctgatattttgaattctgacactgatgatctgaagaatagcccaccaaaaccagttgcaaaaagagcgaacgggaaacagaaaccgtcaaccagacacaagggccctactgaggcctcaacaaagatcactctgctagtggattccaagcctacccccaaatcagggaagactcaaactaaatcaagacaatcgagaaacaaaattggttctggcgatgcagaggaggggaagttattgagcaacttcattaaggagttaattctatacaagagcaatgcaatccgtcaactgagactcagtgattccgaagttgccaaaaaatatttattcaatgatgatgagtcgctaaaggtgctggatcacctattattgttgactggtaatggtgaccacgaaagctccaagaattcccaagaaacccacagcttggtaacagaagacagtctacaagatgtattgccaaatgatttctcagaatatcaggattatggagagtttaatcgttcttacaatgggatattgaactttgtaaacgataggctatccaagatttacaattgagaatctgtagttgaaaaagttgtatgacttaggtgagccagaaatctgggcaccttttatttgtatatacaatacatatcaatcaattctacaaggcctccagggcttctatgctaatgacgctgttccctctaagaacgcaggacccaacaggggtatcttcagccctgttactgggattaacttgaacacaatcatctaaagtcaggttcaagaagacatcgtacccggtcaaaagaccctctatctgacggccagcatttatcttgacggagatcctgtgatggaggtatttcttcagttctggagtggaaatgaccatttgtaggaagacacgatgcgatgattccaggacagaaagtttgaagttcgatctatgcgcgaaggcacatcagagacgatgtcggatgctaaaggtagtgttcttgaacgtattttttcacttttctttttcaagcacctgtgggattacaaactgagattggcacactgattatctcgcagctgtggattctagtgcttacgggtactaatagctaccatgaaggggctgccaagaaagaataagagcacggtcctgagggctacaacggtgtgtcaatgagcgggcagatttctcctgttgtgaaaaatgtccctaagctcgctcgtttcagtgtgacgaccctccactgaaacatgacaggagttccagttccgcgttcacttcacttgcagccttgtttgagtcacgaaaatctgtgcatctgggaattcaatcaaatcacaggttatctgccttcattaaagtccctatttcgtttttttcgtgatagctgcatgataactgcatgatagttgcaacattgtgcattcaaggtgtcttgtttcatcaacgtcgattcactcgtggagccccccaattctaacactgtcagccacttttgtttttccttccatcatcggttaaacactccggctatcatggagatagataaagtaaacggcctgaaatcttggtttactaaagagcaacggcgcactttcccgttgtttagatcgaagcgtagagcatcagctactcctcctgcaaccggcacaagtatttcccaccctttgttgttaacagatgcaaatgatagcatcccaaaactcagaccacttgctttatcagcgcaaaattcagctgctctccattctcctatagatgaggattatgctttagagagtgagttggagaatcagcagtttgcagaagttaagcttgagttgtctggagatgaaacactaaatttgaggatccctgaaattcttcacaacgcctgtgagtttatcaagaacaacgaacctgtagaagggatctttagggttagtgggagcctgaaaaaagttaaagagatcgaagagtcactcagtagtgagcagaaactggcctttgaggggctagatcttgacagctttgatgctgcaacaataatgaaaagatttattaccagactttctttgcctcttgtatccactaacttgcagcagaggctccagttaattgaacttggagactgggagggttatgctgagactctggaatcgttaaacaagttccagctacatttgttgttatatcttttggaatttttcaacagtctcttgcaaccagatgtggcagcagtaacgaaaatggacggcaagaatatcgccagaatatttcaggttgtgctcttcaaatcggaccactactccagcagtgaggatttaatggtcaactttgagagcaatgagctggttcttttatctcttattgagaatgttgagcagctcaaagaatactttagtaagaaggatacagcgcagaaagagcaaaacatgttaacgttaccaggtacagcgctaccatcgaggttacctcttcccgttaaatcccaggaaattaccacgaaacaagccaaaagaccatccagactatccagaatgctttccacttcagcaaccgacagcgggtactgtatcgattctgaaccctctttatcgtcttcgatgggaacaacatcttccaacccgatttcggatagtcctagttcgatttcaacttcaattttttctacagcaacatcagcaacgtatgactctgaatcagttgcaatggctccatcatctatattttctccttctgatagaagtcctatcccgttgaatacccctcctaggagaaaattaagttttgcacaatttcgattgccaagtaaatagatacccaggtcaaattcctagttttttttgtttcaatttttgtcctatcaaaaggacgccgctaattctaatgctgggccttagaagaagcttgctggccatctttttttatagtaccggaagcttttgccctatcgtctgtaatctaacttgcctctaacatcgtattctgattaaatcgcgacgtcaaataaatatgcccataattgacctacaaccttctgtgcccacgccttatcgactaccaaatccatagcaactatggccgagttcaactccgtcctgctagatggaggtgctaatttgtactggtcattattgctcacatggattttgaccgtttgtgtcaccatattttccctattctacatgcaccgaattgttgcctttatcataactaaggtactatatttcaccctgtggaaacgccataaggttcatgtgagcgttcattcttttaagataagcgtcttgggcgggagagtattcttcaagaatcttacaattatcaacaaagatttcacaatatcaattctccatggtacgttgacgtggagatactggctactgaatacacgagagcctgccttcatgaacgatacaccggaaaacgcaaagctgccctgtagatttttacttcaactttacggatttgaaatattcatgtataatagaaccgcagcgtacgatgagatactaaggcagttgaaattggatcgaaatcaagcacgaggccaaacacaaaacaaagaacaagattcagaacctagcttggaaaaactgtcagattccatacattcactttcatctcaatccgataacagagctgatgaatgtgttccccccaaatggttcaaagttcttccagtaggaatacttttccataaatgctgtgttgtagttggtaatgatactgttgaatcagttttaacgatgacatcggataatacagaaggttcgttggacctaatgagaccctcctgcaggctggacctggctcaattcaacatcaacctcaaaaactctaacgtcaaagtgcattttactcctaacttggcttatcaaaaaaatgactcttcctcaacgaatcctgacaacttgctcaccaaaagaagaaaactgatacaagcattacttggactggcgtccaaactagttccaaaggcaaaatcacataagttagagagagccatgactttagactattttgttcgccaatggaatgggttgtcgagatatgcagcattcgacgatgaacttggtgatactatgttttcttctttgaatgaagaatacgccagatactccaatattgtttcagccgattctctggatgtggtttatttttttgatattcctggcagagtcccggtagaacctgatatgtcaacaggagatagcataacgcccaatattgggaataacgggccaccccctctctctggacttagtatttcatcttcaaatgcgctaattcattatggtccatgggctgatagacagcggtactctctgcaacagatggtgttcccatatctctgtagggatcatgctccaatcgagaaactgaagcctggagatatacgcaaatatactgacttcaagataacctttgaagttgaagatactctgacgttgagagttccttttaaggagtccagtaagaacgcttcattcttacaatctttgaaggataggtttggtgaagatgtaaatcttgaaactataaacaccaaaagaccatttgcttggttagaattgaagacaaataagaagtcgaatgtttcaatcagttcaggctctgttcccctggaagatggctggaaaaatttggtcaatatttatttgaaagacatagaggtaagaaccagtattaatcataacgttcttatcaaagctacagaacatgtagtgtttattgatatgtcagcccctttggcttggaatgggtatacaaactggactgctgatttgaaatcgaaagatgccgatttttttcttttaagagagcacgttactttgatgttggacttgtttgacgattttggttcaggcaaccctaccccatacgaaatgttcaaaccatttcattactacataaactggaccatagacaactacaagctgtacctgaacatcaatgactccaatatcattaataactcggttgatctaaatgataacacatttgtttgcataagcggtgcttcgactacgtgcaacataagtatacctttggagactattgtgagaaagcacaatactgtttcatacaaaattcgaacagatatgtttcatatgtccttgtctcttcccccatggcacaccctttcctcattctgcgacaataaagaagtaggcagggcagtgaattttgaactagaaggcgagtacacttattattctgtcttggatattaatgctgttgatactgttattataaaatgtacttcagaagacaccactctacagacatatggatggataatccgttacatcatgattattaaggagaactatttcggggaaaacattcacttcaaaacactggacgaatttcaccaggcgaaggctaatgaaaacatgggcacgggcaatgaaaccaacatatattcacgcacgagtgatgacctctctactataaacaggtctaagagtttttcactttacagcaaattatttgaaagctcgtcaaatgttcccaagcccgaagatgacgattctattgatagacagacagatgattcatctatagatacggaactcagttctgataccgtttccgatacagattcgaagaataataagcattcaatggtattacctaggaccaccaacgaaacggatattctgttttcattctgtgtcaagaatggaaccatagttcttccagaaaatatttacaaatgcaatgaatctcatgttgccttaaactttgactctcttgacattgacattcgattcacaaattactacatggatttgcaagcaaatttatctcctgctaaaggattcgaagtggaaaatactagctctaatgaagtgctgttccaacgcacaatttccagggtttatgatgattggactccagatattcaaattgatggactagctgtccatgggcacagaatttttggtttgcctcctttagagccaacttatttttgcaaatgggattttgtcatcggcagtgtgttaattgatagtgaacccagatttttggacagattagtcaatgcattgcattccctggcattcggttataaagatgttgaaaacatgctaataatagatatacctgtgattcatgatgtactctgtctttctttggatttgaaatccgttgatgtcaaaatcaaaaactcactggttcttctccaactttgtttaaaagaactgagtttgacactgaatgatttagcaaattcaagatacacatcacgcgtggatctagatattccgagagtaacagctcgcttgtttgatgtggaaaatgatcggaaaatgatagcagggtttgaaacatttttggtgcttacgaacttttcaagtaaacaaaacagcgacgaatttcgaagactgcaagcagagcacgttactttacacgatggacccactcatagaatgccattcataattcccaaagatttgagacatggtatttataagcacgaagaaggctctatcaagccctcattttctttaccagaacttccagtaccattgaactattcttcaatagatatagctcttagcggacttccggaaagagttcaagcttcgattcaacaagacgttgacaatatttcttttgccaattccatggaaaacaatgatgatacactaagacttacaactgattacgatgagaatgatattaatatggtcaaacgatccaacaacggacttggtgaatctaatatagtcgtgaagttttctaaggtttatgcctttagctctatgggtggatttgcttcacttatttcactatttgaagacgtcaactcctttactcttgagaatactatggataagctgacttttgatattgtcagtaatttatctgatttttcgcagccgcttgctgaaaagctctgcttcaaagtcgtcctcccagaaattcatttcaaacttggagagtttagtataccacccgatacacctatccaagatatattagagaccacacagccgctagagaatgctaagttactagatgtcagaatcgtgaactcttcagttacattttcaactgaagagagaaggcccatagtaaacgatattgcggacatactattggcggaaaaggaactccttgcagccgtacaagtcaaaagcatacatgctaaactagtgaacaccactaccaaccaagattcatatgatatgttctccattttactttctgaagtcaatttttgggcaaactcttctgaaactcgttttggagacattggatctgtcgacatcaaagatattgaagttgacctaaggcaagaagaattagctgatgttcttgcttgggcacaagaagccgacaggcatattcatgacctcagtacgaaattagaaacgctttccagcctaagagatgaagcactagcgtatttggtttatgcaacttgccaagaagaggccatttataaagtaccccacgacccctccgttattactaaaccaactcacattctccggacatcaacaagtcatatccgaggtaacatcagttggaagattgttgctaggacccgtcacgttctacatcaccttccaaaagagtggagaatacaaacgaatagggactttgtgaacaagagctggaaaagagttgacaaaaatgaggctcacaacttagtcgtcaatgcattcaataattggagaagttgggagtttgagaatatggatgaatgctattttttcaagtatgtcttgcctgagtttgacttgagtacaaacaccaacagcgatgacaaaacttttaacaaaatctttacagtctctcttggcagatttttattcaaactgggagatgacattaacgattcaaccacagcttttttcaaagtcacccaacttggcttcgagttggtgcgtaaaaaggagccactgacagataattctttactccccgttcagttagcaacagatttcttcctggacatccaatgctcgctgaaagtggcacattttagttctaagatgacaaaggatttgaaggtcgtaaaagatgcatttgacaatgtttcttttaccaagtacgaaaaagtttcgcacaagcccgttgctccggctttaccaacagtttttaattttgattttcaagctactgagattttgagtactttcactctgctgaagtcttccttagtgctatctgtttcacagactgcaggctcttgttatttgatacacgaagaggcatcttccattattccaatcacatttaatgcctccatcaagaaagcaagctcagtagtcgtttttgacactgatgctcacatgctatctggttctctcaaagataccactctcaatctatccagtataggaacactagctgagggtttgaaaaaggttgacatttatacagatctggtatcatttaaatctttgcaggaccaacaaacatggatcctggttttaacttcactcaatgaggaaatacctataattacaagttggatatctaagggaccaaaaagttctgagaacagtatgcttgcaactgataagaacccactaccatttttacccttccctttgatggtagttttcaactcccatctaataagcatagacttggaaattctttccgctttcaaagttgttactgatgttgaaaagcttgaattgggtgtggaatgtaataaggacttatcttttatcaatttggaagtttctcgttccggattgaaagttctacaacgtgaatttcaagaaagaggatacgtggagctccttcggggttcaattgatgttttctcacttgattccaaggcttcgataaataatgaaaaccaaccatcacttgacgttagtactactgttggctcgtcctacatgattattccaactttaattaaagggctcaagaactttgccaaaacctatgatctagttatagggaacataaatgcaatctcaactctaataaaatcactagttgacagcaatattgacaaagagacatcatactcgaatgaaaatgatttgcaaaagggtacctccgtttggttgcttgattttgctgctttactctccaatataagtatcatcgtcaaagagccggactccaatatcaaattaattttagacgaaataaactttcattgtgccaactatgacgatgctttacccgtgatgaagataattccattcttcggaatcgctgacctgtcatcaatcattcttcgaatggattttaagaatcctatcaataagaacttcaacattgttagtctgggcttgcaattaaaattactccattttgaagaagaagacaacttacaaaatgttcaggtcataagcacgtatactcgagtctttttgaattcgtttttgcttttaaaactggtgcatttctatgacaagttatctaatgcagtctcggagcttccacgcaagaaatgtatcgaaactaccaaaagtgctcaacctacaattgatgagacaataacgaacactttggagtcttactcaatccatgttctgttacacaacttttgcataggatggatatatggaacagagaggttccagtatccaggtatcatactggggtacgagaaagcctttgtgatatttcataaggccatgggaaaaatcagcttcttgggtttctatttgtctcttgcccatggtgctaccccttctgatttttatgcctctggaaatgaatttgagtcgccgaattgtgcctctttacctacgttcaagtttgtgtatagcatagctaaggatggacccgttcgcaatttgcatgctcaattatctggtgaactgctgaagatcaagtttgaagcggggactttctatacgatggaccatttgattgattccattaactctacaaaagagctcttgaatcagcgagacagatttaccaacatcaaaagtaaccccgaaccaggctgcggaaacaataattcagtaaaaggtatctcatttttttcctctatcaaatgtctttcgacatttgacggtgcacagatcataatctcctcaaagagctattcacaccacaacaatttgccccttcaaatggattttccagctgtcaagattcttacagattatgctaagcgcctgactactactgaaagacctcacttggtgaatgttcatgtggggatctcaggatcagacaatttgtttgacgctacgtcaacatatgtcatattggaagttttcaatgaagtaaaaagaattattaacaaaccccaatcaccaaaaactccgaaaatgtcggcagatgttgccataggacctgagtcacatctgtttaccactcttgagcctttatttgcggatattgagtttaacttttgtcttagtttaaaacctcagaaactttctctctcatgtgaacctaaggcaaaagttaagatggtgattgctctggacgaagtgacgttgtacttgaactctaatgagaatttggatcattgtgtgagtagtttgctgcaagtcaccaacatcaatgcgtatttgcagcatatttattcaagagaaaccagtggttctctgcgaatttcggagcttttattagacggtatctatgaagcgccgaagagtggtagaaagatggccgcaattggggacatttcagcaattgacttttatatcaatatgaaacagttgcaagatattgacttgttcaaagatatttggttcccccgagaagctttctctagctcaagcccgtcaaaagagaagaaaaacacttttgctagcccgaatataagcatgctgaatgcttatagacgagtatcccagacagttgcagtacaatggatttttgccctcattctccgtaaagtgacatccaaggttgatctgggtaggtcattagggctggttactttaactttggaagacttggatatattgtctcaaaggcaaatcaattgggatcaaatgttgaagatttgtttcaagagtatcaattgtagcaccgaaggaagattagggggtgttctattcgtcgataatgtcaaattcaactccagtttattctgggacgtagccgaaatgaaagaaaggcttaccgagacgccatttgtatccctttcattagacatggaagctcttcagatcaaaacatcactggattatcataactttttcattgctcagttggctttacttcgtttagaggtattcaatgagaagggagatgaattgtcgcagagttcagttgttgggagaactagtcttggatcagtggatctgtacctgactgttttggctgcctctaattttatggatatttacagtaatatccaaagaatgagacacgatatccggtttgcttacactgaggtccttaacgattcaaagctacaggccggtagtgcttcacgtatgtcttcaattgaggtgttaaacgacagaagaaagaagcatatgcaggaaaagttgattgatgctatggacttgctactgactaagctagaagtgtctttgaatagtattgtggttcatatctttccagtcagtttactggaacctgaggttctcatggtcaagttcgaccaaatcaaggcaaccttcgaccaatcttgcggtgatgcattggtgaatagcttggatcttcagttgaacggtgtgagaatttccttatccactgtacctggaggaaaggaagaggaaactgtgctagaaaccatctctatcagtgaatatattaagagaaccaaaggagcgtacggtggtaccatttttgttttcccaagcgttacggtgatgatgaagtcctggcaagacccagaaactaaagtggttgaatacatttacgaatgctacttctctggaaacgtcgacatcaagtggaaccttggaaccatcaatttcattaaagaaatgtggaccactcacgctcgtgcattgtcctccagactgaataacattggaaaactctctgaaattgaagagagcgcagatagacgtaatctctctgttcctcatacaagacagccatctattctggaaactgtggacatagaagagaaaatcaacatggttgccactgagactactttcgaatacattgccaaaaaggaacctatcatagatactccccagttgaaggatttagggatagctacccctcctttggaatggttgggtgttcacagaaaccagttccccattttgacacacagatttgtcataattggcttgcagaagatggtccatcaagtggaaattcagtatgttagactgttgaaataactaatattattattacataatcattcattttcattttttcctctcagaagttttcaatgcttcggggcttacctcatcatcgtctcctcccaagctcttaccacattcttgctccatctttcacctcagaatctaatgtcattacttgagactttgcatagaaaattggaaaagcatggcataatagcgcaatgcatcagatatcttccagtgatatcgtttctgtttgctttcattggagctggttggatcttctttttgcctgtccaaggtcaatacagggacacgtatatttcggagaatgcactgatgccctcacaagcctacaatttttacagggagagtgaatggaactttgtgcgaggatatagatcagagattgaaaagcttgccaatgcttcgcacgaagagagaacagagaagttggcggagtggttgtcccaaacaggattcaagactacagttcaagaaggttcagatgatcacctgtctaacctttatggtatcttgcatgctccaagaggtgacgatacagaggctatgctattagtggcaccatggttcacgtcgagtggagagttcaatgttggtggtgttagcttgggcattgctctggcaagattcttgcaacgactatcggtgtgggcaaaaaatataattgtcgtatttcccgaagaccaatcttcacttagatattgggtaaagggatatcatgagtcctttgatcatactggtggtagtatcgagggtgcgatagtggtcgaattcccttcctctttggattacttgaagtatgttgaagtggactacgtcggcgtaaacggtcagttacccaacctggatttaatcaattctgtggtcatgattgccagacatgagggatttgatacgacattgcatggtatgccaattaacgtttctagaggttatatttacagattgaaaactttgtggagaagcatttttcacttggctaccgctggtctacgaagggctagacaaaattctgccgaagcgtttagcggttggaacatacaagccattacaatccggggaatggagttctgtaacgaaggttcagatatcacctcatttggccgtatagtggaggccactttcagatcaatcaacaatttactcgaaaagtggcaccagtcctttttcttctatttgatgttatcaccagttcattttgtgtctatcgcaacatatttaccagcagctgtacttatggccgtgtcgtttttcttggcttcattgtcgataattttcaacaatgacgacatatcttttaagaacatagatatagcattgccaaaggtttcatttttgtttgcctcggtactagtttctgaaagtgttattggaatatctctaacctatgctagtgactgcgaactgatcttattgttgactttcattaccggcgctggtcttacgataattttgcctacagcaaagcttccacaaattgtgcttacagctaatgagcggagtatactccaggcattatctttgttcgttgtagctgtgtcgttgctgatggtgactgtggtacacttttcattggctttgctcagtggaatagcaatgataccacttacttttgttcgtctgcaaaaggagcacgcaaagcatagtccagttgtaaataatgccagcttaatagcctcgtcaccttttactaccatgctcattttgggactattaagcgatggttggacttcaaagggtttgatttggtcaccattaggagtatttcaaggattggtttctagtttcgatgcattgaactgttggacttgggcgtttgtggttatttgctggtttaccacttggagttgcactcttctagcagcaaatgctaaagttttgcccacagaacgcgagaaaacggaatgaaaagttgtttcaatgacatttcccaaacttcattttattcactgaatggaatagaggcttctaggatttcaagaagaagaatagcccaatttcgttctctgaaagtgtacaggtattgcattcctctagtcaaccaaggaaacactctagtagaatgctcacctgttttaaggctcaaactgttgtctaatatatttgcgcttcaatctaggtttcatgcgcccgatagtagattttcgaatatacagctagagtatgcgactaagcattgaaattttgatgatcacattgaccttggtagaagagaaccgaccgttcgtggtttagagaagactttttgattttctgttccgtgaaacattcaaaaactacaaagctaatgtctacaggatactcttagcacccgatcactgaaacgccaaaatcttcatggatgagacaacaggagcagtctccatcctcctctgttcccgatctgtctaacttctacacgcgattatttccctttcagtcacagcgtctacgaatttggaagttacatgaaaagggggtgcgcgctccgtcagaatttagtgtcaaattgtagtacgatctaaacgaaatcactccatcgttatctttcttatcacacacctatcaccataggatatttcgttaccaattagcatcagaatgcccgaactatccactcatactcaaaaaacgagacctctatccaatttcagcgctctagcttcacagaaaaacccatcagaaacgaagggcaaggtggtatttcaagattcagttgctgtgagtgtaattcagtccgtcctgatcgggtataccacattctaaatctgacaacaattagatgcttgcaggaagaaagctagaaacggggaggggaaaaggtaaacattttaaaggagcacactaagtacgggaccccatgaggaatatgctccaggctacaatttttgaagcagtttcgaactgactgatttagctggcattatgcgtaatctgtgtataaataaatatggaaaaaagtaataatataaaaaaaagcattctcgtaaaaacataagacatgtatgcgtgtgttagtgtgttttgggtaatcaaacgttgatgaaccgatcaaattggaggttctcatcattgtttatcaggtcatagttatcataattaacattgaaatctagaaaatcatcaatcaacgcgggctcggcgctggaagaggaggatgggacttggagagtgctgctaggtttgataccttggagaaactcaaccggctcatccgctttggttaacgaaatcagatctggatattttgaatcgacgtcataagacatggttgaaggcaagctattggaaacaaccatgttgagatccagctcatcatcgatggtagagttggaatgtgtaagagatattaacgagtttggcgtcagcgactcgtcagatgacttttgtgaacgtacatgttcatcttcaggaatgatcaactcatcttcgttgcccagggagtcctgatactcttcaagcttggaagtggtcaactggttggatgagagtccggattcggattcggaaatgaaaaatgacgacaacagctcgtctatcttgcaattatcctgctcttctttttgaaccgctaattgaatgggttttttgttggtgattgagcactctgaagtacacggtcgtttcctgccattaggagtacctttatttagtatgtcggatgggtttaaagccggttgctccattggcatctgggtcgaaacttcagattgcatcagcttcagctctgctacaagcttgataactttcagcttcaaatagtagttttcctcattgattgtgataatggcctgttttaaaggattatttttgatggcattggcaaggatgtcatggttaggttgtggtggacgacgagagcattcctgctgaggtgtattcacgcgaggagtagccgaagaggctgcagcaggaagactttccggcgctgtggttgcgactttcttcttgctggctctaggtcttggaggcaacacccatttcttgctggttgttattttgatcctgtggttctcgttagagtaattcaacgaggaggtcatgctaggattgattgtgtaaatgtgtgcatgcgtggtgttaggggtacaagctggtcaattaaagaggaaaacggatcgcaagagcagttgtggggaattatatgtgagagagtgtgtgaaaagatgatgtgaatgatggtggcctttgggttttttttttcagagagaataagtcgtatcggacaatttcggaaacggagggacgcgcggttataataagatcgcaccgaaatgggctgcctagtgcactacttttccggggaaggttcaaagggacggggtggagatgtggaatgaaagtacgcagcttttgaatgacagagtgaattctgtcagcaggttgctactctaccaagacgtggcgacgatattgtctcgctattggacaaaaccctagtatacagtacactccaccacagagcgtgatgagcttcgaccccgtcgggttgacttttttgaatcttggctacgatgaaaaaggaaatgagtgacactactatgggctaagaaaaaagaaattaatcattttttcgcaccctatgttgttcatttattgttcactcgtaagtccttcaattggatttacgtcatcctacccgagcgcattcctgttggctgaaaaaaaccacgcagcaccttccagccctctaccgatcccgattcggctagacgatgctggatggcggaaaacgaccgatggctggaaggatgtagtgaaccatccagtattggttggtgcaggtaactctttcttcactgagccgggaggtaagcggaaataaggtttgcatttgacagtaaccggttacgtgacggagctctaagagccctgagttacttaattcgattttcctaaacggtttttttttttttttttttagtccccgttggcacagacacgggcaaccaactccgcaagggtgataccgctcaggacttggtctctccaaggcctcctccccactaacctctctgactccttctacatcctcgctgtagcttccctctaattattcattctgggcgcgcactccccacgtgtggtatatgtctcacacaacgttcccctattctccctttatgtactaatcttttcagtctttccgacccagtgatctaccttctccgtctgataatcatctatgaagtttggtaaatacttggcaacaagatccttggagttgccggagtactcagggcattttatcaactacaaagctctgaagaagctcataaaccaactagcgatacaggatgattctctgtccctgcaggataagaagggttcattttttttcaaagtcgaaagggagctggagaaagttaatgagttctacctggaaaagcaaagtgaattgcgcatcaagttggatattttgatgatgaaaaagaataagcttttcaaccagtcctctgttgagaagagctccatagacttcatcagcctttacgagtcgttgaagaaattttcctctgatttggaccggttgcaacagtttgttgaattgaacgaagcgggatttactaaggtgttgaaaaaatgggacaagagatcaaaatctactacgaaagaactgtacctctctatcgctgtcaatgttcaacctgtctttcaccgaaatgagatcattgagctgagcgatttggtggcgacaaacctattagaattagaagcacaggctgatggagatgttattatacgttatgagaaacaggccaccaaggcaataccttcttccaaatcggaccgcttgtttgaccagctcattttcatgataaagacagtcgaccctagtgtcatcttggaaaaacttaccaaactttttcaatcttttcttgacgaaaacaattctgacaacatttcattcaaattatcaaatcttctctatttattaactttaaacgagaacgtctcaaatgagattatccttcatttcattaacttcttctctaacctcaacttttccatggttgacgatttgacaggaaggaatttcttgcatcaactggtgatttccaaggttgatagatatccagtattagaccagattgttagaaacccagactttgatccatctactctacctgtgatcaaagattttaacggacgaacacctttacattatgtggctgaagctggaaacttgaatacgcttcaacttcttctccaatatactaatataaaacttgtcatcgacgcgttggatggtaactccatgtgtgctttgctattggccgttataaacaggcacattgatattttacagctactgcttgctaacggaagcaacccttttccgactcagagcgaagtgcaaccggtttacttgcccttgaacattgcatgccaattaggcgacgaggagatagtcaaaatcctattaagctctacaaagcactcggagaatcaactgaataatttctttcagtgcaacgcagaaggcctcttacctttgcatattgtggccagtttggggaaccacaatttaatcactctcttattagatcatggggctgatgtcaaccaacttgataaactcaacaaatggacccccatgttttatgcggtaattcagggaaatccccaaacagttgaactgttaattgcaaacggtgctgatttcaagcttcgagatgacgacaatttagatcccctttattatgcagtcctagaaggtaatgtttacgtgatgaacgttttattaaaatacttgaaagacgaaccagataagaaattgacaccttcgaaatctcaaggtcctgagaagccacacctaactcccagtgttctttccatttcttcagtgcccagctcagtcacagatctaattcctgatttgtctctaccgccgcctattatacccctccgaaaatatggtcacaatttcttggaaaaaaagatttttttgaagttcaactttttcacagctagagactcactcaagattaaccctgacacctttctaacatccgttccaggaaggctaacagtaagtttcaacaaggatgaccttattcctaggaacttgattttacccatctcgagtaaagagaacacaattgccttacaagtggattcccttgacgatataatgattgactttgaactttacccaacattcggaaccagactaatagctaagtcgaccttgtctgcttcgttactgttatctcgttataacaaggaaacagatgtttatatctccttgccgttattcgacgtaagactaagaaatattggccaactgcagtttagctaccaagttatttttccatacagtggtaaaccgttggaaatctcaatttacgaaacgtattggaagtccactaataaccaaagttcgcaacaactggtaaaatcaacatacttttcgtttgtcacagcttcatcattatctggtcaatattatagggtcaaagtgtttttgtcgcatgacggaattcctttggttgcccctgagtggtatttggaactggccccaaatctccgtgtgccaataagcaactttacttatagtcaactaaaggtgatgctgctacataatcatgatataccagagcggactgcaaatgtgaaagatttcaagcaattggaaattttattggatcagctcaaatgtattcctctgcaagtgctgctagagaatctccctatcaacttatccatcgatttagagatcttctatcccacactatatgagttgacttttgccgatcttcctctcgcccgattgaacgttaaagggaatgaactgattttgaagaccaatgaaatcaactattacactgacacaatattgactactgtttttgatcacgttagaagctctcgtcaaactattcagcatgatcagaaaactagatcgatgatattttcttcgagtaaccccagcatttgcactattttgaattggaagcaacccaattatccggtccttttcaacatgagtggtgtggtgtttgacgatgaggaaaaaacattcaaatacgttagtgctaacgggtttccaatcttggaagactttgaacgcactctgactaaagatagatctaatatcaagttggacaatattgacagtatcaacaagaaggagtctaactcttataccgacgagcttgtcaatcagcactgcatctcaaagtccattaaacaggccgtctttttcgctacttctaacaatttgctgggtataatagtttcaaatcaattgttgaaggtgtgtcctcgtcttattgaagatatacgatctcgtggattaattttggtggcatctgagaacaataagacgccgtacgatataatcgatgatgtcaacgggttacgattgaatgatattctaaccttccaagatgacatagatatgtgatgagggttaataattgttagtatataattgtttatagagtctcatagaacaaattactggaggcttagatagaactgttcatagttaatgcccttagcattcagatgttgtagaacaggagcttcgattggcgaatggtactttgacaactactctctatttgtcttgcataacggttatgccatatattgtttcaagcaaacaactacactggttgtctttggcgacaacattattaaaacttcttatgactctatttacaaatactctgtctagtttacttcttgtcttcgggagattctggggtgtagtcgtagtaccatggtacgttgggtgggtagttcgtaggaactcgcaattccaaactgaatctcttggaaacttctctcttattggcagcttcgaacagctcgggactaactttggaaaggtcctcacatgcaagtttcatggattcatactgttgctttagtttttcgttttcggccttcttccttttacgagtaatcagtttgtaggcttcttgcaccgtgttatgcttgacaaaatcttcaggacaaagcttcaacatttttggttgttttctagaagctgaaagaacagacaattgggtaatgagtttctgggctgctggtgataaatcatattttttcgttctcttccctctgacaaactggataaacggagtgggagtttgtcttgtcgcaccaacaagtccccttgaaagactctgaggcagagcagaactgtaagttttgaacataggtgctggataaattgtccaagtgaaaagttgactacattttatggatcagttcgcgggtagacagagagcttgaaaggcaagaggtgaaaggtaagttaagaaaggagaagacatcatacgtttcaaggtggggtctagggtatagagccgaaccaaattccttgattagacgagtgagtgttgagtcaatagatgtgttgttccagatcaggctcagcatgtcttatgcattcaccccgctacgagtaaacaaaaaccccaactggcagttcccaaaagttgtactctaaaggctaccaagaaaacactatctgactatgtgtgtagtctctgctaataacgactctacaagataaccagcctttggttggccatgttgcttcatcatcgcatcgccccttgagtgttcgcgactacaagtttgtagtgagcttaagaatacttgcggaccccatatcttttgatcataatggactctaacaatccttttgcccaagatgtgcaagaggagctttcaggaaacgcacctcaacagaatagaccgcaagggcctactgacatcataacaattttggaaaattctactatcaattccaactctagcctcaactccaactccaattcccattccagtttaccgcctacaacaactcatactggatcttcagtacctcagatagcaatttcaccagtctctgctacaaacacagccaataatggtgatattcagcaagagctaacacccccattgccaccaagaacgcccccactaacggctgcaagaccagctgtaccaattccaagtccccgacctatagaagccctgcagtcgacgcatttagatttaccagagtctaacgacctgaggcctccatctccagcgtacactcccgtagcgtctcctcaggaagtgacaggaaatgaacttgtccctgagcttgatttggaacacccaaacgaacccccacctccatacactgaagctgatccaggattacgtcatgaaattttcactgtccctttttcagctactggtggagatcaggatactcctccattgcccgaaagaagatacaatcggccgtccagccagcccccatcagacaatgtccctcccgttccaaacagaccaaactatcaaagaccagctgcacctcctcccaatgtacgaccgcaagctccacctcctacaaactggcaaaggcctcaaagtgttccacaaggctacccccctcaaggtttccagccacaagcccctgtctcaccacatgaattcccccctcctccagtaaggcaccctggtgcaagagtgacttccagtgcttaccctggcgctgctaacgttacctactctgggtattcaagacgatagaaaattttatgctacgaatctatacgttgataattatttaaggaaattgaaggtgacatggatctaatagcagagacatcaggcgaaagcaattctgatttacctccttgcggcgtatctgcatccacgccaacgtcataattctcccttgatgaattgtttggttttcgaaataaattggtgaaggtatcgaagactccccattttctttccgtatgcacagtgttttcaggcgtgctaggcctagagattgtagagaccggctctgtttttgataactcatgcttagctgccaaataacgttttctttctagttgtagtctttggtttctaagttgcttgcccttattgctatatctttgcttgagcttctgctggactgacaattcaacaaccttcggagactcttttatcattggttctgagaccttatttgaccaattgaacggatttgtactgcgttttaaatcatcattagtctcacttttcttgtgtgccacccctctgtcagagctatcccattgagagcttatgtcaattagtctgtgctgaatttgtgacttggagagataatctcttgagtgaaaattggcctctggttcggctttatctttatacaaccttcttggtgaaatgatctttgaataagccggctcaattagtagttccgtgtcctcaacactctgctggggaggatcagtggagtacggaagtattttaaggactatagcattggcatcttggttcatcgtacgcacaaactacgaatactggttatacaacatggatatgagatggataagagaaaaatgaagggcgaaggaatcgagtgtgcgaggaaaatcctccagaaacagttcctagggggaacaaccggccagcatcaaggttcgcgttagttaagccctcccaattgtagccataaatagatgatatttggcacatctctttttctgtaacattgaatatggggccgctgccagatcatatcattgagctgtgcaagaattgcaaggctaagaaccaaaaggaccaagagctgatcaactgggctaatgagacgcttcgaggagtgccaaaaggaaacgaggagtgggagagaggtatcagtggtatgttgtatgattctgccgagcctgatctgctcttcaagaggtttttagccaatgacaaaactgtagagtacggtgaaatcaaggccaaagaccacaaggatgcccaatcatacaatgatgctcgttcgaaatttatgagagatgttgttggccaccttgggtctaactcttgttttgagtacccatttttctttgattatggattcaacacctacattggggacaatttctttgccaacttcaatttgactatcttggattgtagtattgttaagattggaaacggcgtcatgtgtggtccgaatgtttccatcattactgctacacatccattagacccgacccttagaaaatcgctcgtcgaatacgcactccctattacaattgaggacaacgtatggcttagcagtaactgcgtggtactgcctggtgtcaccgttggaaaagggagtattgttgcagctggggcagttgtgtcaaaagatgttcctccgtacactgttgttgctggagtccctgccaaagttgtcaagagtcttgaaaaggagcaggatggagcagagctggaggatatactcgcttttactagatagacgacatagacatttattttaagctagcattaagtcaatgagtaggagagcgatgaggcgatgagatgaaggttttttttttcttagtacctcactacgtcaacctccccatagaatgacaacactagttctaccacagtttccagaaacaaaaattttgatagcccaataccagaatgtcaagaacgctaggacaataagagaggaactgataaagggaaatttgcagtttaattatgccttcataaatgctgaaactgtcgcctcagagacgcatctaaacagtgccatctataggacactgatcaaccacaaaaacaagactatgaaggcaaaaaccttacattctgagttgatattcaacctttccccgtttaaaaacataatggatgccttcaagaagtttggtattgctgatgagtgtagtaacatcatcgttgtgcgtatttctggcgatggggaaacagaaccagagatcggcaatcttgattccgtggttgaaggagaaagaaccgaagaaccgattggactccactgtagtacagcactggtcaagaaaatctttaagctgaatggtttgcgggacgatttggacttgtctacgttgatcagtgggtcaatccaattaaggtagattgaggggttgaagagattttggtaacccttcagatagactgtactatatgatacaaaatcacactaatattagtcttatatagagctcaaagtcaattttggtgtcctcttcttgcactagacaattcgatatctggttattcctttcgaggcctggtagttggtcttctgatattaccattccgactgtcccggactatccatgagaccaaatttgtcatggattatcccaatattggttttactagggcttgggtaccttgaatacatttatgcgtatcggttctgctacattggacttattagaagccgctcacaaactgctgttgctattgtcttcattgtgatattcaacatcctctattgcctgattctgtttacatggttcctattggtatgcttgggacctgggagtttgaaagcgattcctctgtacaacctgggggaaggctctaaagaaggtttcttgcggcccccagattttttcatctgtaatggcaatggattacccgagtattgctcaacttgtcacactgttaaatacgatagaagccaccacagcagtaagatggaacgctgtgtgccagtatttgaccattattgcttatgggtgggtgtagtcattgggaaaaacaactacaaaaacttcatgcttttcatgacttacctcttcattatgttcatttacgttcttataacatttaccatttacgccccatctttgcgaacctatagaaccgccacgggacagactgttctcaatccaaatttcattgttatgtacatttgtactgcattttggattgtcatgttattaggcctactcatatcccacctaaacctgattgcttccaacagggccactatagatgacctgaaaaatagacgaccacaaagagagcgtcttcctaacaatgacttatggtcagcactctgcaataagcaaccaactcaagctgtcattggtggtcaagttgcgggttacgttagtgttaaacatcccacgctgcggggtgctagagtagtctttccatactatcacagtgacaaaatttacgatcatggatggaaggaaaatatgaaagccattttcgggaacaaatactaccagtgggtgctaccccaaattcattcatacaggccccaagatcaagacactagtcggataattgaatcagaagacagattgatctgctgtcgattcaaggaaaagctcatcaaacgtatccacaacgacgagggtgacctatttgtaattgaatagctatgactaatgaataataatgaattttttaaacatttctattcctcggaatagtaatccttttcaagatttcgaatatgtatctactaatgccctttcgacgttcaatgtgtcctccctgtaagcaattctaatgtcaggaacattggtcttttcaatatcgttacctccaacaccattctcggtgaaattttttcctagccaatgtcttttaagctggtattcgaatccagacatcaaaacagaatttcttgccagttcacacatatccacattcgataatttgtagatttgagctgccacagagtactcctcaatcagtggttccctggtgtatgagaattgcaagggatcatctgtagatagagtcacattcaaacctcgtttgaagtatgtgtagaatgggttcttatcgtagtttaaaaatagagcattatttgacagtggagacatggccaatggaatttgagttaagtagaacaaatattggacaaacggtacctttctcaacatgatcccatgagaaataccctccgaagttaagaatgtgctgataagatgctctggatccccagcttcaccacagtgtggtcgcagcacaaaagtactaaatcctcttttgtttctccaatgatttagacaagcagtatttgcatatagataatacaggtagtaagaatacggaggattattcggcgtattccagtatcttggagtggggtactttttgtgaaatcttctatccgccttggattcgtcatcgacagaatcaaaaccaatcactcgttccaagaacacatgcaatttaggatgagtttgagggttcttcgtgacttcaaataatggatagaacaagttgtgtgttatatcttggaaagttgtgatagcattgcttttcttgtagatatcgtacaatcttggaacttgaattaaccatctaacattgtgactgatgagcttattatcaattacccatgcagctaatttgtcccattcgtcaattgatctaccataaatactaattcgatattccatcatttgatacttagaatcttcaacgtcatcaaacacttccctggttatgtccgccaagtattttcctttgatataattatcagtcttgagaaatatctcacgtagacgagattctccaatcgggttgtactttaaattgaacttatcaaatctgtggaaggtatccttatgagcatgcatatctagggtatcaattgataggtcgtaggcggtcaaattcaaagactgaaatacttcctctaatgtaagaactcttccatctctgtagatgaccttctcttttggatggtgtctaatcttgtgtttgatgaatcgaagcaagtgcttttgattcatacatgcagaatgatgaacgtgagtgtcaacctttctaacgttataaaaatctctatgtggattctttttagattctgcagtttcttggtattcgttcaaaagcgaatacaaattccatttggcttccaaatattgcaaacgcttgaatgcaaatgatttcgccggcccatctgatgccatggcagttatagcatccaagtccatataatattcctttatagttggaatattggaaagtttttctccactgattgaatcgactatctggaaaacatcctcactgtccaagacaaagtcaacataagtatcttcccctgggatagtacactcctcaaacttgaattttagggcatcattcagatcatcttcagaggcacatttcttgaatgttttaggatcagattgctgtgtggtccatttaggtcctggaggtggagggtatattttccaagaagggtgattcttggggttatcagaaaagttctggagcgacgaatcctggtacttttttcttagttccacacaagtcttgatattgcgataaatttgaatgagctcttccgaaggtgcctcatctgtagcgttatgatcatcttctaaaatgcgccctaatttaaaatgcggtttgttcaaggcaattttcctcattccatcagtaactgcagatggcgaaagagagttagtggtcgggtcatagctatacttggattctgttggactttgtccgccctcctgaagtggtgcaaaaggtggaggagggatcacaaattcggcaacactgctccttctatgtctgtcgttgatacccgcagtatccttttcaactttggaagaattgcctaatgattgcaaagctctcaatttgtggtcatgttcctgcatcatcttttcctccagatatgaaaaatgggctgtggaggacgccatgctttcattatcattatcgattggtggcgatgactctttttcacctaaatcttgatcaatctcgtcatcgcttatatataggggcttgttgcttccctcataggacaacccacccgaattaggcgagaagctatcgtggttactagttgttcttttgggcgacgagtgcatcttgtattttgaaggtgcaacagtgacttgttagggtcaagagattaagagatgagatcgggattacgatcgaggttgccttaccaaggaacgacagatcccgatgagcttagcttagctctcgttcgcgacttgcgatttctccatactggtaaattggtaaataaacaacacatcgtctcaattgttttctttccaccctttgcaagtcactgagctgaattagaaatcttgtaagatcatggaggacaagaagtatctaactccaggtaagttgaagttgtgagatccatcgtgtctttattttttttatgcgttgatgtagtgggcatcgaggcaaatagtttgtgcatactaacaatcagatttcgatccatcgactctcaaagtagcacagctgaggaggatccttgtggaacatgacatcaagtttccagcatcggcaaaaaagcagactctgttaaacttgtttggtgagaaaattaaacctaaggcttcaacattgttggcgaaatataacgaagcaaatgttcccaacggaaacgacatccttgatgcatcgagtaaaaaatccattataggcaattcctctgatgatgaaccagaacctgcctccaagaaccagaaaaagacgaaaaaggttacaaaaccaaagaaaaaaaccaaatccaaaaagcaatccagtactgtgccacagaaagaagaacacttagtttccccacatctgaaagccaaggcccttgatgttaccgatgattctattaagttgaccccccctgaggataaacttgatagaaagattccccgaaaacatcgagaaaaggtggcagaggaagtcaagtctcccaaattggatttgaaactcaaaccagcgttagatcacgatttagaagaggagttgttggacgaaaaatgcaatcaaattattccttctaaagacgaggatgaaaagataaagctggaaagagtgaaggagaatatcgaaacgactttctctaatagaaacgtatttcaaaaggaacactcttcaataccgcacaaaagaagcagagatctagaggaatattcatcgcccaacagaaaacaaataaaacaagataagtcatccaaggatattttcaaaggtgaagactctttcaactccactgaagacatagactttgacaaacttttgagctcgcctactaaaggtaaagtcactagaacgaaggatacgcctaaatcgatcgccattactcctcaagtttctaggagacacagaaaaactccaagatccactaaacaactgtcaaacactccgacgacacattcagatcagtctttctcatccagcacccctatcgaagagcatgtacctaggggtccaaccgaacaaattgatttgaagaaggagaaagaagacatcaccaaaagttctcgtaaaactccgaaagtgactaaaagattaaagcaagaaagtgtcgaacctgataaaaacaacgacagcacactcttggaaacgttgaagaatgaagtggaagaggaagagaaccaaattaagaaagatgccgatgaattattggttgatatcgaaaatgcatcttccaatgtttccttcaagacagttttgaaatacttcctaacttggttttttgcatctttagtttttgttgctttccttctatggagagagcaaagaatatactctggatactgtggatcatctatccacaaaaaagtttttgacattgactacgatataattcctgagcaattgctacctctaatggagtatgtcgaggagacatcatcacagttggttcctgaatgtgtcccatgtcctgaacatgccgaatgttttcctttgttcaaagctagatgtgatgtagattttgtttcaacacatccttggtactccatttttgggtttgttcctactccagtcacttgcgttccagatcatagaaaaactgagaatattcacagagttactaactatttactgtttctgcttcgtaacagaaatgccgaaattgactgtggtaggggtttagacgaagatgccggcttgtctcttgaggagctgcacgatcttgttttagaaatcaagcctgattatgtcagccctgaagaatttgaatattactggagcaaagcgttggtggacttggaatctgaacctgaaataattgtaaggcaagtttatttattgaaagataaccaggcttcacagcttctttatctctaatttttttttcacattctagtgtcagaatgtactaacatattttagctatcaacatcaaacgatatcaatagaaaacaagatattgaagacacataccaggaaatcgataaaagctcaaaccaaacgattattcgctccacgtctctcacaaaccttagtttccagtgccaaatagatcgttacattaccagtattttgataaagtaccggccatttgctcttgcctttataggtcttttgatatttatacgggcctcaatttttatctatcggagaaatgctaactacaaggaacggatcactggattggtttcagaagtatttcaaaggcttcaaagaagagcaggaagtgccaagaaagattcatcaggtttgacaagaccttatattggttcgcatcagctacgggatttacttcttgactctgaaatgcgcttttctgagaaaaacaagatatggaaagatgtttcgaagaaggtcgagagaaacagcaacatacgcagcagagtcatcgaggtatttggcgaagtaatgaaagtttgggaatggatatcggatgtagacaattaaataatgctaacttatatacaatatttggggttcagtttcaaaactgttcacgggacctttcagtatccaattttcttctggaaaagttaaaagtagaacgacacaatggacatgtcgaagttcccgaacttttgaaccacttgtagagacacccactatggaatttgttgttgcaggtatggcaactttgagatggcaaagatgaatctagatgaagaatggagtaacagacagcacactcttcgaacccagaaaaatgatagttgacattcttgttgaatagctcaagagcttctattattgtgccgttggaggatgaaatgactctctggcaggagtttaaccaagcacgccattgttgttccttgactccaatacgatgaagaccctcgaccataacattggttaaaggataggtgtcaggaagtcgaatagtcatttccatagtttgttcatcaatagtatattgagacttaacatcgtgttgttgcctattggtcttgactttgagattttcgtccttggtgaggatctctgaacttttcagccttctatcaactgcatcgagctcactgttaatcaatataggtgagattagggttttggttacttcttcaattgttgatttgagttgacgattctttatatccatgaaccaatgcttacatgaagaacctagtaattccagagcagtatagtaaaggtaaacagtgaatgttttgaattgcacatccattggtaaatcggaagaaagcttctcaaatatcattggtctgttcacttgagtgttagatttaaggtgttggtagaagcttttatcatgctcaaaatcaatctgccaaaacacaaacgaaagaaatccagaaagaaagtcttcaatttgaccaagatagctcttcctgatgtcataggtaacgtttctaaaatgcaataagaccaaataccacccaaataagtatctggcaacaacttccggagattcaaactcaatatactcttcaaagggagtagttatcaactggataagcaatggaggaagttctggttttaatttctgggtatcttcatcagctttgacagacattttctgaagctccatttcaattacaaaattctgatgattgtttaagagaactttgtaaaggacttgagtagtcacttttagcattaaaagtgagaacgatgtttccaactgttcataaaaaaagtcaatttcttcgttcaatgaggagtctggaactatatcaattaacacttgctcagtaaaatttagtaccaattcagtgcacaagttctcaactttaaaatcaaacactttaacaacagccaagaattcagtaataatggtttctttttctgacatccaaatgtcactgttaacttgtgaggacttctgtagtagaattaaggatctgaaagtgaagtaggccagtgctatgctcatgcctttggtcagttctgtggcagtagctgattccaactccatcgaaaccacacccagtgagtctctcaccaagttcgacaaaacttcatacgtaggcgccaaaccatctgaattgattaacttttttgaaatacaattgtgcaagtaaatcagcatctgaattcgcataggaataaatccctgatcatatgctatatcacactccaacagttttgaaaaagactgaagaaccatcattgatcggttagcttcgattatttcaacagtgtttgaaatagtttcttcctcaagaagagtgaaattgttcaaaagagttaaatgtggtaagccactactcaaaatttctttcgaattttgaatccccaccaaataggatgcaatttgatttctgaatctatccaactccgttgaaaataaaacttcctgtggaagagatattaaaacaattgacagaatcggcagtcctctcttatagagatcattcaaaaaactgagagtaaacattgcaggcttggagtattgcagtttgttgctcagaattctagtagcaattctggcaacaaatatatttttctccgcttccttcagcaagctactcaagacagattctgtattagcatctgatatcacgtttaatacatcctctgtagtcaaatctttagttaaccctagtatatagttaacgctgttgctgtgtaagtcaactaaataagcttcaggatctggagacaaaaatgtgtgatcaactacagcctcggttagtacagctagaactttaatgtgcactttctctgcaacgagcttgttctttaagaggaaaagaatgtaagaaataactgcactaatggaatatatgctcctcaaactctcaccattgtgaacatcatctatcttgaacagtgccacattatgctgtaatggattcgataaaatcgtctggtacgagccaaatttgacaccattagccaagttggttatcagtctcttatctggaagggcaagcatttcaggaccgttttccgcttttaaaatgtgagctaatatttcaggaacattcttggaatcttcaaaagaagcctgcaagaggaaagaaagtaaggattgcttaaattcaacgatgaagttgggatcagtattgttattgatttcaatgaggttcagcaaatcttttgaagatgagaatcgtttccacaaattgaccaaaaactgaggctcctccagaacaaatttcagaaatagatcgttttggtactgggaacaacaattggctatgaagccttcccaatgtttgctagaatctaatgcctgattatacaaattctttaaaacatctttggtcaaaagtttgaaaatgactgcagaatcattttcggtgaacgattgtccagatttcttcaaagtgaatgaaaccaaattagggcattttgcaatatcaaagtgtttaatttgtggtatttttttcagaaagtaagaaataagtaagttatcatttacatcctctagcttcacaaagaagtcattgataacttcgtgaagtactctgtcatcaaaaagctgactctcgctgtatagtgtcaatgtttttaagggctctttaacaaagctaacgtctaaaaacgctaataaaccgaaaaggaaaccttcaacttcgttcgaatactcagtgaaattatgagaaattatgccttcgactagaaccaatgagttcgtgggtttctcttctagatcaagttcttcgtcctcaagagagtttaaagcgttggagcagagcattcttaaacactcagacagagaatcaggttctgatgcaaggacgttgaagtagttgttcaaaaaaagctcggcattaagtggctcttcaccaaaaattatcttctttcccaccaacgaatctaacaccaaatcattaatggtcaataggagctcatctgagggcagtgcgacaaaaaagtgtgaagtctttttaactattgcagaatcaagttttgatttgtttagcaagctaacaataaatggggtgacctttttgatgatgagttcctccgggactttaaacttaagaatgatgtccaagaatatgatccatcccacaacgattgagttgctctgcctttccttcgaaatgcttcggtagataatatcagttatagttgtgaaaaacgcatcgttctctaggctaataaacgaatcatcagatgatgtaataatttcagacaacaaacggtaataaattggatcacagttgcatgagccaagtgatacaaagtcaatgaagtaatcctgggagttcttactaagcgtccaaaagttattcgactgaacaaccaaacgatgaagagcattcaaagttggtaatacaatcgtggagttgagcaaagcttgcttcttgtttatctttctacaagacttaaacaccgctttagtcaatggtttgagtaggttttcagagtatgacaacaataatgggacagtctgcaacgtatgtcttctaatattcaaatccttgctggaaaaattgtcccacagaggcgaatgcgaatcagtaatcttgtcaattaactcgaccgattcttcagaatgattgggaagttgcagagcccgctgaaacatttgcgtggatgaagtgacagctctgttaaactttaataatgcctcgtccttggatacttgttgctcattagaaagagaattctgagtctcagagttcagtaactgattgacaaaatttagcagtggaacttgaaaaatcgtgaacagggattcaaatttctcttcgttaaagcatgacagaaactctgttctaacttgcgatgagacaactctttctgtgtcatatgtgcctataatccaagcaccaatggtatcggggaggaatctagaatatttcttacctaaggtatgcactatctttgtttgcagttgatgagccaacaacctcacatttctggacaaatcaatagatagtttcggataaatttggacccaggcaactgcagccgtatagtcctcaaatatcctaacatcagaggagttcaggatctctcttaatgccttttctttggtggtgtcgtccttctttaatagtgaccgaaaattctttttcaaatttggatccgacaacgtattgatatctggaataccagtgaagtagtttagagagacttcaaacccattagtacccagagtggcagctgagttgaaaggattcatggcttatagactaatagtatggaggaagataatcagaacggcgcgcgcaatggcaagcaagcgatggtgtttaggtggactggaagtgaaatatttccaggtggtaagcatcatcaggtgttattaccgacggtgtgcggacagcggtcctctggcatgcctataaaacaacctatgggcatctatctacagtggctaaagcttgagtttttagttatttattcttgttccattatcgtctcttgtcttgaactttcatgtagtactgactttaacagccgtctgacaaccgaaacagagtgtcaaaaggcacaaagtaaacatgaattactgctccgtactctttcaaaattcatcgtcgtaatcatcatcctgctcacgatctgccccatcgttttctataaagttatcaccgttgacatctgcattctcttcagcgacggcttcacaagcatcgatccaatcgctgtatatatcaatgggttgcgaaagtgagtttattggagcctggaaggacaaattgcatttcttacattccaaaaggcctatgctgtttttcttatccaaggtgcataccacagagttgtcgtggttacagaacagacatgtgaattgagtttccagcttctgcttgatctttggagctggttttctggctgatgactttctctttcccattttgaggtgatgttcacgggagttgagttggtgaatacgccaggaaagctgtgttttccgtatctgatcagatattgatcgcgacagcttaccaatcgtacaacagagctttgggtgaaaaataaaatgctatgaaggacagacccatgactatctctgctaactcaattaactaaacggatagaataatttcataccccaattttacttcagttgtggtctcttgccgttgtcgccttgtttcaatcatctgcgtaactaatggcttctctattacatagccaatgtagcatcgattttagcgaaaatgaaaaaaaaaaacttatagtgggaaaaaaaattcagaaatactaagatcagagaacctaccatattcacttctatcaacatgcctcctagaaagagaataaccagaagctccgctaagagtaccagctccccagttggaacaccatctaaggcttctcctgcaaagaagggttccaagaagtctgctgtggctaaaaagaatgaagtgtcaactgaagagacttccattgagcaagaagattctaaggacgattctctcagtgttgtggaaaatttggctgaaggacaaaaagagttcattaagccagccgttattgagaaggctgttaacgagttgcttgccttcttgaaaaagcaagacgaagagaaatcgaccaagaaatccagtctgtttgaggaagatgctgttccatttaccttgaagtttacctctgttaaatatttcaccgataaggtaaacctaaagccaaagctgatcagtttgcctcatcccctgcatcgtgatgaagaagagtttaaattttgtgttttcgtcaatgataaacttataggagaaaaagaactctcccaaattgagaacgatgagtatctgaccaaatatgtcggaagaattgtacgtggagaagagctgaagggggaatttcgtccttacgacgccagagagcaattgagagaaagttacgattgttttgtctccgacgatgctctggtcactacgttaccaaaactgttgggaaaaactttctacgattcctcagttattcacctccctgtccccattaagctgagggtttttaagggaaaagacttttctcttgacgtgctgaaacagtctctcgagagagttagaacttccacttattacagagttccattcgggaccgaattggaaattaggatcggcgacagtaaaatgaacccatctgacttgctagagaacatcaccactgtcgtaaacaaagtgttaagccaagagcaaacgatcattgacgttgacctaaaatcttacgacaaatcttcagctgttctgcccatctataccagtgatgatttttacaccgaggacgatgtcgcagaagtagcactaccacctattagacctgtcgacgtcatttcaaaggaagacccattagctgcattcaaggacgctctggttgaaattgctgttgacgaagacgaggccaagaagctcatctcagaagtattagttgactctgagaaacccaaaaagagaaatcatagacataatcacaccgacgctcaggaaccagtctccgaaagtctttcaaacaagaaaagaaaggaggaataattgtatactactgatagatatcatttggagtaaaaataaaaagtcccagggacgtatttagtttaggtaatcaatccatgcgccttgcgcggaaagttatccgataagcaagtttagcataatcctgtatgcaagaagttccaactaacaccataatcctgaccggatttgagccaggtcagttgcaagatgacgagctgattgtgtcacatttgaaaaaccttgtgaaaaaggtaaccccacctttcgaaacaatcaagatcataaaattgccaaaatttcaaagggtctttttaatatttgaagaaatcagctcttcgatcgcagcatacgactatttaacctctgagttgaattccttgacagtgggatacagtataagaagcaattttatttcaactcaggaatttttgcaacttcctgaccaaggaacccgatttgtcatatctccaccttcttcgcctcctccagagtgggatcactacgataaagtagagggtggtccagatatgagggaaattcattcgccagacgaattgagaggccttttgtttaagaagttaggtgatagaattacacattacgatggagaagagttcgaaacgaatgacggtgttagcaaaagaaagaagtttgaggcatctcaagaatggcttattgaacagatgaatcaggaaataacagaacagcataaaaatctcccatttattattgtcgacaaagctgacgataataccaacatagaggaagaatgctcgcttgctggagtcaagacaagactccccggtacctgaattctataatgcatatatacgatatctttcaatcagcgtcattttgctcatccgcaatcttactcaaaatgtcatcataagctttgctaattgtttcaatctctaaatcttcctcggaagctgcccctgctgcttcccctgggctcatctttcctatgactttgttcaactcaaggttcttcttcgactcctcagagtaattatcttctaactccgagggtccatgttgatgatctccttgtagctttgtcttgagtgtctccatcaaagttttgtcatcacctttacaaggtgatttcccaaaaatggattcaacctgaattcccttctctttaaaagtattcaaaatttcggacaacttctgggcatcacctgtaagaagcaatttacggatgctgtcaccatcaatatctttaagcttctccaaaacttttggagtctttaaatgacactgtaccaaagctctgttcttagccacattgctctcttcttgcaactgttgcttcatctttgaagaaaactcgttattagcaacagaattatccttaatcaaagtagcaccgccattatcttcaaatggcaccaatgcttcatcagcgtctgtattttctgttagtttggagacaattaaattactcacatctgatacgctgtacttggctttgctggaaagaagttttattcccttatcaagagaagaatccaaaatgcaaagcctgattagggtctctttaccttccagattaagtctgttattcacttgtagcttgaataatgcttgcatagtttcatgaagtatatttttggcttccttggcttcgtcgaataaagctttcaactcctcagcagaagcattggaattatcgttagaaagaaacttggacattttctcggtccaagtttctcttgtatcatcttcggtaatcccagttttatcggtggtatacagtattttttccatgtttctcatagtgtaaagacctatttgctccttatactttggagacatgccttcaaaagaacagttcaaggtaaacaaactttcagagttcttagctgcattggtcaaagcaatcgttgcagcttcgtccaaagtattgccaactatcgaaaaagaacacaacttcctacaaagtctgactgactcagcaaaagtgatgatcgcagcagtagacaggtcattgttatctaaacacaagcgactcaactcgggaaagagaggcaaataacttgcaatgaagcttgtcatcttgggaaacattttcttattgttggacaaatccaaaaacttgagagttggcaattttgaaagtgaaacaaccaattcttttacatcttgattatcttgaagattacagcaattgagagacagcaacctcaattgggattgatgttcacttttcttggatgcgtccgtaaataccttgatagaggtcgataaatcattgtaacccagatcaaggcctaaaagttcaggatagtcaatcatcatctgagcaagaacctcacattgttgagttgagagctcattgtatgccaaaccgattttccaggttttatgcgataatgccattgaaattaaattttcaaaaacgacaaaatcattaattttacaacctgtaagtaccagctcccgcatacctccacggaaaatcaacgatgctatgaaaagaggccaatccatgtcagatctattttgggtattagactccatgaccttttgggtcgtagttgaagtctccggtttcttgggtgctgaactggtcgaggtgcgcctcttctgagaacctacttgtaacattggacattgtgtgatatcaagtctctctaccctggaattcatggttaagaaccaacaaagaagtttccagccttcgttatcgatgcacatatttcgaagagagagttttcgtaaatgtttcttgttcactaaagaggccaaaatcgttctaaacatctccaaagttagagaagcaccgtctaatgaaacggaaaccacaggtgcgatacgaataaaatcggaaaaagataggacttcaatcaaggaaggctttggatttcttagctgaagaattggtaatggatctgtacttccttttggaatctgcttcaatgtgctaggaattggtaaaatttctctaaggtggcaacatcttgtatagagttcatctagcttcagcgtaactaacggtttatccatctcaatgacgtgtggtcttcttctaaccattggtttatcaatggtaaccttagaaccatcaacttctacatccttatgtgaacttttgttctctgattctggttcatgttttgactttgcggacccgccaacgacaattcctccaccatgttttaacaaatcttctggattgatcttattaattattatctcaccggtcttgcttattacaacatttccctttctcgggttcctagatggaatctgttgagggggatcattgacgaacatggtggctgcaaatgcaactttcttgagaggggcaatctcattcaggactggaattcctggtttcttaaccaccctagggggcggctttgtataagttaatggagggtgctcaaaatgagataaggactgcggtgaagactctcgtctatcgtttgtcttagttcttctcaataaagatccaaagactccggcgccttgagcagaaggagatggaaccttagaaatcggtgaaccatgatcctgatcctcaggcctatctttgtatttgggattaacagagaaagccgatgggagtttcggcctatctggatgcggcggtatagggtttccagcaacgtctagtttcactttcttgggctcttgaatggatggtgatgcgctattagccaatgaagctcgtgcagaggcttcttcttcacgttgagcctcgaagaatttcagatattccctcagttttgggtcgatattcttgttggaaactttgattgaaagattctcaagatataagctataatcatcagtgtccgaatctgcagccgaggaatcactgaaagcatcagtttctgcatcatctctgtccttctcttccttaaaagtggtcaaggacttgtctattttgactttaacattgcggggctttggtactgtggaactatcgtgcgatgatctagatgatgagggagacgatggctttggaggaattttcttgtgaatttcctctaatctttttgcagttggagaagtttcctttgattttctcctaaataatttcttgaaaatgccaccgggtggagaagatcccccttcgttgaaagtactatgagtttggtttgtagatgtcctggtcaaatctgagtttgataaactagacctccttcttgaggcagtcatggtaccatctacggttcttgatcgggttaatctgttggtgggaatctcatcatccgcgtcgtaacctttcttgaactggctgctctgaggaagagaagtcaggggagcttcgctgatttggcttgtatttggcgaagacaccgtgtctggcgaagtttcgacagtggcgcctgatttggagttgggtgatttggctatggtgggagatcttaacggagttgcggatggcagagagatattgggattcacattcgaaccacgcagaaaccagtcaatctcaccgttctgaactgctttcacaaaatacgcagcatcctcttccaacttctctctaagagagctgaagactccctctttcttggcctcatttgagtccttgtggtcatggtgattctccgtcatgtgtaaatgaagctggctctgatgagggcacgggggtgattagcaaattgaattaaaatgtctatgattgtctgaaagagaaactcaatactatagactgctgtgtgggaccaaagaagagactctttctggattatttggtagcaaaagaaaatgataaaacgacaacaaaagaaatgttggatgttgaagatctagccgaattctatatgggctccggtaccctgttattgccgcgaaaacgatgggatattctgtagtataaggacaatttagggtgtgggggcagtctgctgctttaggcatacgtcagaattccagaggaggtagtgtcgtacccattaattatgggaaaacagttgccagaccaacaggccctgttacgtctattgttggagcgatggaagaaacgggggatggggtggcctactgttgtcggataagtacagtttcttaatgcgtatatatgtttatttttccatcagttgtttgactttcttgttgagccgtaattccaggcgatttttcagaaaatcagacgacattatggagtgattaggcttactgccgtctagctttaaccccgaatatctttctatgaccttcttcgataagcgggagaatgcctctgcgttatcgacagtgttagaaagtgtgatggcatcagtgacaagttggtttatatcgacaacgacaggtttaaaatggtagtgatcgtccttattctcttcgtttctatgtttgatggggtagtgaagtaacatgtaaagcacttggtcgtactctgatgccaatgtctgcggcttaagtttggtgattaaaagaacaacaatgtaagggatcaggaacgcaaattcaatgtgattgctgtctttggtcttgtgtagataactaaaggcaaaaatcttatcccacgttagaactgtagacgagagtcccaactcccgtattagtaatagtctataatatctgatcagccatattgaagagtcaatcttcaacgtcttcgtcagatattgatggtggtatcggtcacagttgtgaaatagaatgtcaaatttaatggattcttggatgaaattgtcttcctgaaaaaatgatggagccagcttatacatcatgcgattgaatatcgtaaacgagtcaatatgtgtaaatttgggaccgtacaattgggccaccggatgcttcgtatagaattgctctggtttcccttgtggtagctgttctttgatcaagctgatcatgatcagtccaaagatctcatgcatgccttggcgatacccagagttcgtatcatttacatcgtcgttgagcttccaccatataaataaagatgtgatgatatttctagagttctccttgtccttgataaataaattgggataacttggaaacaggcgtttacaatctgtcaccaaagtctgcagtttggctaaatcgtctgtgttagaaaggggatcaacagaagcatcctgttcttggtaaaattcatcattttgctgcagtaaactccacggtactgggtatttctcactgtacttctgataagtgtttcgagtctgagtcaaaaccgaataatcaactttcatcgatgaaggcaaatgtggtttggacttgaaatattctgtaatcaaagtaagcttccacactaaactccttgtgaaatggggtaatccagggttgtactcattagatactactgccgaacacaggtctctagttgttgaatacgtggcgagtgttttcctggattgttagatagttaagtcattgctaaaaagacgatgcacttactctgccttctccacaaagtccatcagaggggaatgaaaaaatggcacaaaaggcgattgataagtggaagagttctatctagagaccaaattttaaacttttagggtctgcacagatattggaaaacccgcgcaagcgcacagctgacagcgtattctcttcccagtgaaccaactcacaagacaatatgaacattgcattcgttcatcccgatctgggcataggtaagctttgtcatgaatgtagaacaatagaaagaggcttactaacatttgtttaaggtggtgctgaacgtctcgttgtggatgctgcctgttctctgcagaaaattgagaaccaagtcatcatatacacatcgcactgtgacaaaactcactgttttgaagagatcaagaacgatgaaatcgagtcaatggtttttggagatttcttgccaacccaaattgctggcagatttagcatactgtgtgctataataaggcaagcctggttgattcttcgtttggcattgtctggaaaaatcaaagagcatgacgtgttcattgttgaccagttatcattttgtcttcccatattgcattatctaaagcgaagtgacgctagaatcctattctactgtcattttcctgatctgaagcttgcttctcgagacaccactctacgaagtatatatcggaaaccgtttgatttactggagcaatatacaaccatctgcgcagacagagtggtggtgaacagcaattttacgaaaggtattttcaaagaaacgtttcccattatttccaaatattacgagcccacagtgctgtatccatgtgtcgatacggaagcttcttcgatcgacgacacaactgaagaggagatgaaagagttttttcatagtaatgaacgattctttctatctgtcaacagatttgaaagagccaaaaacatttcactcgcaatcagggtgtttgcaaagcttaagaaagagaatctccaatttttcaaggagaatcgccttaagcttatagtggcaggtgggtatgattccagagtgagggaaaacgtggaacatctaattgaactggaagatttagctagatctctcggtttgaaggttatatcaatacgaggccgtctcttttcatatccagctagtgacgttattttcctgccctcggtaagttccgatataaaggattatttaatttccaaagctgaagccctactctacaccccagggtttgaacattttggaattgtgcctttggaagcaatgaaatttggaactccagttattgcggtcaatcacggtggccccacggagactgtggtagatgacgcccaacctgaaccaactggctacctaagatcaaatgaagttgacccatggtaccaggcttgctctcaggtagtcagattatctgacgaagaaaggcagaagctctctgccaattctaagaagcgcgttgaaacatatttttcaagagaggcaatgggtaaagcattttctgacaacatcgatcaaatgttaactgaacctacaagtgatagattcagttatgaaaaacttatagacatcttcttcgtattgggacttgtactactcaatgtcataccaatcgtagttgcagggtatacattcaagcgaatgagaggcgataattaaagttactaatggctacataaatagagtagacaaaaatataatacaattaattctccctgtaatttggttgatactgattaaattgaccttggaattgatttcccatgagcggatttgacaattgctcatttggtagctgggaggtttgattcggcccttgattggccaaatttgatggaattgcaagaggtgagctcatagaagttactgggctggttggagaattttgcatctgtctttgagcagcctgaagcacttgtgcccttgactgggcttttagctgtgcctgttgaaattgagtctgtgcttgtgattgtacatgtgatggctgttgttgctgctgctgcatctgattttgaattgcttgattttttatctgctgttggagctgaactaattgcatcctttgaaattgagctcttttctcgggtgtaaggtttgcaaactgttgttgctgttgcggagtcatacgcatgtggagattcctcagatgctgttgctgctgcagtcgaaattgttctttctgcttttgttgtaactgcaattgttgctgaagctgcaattgttgcggcgtcatctgagaatactgttgcggcagttgattcgaaggacggttgtcggggattggtgattggtgggtaatcggtggtgactgttgctgttgagcttgttgctgttgctgttgttgtaagagtagcatttgctgttgctgttgctgttgctgttgctgttgaagcatatgagtttgttgttgttgctgttgctgttgctgttgctgctgctgttgatgttgttgttgttgctgctgttgctgatgttgctgttgttgttgtatctgggtctgttggcgttgttgttgcaatcgttgttgttgttgtacaagtctttgaacagtttgagatgtctgctgtccagcagattgtgatatctgttgctgcgcttgaggtggagattgctgtgatttttgagcctgttgctgctgttgaacttgcggtcgtggaggttgtgggttcttctgagttttattttgttgctgatttggcattctaggagaagcacgaacggagaagtaataatcacctgccctatcaacatcaataacagcagtcctactataaaggttcccaaacggattagttggtactctaggtaaaattgcacctgcaaacatctctcgcattctcaagaaggatgatcgggacctcgctggcattattacctttctttccaatggtagaggataagatttggcaactccatccaaaacctgatgagcttcatcatcttcatcaataggtatttgagaaccgtgaattaagtcatctctagctgcgtgggcagcggccgcattagctgcgaactttgcttgattcttcctttgataggcaaccagtaactgatcgtaaggagcagatctaccaggtacagctctttttgcacccatagagtgggtcttacaagtcaaagacctagcacaatagccaccgtttggtaagggaaccccacattgtctttcaacgtccacaggacccttgggcttggcagttgacttgactctctccttcttcggtttcttttccttcggaagcttaactttcttggtcttctttgaagtagttgagttgatagcattggaagaattagtcgaattagtgttggtgactggagtagattccttcgactcttccagtacctgattttttctttttcgaaccatgttcattggcttatcgtcttcttcaagtttctctactttcacgatttggttacagattttgatgtgtttagataaacagctttgaagaatgggtctatcacaattgttgcagatgcgatatctcaatgggttggacaatgagtctttgtagctaggagatggtaaatctgggagggaagacggtttttcttgatgaatcggttgtagggtgtctagatattggcctaactctttccaaacaactggtctttctgggttttgcatgctttatctttcaggataatatgtttggaaagcccaatatcgacttgacagttgggatagttagatgataacaatgtgttaagaattgagttccacacactttaaagggcactgtggggggagggctcaacgggaggacctctggaagggaaatgagcgaatctagaagggaggttttgaatcacctctaatatccatgatacacgtgaatagctttgtatttctgacagaacttgtcactagtatatggtatctttggctgcaatgttaaaaaaccggtaatgtcaccaatattttcttctttacctgcaatctcaaagcccaagtttgtactggtttaccagttctggtacatctcaacaccatcactgggctcacttttctggtgatctttcgtgataaacaatcacctagaacgaatacgtaagagcacactaatcacatggtggaacgcagaaccagatctgagtcgggaacgcctagaccggcagatactccagatgagattgctgaaattgatcaaacgatccaggaagacaatataaaagtcgaagacccaagggatgaggaataccaagaaaatgacgatgacgatgaagatgaagaagaccccgctgcgaacgaggatgcggacgaccctgatgaacaaggggatgaaaccattcggaaaaataatagacgaagaactagaaagaattcaactgtgaaggaagaagaagatgacgaagaagatgacgacgatgacgatgaagatagcgatcagagtgaaggatctccctccaagtcaaccgccaaacatggaaagggcgtcacccttgtcataaatcccctgagaagacgtggaagacctgccaaaaataagaaaagagttagtgaactcgaagaagaggaaatagccaatgaagtcaagcggaaacgagggagaggtaggatagattcaacagacgaggaaggcttgcatctggaggtcaaagacgatgaaatagtggttccagttaatgaagacggagagacaaaagttgacagtgaaggtcatttgaagggaggtcgtgaataccgtgtgaggacgtttacttgtgctggaagaggtaataggctttacatgctatcaacggagcccgctcgtttgatgggattcagagattcttacctactattccataaacacaggaaactatacaaagtcatcataaacgataaggaaaaacacgatttgatcaacagagaaattttacctcattcttataaaggaagaaacattggacttgttacagcaagaagcatatttagagaatttggtgctcggataatcaaaggcggaaaatggattactgatgattacgataaggagtcttcattagccgagggccacgtagagggtgaactggcacttcttccaagtgacgaattcaatagaggtggcacaccaggctttgctaccaacaaaatgatcacccctcacacacaactcacgcaaacgtggatttatgagagcgctttgagaagtagacaagctgagtctcaactgtatgaagctcgatcatcattgtccactcccagaggattcaaggaaccatataccggtgtcacttttatacctcaacatttgcaaccttccaaggttgagtttttcaagtatgatgataccgtttcagataagttaatcatcactaccgtcatgtcgggaagtacagcttcagccactggattgaaggatgttccagaagaaatttacaaagacgttgtgacacctgacgttcttcaagctattcaagagcaaaagctgctagaagagaggctgtagcggatgatagctggacgattctcacctttaagtaagccaaataagtacgtactagtgaaatatcgcgccttaccctctcagtcgtagtctttcccagaggcaaaaaagttccagatctgtttcttccttcaagtaccgtccttgagttattcgacttgcaacatgtcgaagttggtgagcggattttgttctgtttcgttccgtaggattgtgaccagaaatctcgtccatcggcctatcataaacagatttaggccgataataagaactccgttgagcccactgagaaggcagttcaatcaccaatcggggatctggaacaagcaccagggaaacccagactcagaaatcccagatgaatcaaaggccaaagaacttctatttcaactgaaggctatttggaaggatgaaaatctttctgtctcggacaaacagggcctgctgaaagtattgtttgaaaaatacgaggtaaactccataaacgacccaataattaccaaactgacgaatgaaatgcttcaggacaaagatgttaccaatgcaagtgaacgcttcgaaaatattcaaaaactccacaatagtttgctacaatttcaccaggccaacatcagtaaacaatctgagaaaactgatgattcaaagaacaagaaagaggaagacgatgagttttttacctccctgttcacaaagggtggtgaaaaacaaggtaataaaggccagaaagtttttgttgccacaatccgtccagatatgattttgttgtatctggtttcgttcggtctcttattttacgtccttagttctgaatcacacgagagagaaatcacttatcaggaatttcgttctaacttgctggacaagaatttcgttgaaaagttgattgtggtcaataaaaagtattgttacgtcattttaaaccaaaacggaaggcagcaaccttttcacaataacaacgttgaatactttttcagtatcggttctctggaaaattttgaacacaagttagatgaagcacaagatgcaaataatatcagcgctgaattccgagttccagtagtctacgtccaacaaggaagcatttggagaggtgttttcacatttttaccaaccattttgatgttaggaggcctttattggattacaaagaagactgctgcttcaggtggccttggaggaggaatttttggagcgggtaagtctaaggctaaaaagttcaatatcgataaggatgtcaaaatcaagttcgatgacgttgctggatgcgacgaagcaaaagaggaaataatggagtttgtcaagtttttgaagaaccctgccaaatacgaaaggctaggagctaagattccaagaggtgccattctttccggtcccccaggtactggtaagacccttttagcaaaggccacagctggtgaagctggtgttccgttctattcggtttctggttctgagttcgtggaaatgtttgtgggtgttggagcttcaagagttcgtgatcttttcaaaacagcacgagaagatgctcctagtatcatttttgttgatgaaatcgatgctattggaaaatctcgttcaaaaaactcattttctggatccaatgacgaaagagaaaacacactgaatcaacttttggttgaaatggacggattttcaaacactgatcatgttgtagttcttgctggtaccaatagaagtgatgtcttagatgctgctttgctgaggcctggaagatttgataggaaaattcatctagataatccagaattggaggggcgtaaagacatctttggcgttcatttgaagaagctcaccctttcagccgatgaagatatggatgatttgaaggggagacttgctactttgacaccagggttcagtggtgctgacattgcaaactgctgtaacgaagctgctcttattgctgccagaaacaacgcaactcatgttgaattgaagcattttgaaatggccattgagagagtcatagctggattggaaaagaaatctaaggttctatcgccaccagagaaacggaatgtggcctaccatgaagcaggtcacgctatctgtggttggtacttggaacacgccgatcctttgctgaaagtttctattattcctagaggttctgctgcattgggttacgctcagtatctacctgctgatatctatttgtacagctatgataaactgatggaccggatggttatggccctagccggtagagttagtgaagaattgcactttagttctgttactagtggtggatcagacgattttgaaaaagttacggggattgctcagaaaatggttctcgagtgtggtatgagccctaaagttggcttggttaatttcaatcaagatagaggcaacgacatgaccaagcctttcagtgataagacagccgagctgattgatcaagaaatccaccgaatcgtttccgaatgctatgaacgttgtacgaagttactgaaggagaaagcccaacaagtggagttggttgcccaagaattgctcagtaaggaggttataactagagaggatatgatcagattgttgggacctagaccattccccaacaagaatgatgcgtttgacaagtatttggcagaaaagcaagtacgagacgacagtaagaaagccaaggaaagcgacaatgaaaccaaggatggtgaaaaatagaataaaaatccgttacacatgtaaatagatactctaagagcaagagatttattctttttcaaaaatattaatctaattaaagtctccggatagggataatgcgaattctatcccgggtttggttatatcttgagttctggtgctgatgggaatattatagttgaattcagcatttgccacggatcctagagagtatgtcaatccccaaccgacagcctgggcggaattcttgataaagtcagtgtttttaagcgttggaatatcattaagaacatcaccagcgttgatgaataaacgaagccttaatggtgaggccttgacaaagggtatcttagagtaagcagtagctcccaattggaagtagtttgtaccgccaacgaaatcattgccatctttaagaccagttgagttgaatttgaaacctctcaaggaattgaagcctcccaagaagaatttgtcttgaaaatgtggcttcttcgaggtatcgttgagtataattgaaccaattccacctgcaacttcaaaagtcagccagttgttgaaaaatgagtataacgattggaatttcaggtcagatttggagaattgctctttttcttgatcaataatcagctcattattgaaagtcagtgatgaacccttggttgggaacttgtataaggattctggggtaaaagatcttgaatcatagttaacattcagtagtaacgaattcttgttggaaaacgaagcatcacttttgattgtatcgcttgtaaaatcactcaaattataaacatttcggtacacaccagaaaaacctaactcggaagtcagggatctaccgaaacgtttgtgaagcccaagatagacactagaattggtctgatcgtggttagaagcccaagcgaccgtggactttgacaacaatgagttgaataccaacctatacgaaggatccttcaaaggagcttggaagttaaagttgaaattcttcaacggagattcacttctgagatcaactagtccattaaacgacagagattcactatttccaaacgcatttagattggaataaataccattcaatgcaattccgttctcaaataggactggagtgacggtgaaatgctttaggagggatggcttcaaagtcagtattgctttcactggcagaggcttcaattgtgattgttgaatgtttcttttgaaggcagtagtttggccttcaatgacaagggaatgttcatctgcagcagcacttgcttccactacctctaaatgtgaggtattaaacacttcggtatcgtttaacctttgaatcacttcattgcttgattgtacaaagtttgacactgtcaagtcagaattggacagcaatgggttcagtaaatttttgaaaaacagagcattaaaaccctcaccaccgacaatgtccacctgttgaagatgtaagggagtcgagtaattcttctgtagaatctcttgctggctcattcgggtctatgggatggttggttggtatgttgtgtttggggcattgaagttctcgaagaccaatcagtaaggtcacatgattactatagtagattagatgtgggtgacttcaagagagattacgagagcttgatagagtttactaggtgtaacctaagaacgtcgaaatgaagaagatcttctgagattatttgaagtccttcgattgcattaatagaatcattctgcctaagcagcttcgcttgttctcaacctgggccaggcgagcatttgcagctgggaaagggagggctcctactgacgttatcctagcgtttttacatctctcctaccccatgttagatgacatagtcctgccagattcaacagttcaagcgcagttagaactgttttgggacattgtttctaatgagtgtcaagaaggtaggaaatacttaatttggctagatttggaatcctcaaaattctttgagtttcattccaatgatgaagaacaaagactggacattgtcatctacaagaaaccgatgatgaaactgtttcccacccttctaacagtccaaaatcaattgattgcagacaattgggactggaaaaccattagtcgcacagatgctcagcaaactgacaagctttacaaaatattcctggcaattgtaccaatccttttcatcaataatgaaagccatactttagtactcattctagagtcaatggtggaactactgagtatacctaataacaaagttctcaggcttctacaatgccttcttacttgctccaggaacaacataaataagtcttcaagttactggactttccttagaaaattgtactccacaaactcatttcagcagagtatcttcattgacactctgatcgcttcagcaactatacatagaaaaagttactattgctggaactttgcaagcttttttgcgactattgagtttgccagaggagctgatttgacgcccgtttactctcaagtgaaacagttttgcatgagaaatctagattacggagcttggaaagtactctgcgaaataataatcattatggtgtctgccaacacaaatcaatattggctgaaagaatttgaaagatggaatgataataataataataacaaattacgtacccccaacaattcaggacgattgcatcaaaagactatgaattgggcagaacaagaacttttcatgctctccaattacatcaaaagttcccaaactgaatcgctaatccctcttacaatcataaagtgggtctatgacaaattagaactttgatagtcgaaaattcagaacgagtaaaattgaaagtctatcaaactagggcttgatcttttcatgagcagggatctcaaactcaggggtgaaattttggccaggtacaataggagcgatagttaaaatgtcctccaacaaggcctgtgggtcatttctatgtctgtttagaacgtgatctttataaatgacgaactctagcttatcactaccaggtgcggttgactctttaactgacaatggtctaaataatttaggatggaaatcaacattctcctgctctcttaactttgccctctctcgttgagcgtcttcaatcttgaacttttcctcggtagctgcagtatggtttcttactagcagagcatctgtaactttcttccacaactttctggattcaaattccccttgttcttccaagggcctaaccaagggtggcaaagggctggcatcttttgtacagtcgaaaaatactgtctttttgttggtgacaaggtttttcaactccatcacttcggtccacttgcctgaaagttcgtagattgattctccattcttcttaatgtctcccagtatatggttgtagcctccatagatgaaacctttagttttgaactcaatgtcagcctccatctttgtggtcaagcatttaatgatcatatggtcacccaactcaaacttcatctttccgaacagtataccccttccatacatgttaggttgagttaatgtgtagatctctggttctccgtttttatccagaatgtctaaaaatgtcagttttgtaactccctccattaaagcagcggtggagtttcccaagaaacgagatttaggagcaacaatcccatctactctaattccgtgttccgggattatataaaaataggatgatttggggggatgatgggacgtctgttctgaaacgtaaaatgccttggaaccgtcttctagttcccaataacatgtaaagtattctccaagtatcggattcaagggtttcttaacagccttgggacagatatgccagcaactcatgtaccacttaactaccaaaagaaaccgcttgacatcatcatctctggagttgtgggcctccaataagaagttaggttgttgcaattggttggtaattctctccaacattgactttctttccaaaataaacgtaggcagagtaattctacttagatcgcatcctggtcgtaactgggagatgattcccatcaaaatattttgtccctctccatctacttcatcaacatcctctggattggtcgatcccagtgcaggatcggatgatgacacatttggaagtcctaactttagtttactgaaggccatttggtctcacctatgaacaggaccctagatgtattgcttcgccctactcggccacctcggtagggagatttgtagtctcgcgatacaaggcaaaatgagtggtggacgactaactaatagccatcttttttgtctatcatacatattagttgtttagttacaaattgaaggggtggtcgaaccccatattacgtatttctatctaactttttggtctcttcttgcccgctgggtccgatttgatcctcttagaatgggtagagtctccttttgttttaacgggtctctcttcatctggatcgtacacatcggacggaaggttgtacaactttacatgtttgatggagagtgagtatatgtccttattgaagttgggccatgactgacatagagtgtaaaattcagtgcatggttgttggatatcaagtttcttgtccctttggttttttaagttgatttgtaggccaatgtagaatctggtcaaacgaacttcaactttaccttcagatgaagcatctgactgtgcttccgcactgtacggcgtcagcgttttcaagtactcttccccactgagtgttccagtatgctctaagacgctgtctagttgagcaatggaatctactagataagcctggtcaaatgttttcacgaatgggtgggctaagttgatgttctcattgttctccaatttctgaaccagcaatctaagtttggattccaccattccggcaaacttcttttgctcttcagagcttcctttcgtggctgcaataacagtcagataaaacttatagcgtcggaaaaaatcgtgtttagtgaacaagtcactccattttttggctccgctaaagatctctgtgacaatcccactgcccctctggaattcctgtaaaattaccttctttgtagattcagtgatgttgtgggtagcacacattgagggatatgccggagtaataaccggcatcttgtggtatttatcatgaggataaagtctagggttccacactctaacttgcaatggaccatcttcgataggcttcaaaagaacaggttggggccaattccactgccccagaatgacaaaaaatttggaaataatcactgcagaaacagcattagggtataactggcatattcttgcaacaagcattgcccatgcgacaccacctggaaagccaaatacgtttccgtaaacggcacgcctttgggcccaaatcttgattgctcttaaagcatgtttgaatactgttggctgcggtaccaataacaagatctcatcagtgactcttgtaccgttcaatgctcttaaatccttttcgtctatgtttttcagcagatttttgtcatctaaagtcaggttcaacggcactctgggaatgtccaatctagcacaaatcagatcaattgatattccatcaaactccattttgataattggtacaaatgcgtctggaacactttgtatttcttccagttcaggtctttgtctcaaaattttttcgaataccgtgaaaaagtcctctctattgatgtgcttaggaaagaccaccaacgtatcaatatccgaacctggtccatacacacctaaacgataagagccaaaagtgaaaattttgcccccagcgtcctttgccattccttcgtccatgttcttgctcttgctaacactatagacgaactcctgggtcagttgttggagggttttcaagacctttgcacgcttcagtgtcgccgcttcactttcaaaggaaccctgtcttctcagttcgtctaccagcaggtcattcagacgagtctcctcggaggagggtccagcagtgctaattgctggagtgacaccgtacgttttgttcattatggtttgtgtctgaaggttggtttgttggtgtgtacaaggagaggaattcgagggagaagtggataggagatgctgggaggaaaaaaagggaagagcacgaggcgagaactgagccaaatccgcgtggtctcatcactacgacagagatccatccgttcaagatccagcaagatctgcgtctctacaaacaaatgtcacaggaagcatatcattgactttcgtcattttgtcattaataagggggactagaaacataacttacctcattcaacatctcatctctccggtatatatagttgccgggaccctctatgaacatattgtaatctgagtattgagagaattggtaaaggatgaacattgtgttaagcaccggtacaaggaaaaacaccgggtgaatatagttgttggggtcatatatcattgacacatcatcccgatttgtgatgtagatgatggattgaaggaataagcccagaataccactgactagctgtacaatttgtgcatgaaaaatagacttgtttgttgaataataaaccaagtcctggtttacttggaaagtgtctattaactgggcaatcactatgagtgcaaacgctatttcaaccaatggttgttggaattcgtcatcgttaggagctggatctgtcagcgttttcagtatcggggctgctgcagcttctctggaaacaactggggagagactcaaaagggttgacagtattgggttatttctgagggataaactattcaacatggagctgcctcgtcgcataatagagacaccgttcaggggagttattatatggcttgccacattattttgaccttgagcgatagaattggatctggttgttccttgctcaatgatggacgattgtggggtgagagttgtttcttcaaattgaccgactccatagtcagcaaatgttccatacccggcacggcgcaatatttcctcatcgtcatcaccgtcggaagccaaggagctgattgtttttatgcgactatgctgaaaatgttggtatacagccattactgttctgatcagcgccacagcgtacaacacggtcaccatgcaaaagacaaactgaaaatagccaacttgcacgctgatgtaaacagtatttgccatcaatgtcagtaatagggacaataccgtgtggtcttggttatggttgatcactgcatacacaccctgcaccactattagcacgcatatcgtgtattcgattcctttgagcagaatatagttgtcttcttccaagttcaaccaaagcataacggatcaactcattgcctgaataggattaaagcagttttatgtatgaggaatgttcgttcaaaatgggtgggagtaattgcctagagataaggaatgggtaagggaaggctcgccgaaattcgaggtatgcacagataggggccgtttcgttattctggacccaagatccaagcacctagacgggcttcgcttaatagaggctgtgggttggagatctacattggcggatggtggacgatcatagatgatgatcgcagtcgatcagagaagcgcgtgagagcggtgtcatatttgtgttatgtgtgttgaaatagatactcgatgatggaggacttttcatgatatcgctccttgagcatgcatattcatgcttcggttcgatatattttcgtcaacgatccgatcctttcacccactgctaaactcaaaccgacattactctcattttggatcccgaactccgctgaagaattctcttggaaagccagatgccgatgcttatacattcttttccaatcacctagattagtactgagactacatttggactacatactaggacactgtaaagagtcttttcgttcggtgcggcagagagtttttcgccggcagctgacgaagaacgagatctctcgcgtgctatcttgaccggcacctactaatacgtagtataaatcaaccttagtccagcttcccttgaagtctaattgaactggctgacagatttttgacagcttttcactgcagaaggggcaatctccaaactgctggtactggtgaaaaagaaggattaatccttgaaaggagatctgtgatcagttacgtcccgtcattggtaataacttatatatgtatagcattttctttgctctgataacttacggtcgctaatcatctgtgagcaaatttgaatggttcattcggtagcatggtttgtggcctctgaaattttctgcccagattaccataaaaagtactacctacattggacagtaaagtttccaacacgccttgctataaaccaccattcctcgcttacagcctattctctcctctttactatcccatctcattaagctgatgcaaatcaacttactagggttcgtctggcatatggagataaccgcgtttttcaaaatggtcgtggcttagacaagttcaacaacgatatcgccttctgagacgctgtctgtctacaacaactatctgactacaacattaaccatggatgaacacctaatttcgaccatcaacaagttgcaagatgccttggctcctttggggggaggatctcaagcccctgttgatttgcctcaaatcaccgtggttggaagtcaatcgagtggtaaatcgtccgtattggagaacattgtgggaagagatttccttccaagaggtacaggaatcgtcacgagaagaccattggtccttcaattgatcaacaagaggcctttaaagactgcaaacgcatcgttgatcgacatcaagactgtcggtcaagatggccttaaaactgaaaacaatactgaggaatacggtgagttcttacatcttccagataaaaagttctacaacttcgaagatattcgtcaagaaattgttaaggagactgataagatgaccggaaagaatgccggtatttcagccatacccatcaacttgagaatttactccccacacgtgttaactttgacccttgtggatctaccaggtttgactaaggttcccgtcggtgaccagccaaaagatattgaaaaacaaataagggaaatgatcatgaagttcatcagtaaacctaatgctatcatcttgtccgtcaatgcagccaatcaggatctggccaatagtgacggtttgaagttggctagagaggtcgatcccgaaggtacgagaacaatcggtgtcttgacaaaggttgacttgatggataaaggaactgatgttattgatatcttagccggtagagtcattcctttgagatatggttatgttcccgtgattaatagaggtcagagagacatcgaacagaataaaactatcaaagatgctctgcaaaacgagaaacagttttttgagaatcatgcaagttatgctagtaagtcgcactattgtggtaccccattcttggccaagaagttgaactcgattcttttgcatcatatcaagactacccttccagagattaagaatagaattgaaactgccctcagcaagtactccaatgaactggcaactttaggaactgaagttttggattcgccaagttccataattttgaacacgattactgatttttgcaacgattataacagtattttgaacggccaatccaaggacatatcttccaatgaactaagtggtggtgcaagaatatcatttgtcttccatgaaattttcaagaatggtatctatgctttggacccattcgatcaaataaaggatactgacattcgtactattatgtacaactcttcgggatcagcgccatctctgtttgttggtacccaagcgtttgaattattggtgaagcagcagattagcaggttccatgagccttctcacaagtgtatcaatcttatttatgacgaattggttcgtataattaaccagattctaaatcagaatcagtatgctaggtatcccttattgaaggaacaaattaatcaaacttttgttcaattcttaagggaagctttaattccaactgacaagttttgtaaagacattgtcactgccgagcaaacttatatcaacaccgctcatccagatttattgaagggatctcaagctttgtctattgtacaagagaaactaaacccaagtcgtcctaatttggatccaaagaccggaaagccgataaagcaacagcagcaaactcctagtccagaggatgacgaccgtggatcctccttcttttctggatttttctcatctaagaataagaagaagttggctgctatggaggccccgccttcagttttgaaagcatctggaaccatgtctgataaagaaacacaagaaacagaggtaatcaagttgctgattcaatcctactttaacattgtgaagaagtctattgctgacattattccaaagtctgtgatgctcaagctgattgaattctcaaaatctgagattcagaaggtcttattggagaaattatacaacaacaatgacctggattccattgtcaaagagaacgacgttactgtggctagaagaaaggagtgcatcaagatggtagaagcattacaacatgctaatgagatcgttaataatgtttgatatataaatatgttgatcaatgtttttctgtgttctataaaggagggcccacgttggccaccacttcttcaattataacgtttgcatctgacatccggctgcaaacttccttcaccaactcgtagtcactcccccactgaagtgaaggctctagattgaccttattcagtatcttgattttgaaagggagaagccacagggcagatagtttgacaatgataggaattacataatcgtagcctcttaacagactctgacacttgcaaaacaattcaaaatcgtctatcacgtatgtggggaggcctcctaccaccattctgtgtgttctagtgtagactatgatatctagcatgtatcgtcgtatatctgtgacaatttgcactgctttcagttgatttctgagggagttcaactccttttcatcaaccaggcgatcaggcgcctcctggggtatgggtttgagattagaatggaagtatctataccatataatatctttcagcctttcatgtagttccagttctgtcccacggatgttcaaagatatgggaaatatcaatactttggacttgatcacattacggtaaagactattttgaagcttggaacttcctttcgccagctgaggaagaataatgatgtccctgtgagtcggcggggagaactctgtacaaatgtcttcccattgtgtagcatcagtgatttcgcagacggagacctttaaattgaatctctctaaaattttctggatctctgatacggtgtcacttatgttgtcacaggatactaaaaaatgcttcctccctattaatgctgttccaacagctgaggaaagatccattccttgatctactgtggaagtgtaagaggccagccaaggcaagggccctttgatagacctacaggcatttcgcggtttatgtctgccgtctcttttttttttttttttaacttgaatcctctgaatagaatctccatacttaatacacaatggcaaagctggtccacaacgttcagaagaaacagcatagagagcgagcccagccttcagaaagaaggaagcttggtcttttggaaaagaagaaagattataaactccgggctaaagatcgtcatgccaaggaagcttatttgaagctgttgagagagaaagcaaagaacagaaacccagatgaatactatcatgctatggttaacaggacaacaaatgaagatggaattatgcttgagaaagaagaagagccggccctcaccgaagaggagatttatctagtaaagacacagaatgccacttacgttagtgctatgagaaacagagatctaggtaagattagaaggatgaaacaggccctgtcatatggaagtgagggtaaacacaccgtattcgtggataacgaaacagaattggaaacgtttgatccagtaaagttttttaaaaccgatgctaggttattaaaccagagagaaaaccgtttgaaagttgatcaacttttggatggtgatcttaaaaactacgatcaagtgtttgaaaagacgaagcttgatacagatgctgaaaaattgaagcaattgaaacttctgaaaagtcatatggatagagcaaagaaattacaggaattacacaacgagattgtcattagtaaagagttgacaaaagagggtgaaaaggaaaaattaataggatccgatggaaaaccatactacaaatggaaaactcagagaaagaggtaaatatgccaagtacttaatctaataggtgacagaccattcttttactgtagcgtcagatcctacagaaacaatcttgtcctggcttctccaagccactccattaactccctctttatgagcattcaaagccttgatatttcgtgaaggcttctcgacagagtatatgattatattggtatccaaggaacccgttacgacatggtcgttgtcctcattccaagaaatagaattgactttagcagtgtggaaactccacctggaggtcttgacactcccaccatcaatatcaaaaagtgtaatccttcccccgttgtcaccaactgcaacgtacttctcgttcggagaaattgagactacagatgatggagatcttaacacaggtagtttgtcgctgatcaatttcaaagtagtgtcgtacactagtactttctctggagtaccaataataatgtatttctcagatacatccaaactagtggcttcgatagagagtttatcgatctgtttcaagctgggatcataactggtaactccatcttgatccaaaacagcaagtatgttgctgttaccggcaatgtcctttggctggcttgaaagttttactgatacactggagtccaactttctgagtgtatcatcccaagctgttgtgaccggaatgggtttactcaaaattccaacaaccaaattattgtgaccttcaacaattttaccatctcgtagtattcttccatcgtatgctcctgttgtaatttgatcattgtctacgttcaaagctgtaatgcttttttgctgtccttggattacttgaacatagtcatcttgattctcttcgaagtagtaaagttcaccagacaatgtaagagcaagaatgtaatcggcggttgttacaacaccaaggatatggttttccactttcttgggaagtgaccaagtttttaggagagaaccttcagaatcccataattttaccttgctatcggcggaactcgtaacaaacttatcacccttccaagaaacagaaaatattccaccatcatgagcattctcaactactttaatcaaatctccggttttaccttcataaagaacgattttcttatctgctccaacactgacaatggtgttaccatcatcactgtagcgaacatcacgaacaaagttggagtggttgtttctaacggacttgacaaacttgaaaggaggcccctgatagaaaacaagtccaccatcatcacttactgtcactgctctatatggtcttacaggtctaatgctgacagcattgatgggagcagaatgtccactaatctctccaacagtgtttccggtatccatggtcaggcaatgtccatatctttctttaccatcaccaacaacaataatacgttgactgtccgcatcccaggcaatgtcattgattcttccattgagaatttgaaactcactctttacaaccatctcatcaccgatgggatcccaaactttaacattaccagcctcatcggccgaagcaacgtaaaatcctgaaggagaaaaccttgcaacagtggtattataattgtgtttgatgaactgcttggcatccgttggattgctaacagatctaacatagaccgacttccccgaagcatatgctatcttatcagatttggcgtcataggagagatgaaccgccacggctcttgttgtggagggggatggagctagaagtgaatctaaaaaaacatgttagtaattgaaaccggtgccaaagatcctggaaataaattagagcctaccttgctgaattgacattatgtttgtttggatgagaggtttcttcctggatcttgcaaggcgcagaggattggagggcacccgcgactgcaggtgagcagaagaatctgactagaagactgttgccaggatagtggggatggctatactggcgaatttggcattcaagcaacattcgttagaaaatcacttttatggattcataggcttggtggctatagcattaagcttgtttcttgtgcatcttcaacgcaatgaccttgaagctattttttgacatccgtacaccacaatgaacatctgaaattttttttctttaataaattttccctactctgtaactaagaatggcttccacaaggcaaagaataaccaatgtcagaaatccgacgttggtagctcccccaacacctgagcaaaggtattggagaggatttggacatacgcaactagtcaaagaacacagctcagtgactaatatctgctttaacccaataagccctcatgattttgctgtaacaagttccacacgagtccaacttttcagttccaagacaaggcaagtcgtgaaaacgttttccaggttcaaagacaccgtttacagcggagaattcagacatgacggtaaacttttggtggctggtgatgcttctggattggtccaaatatttcacgcagataatccaagatcattacttgtaagtttcaaacctagcagttacccaacacatgtcacaaagtttcatccgaacaacaacagtaacctattgacagcatcagacgacagaatagtgaggctctatgacattacaaatacagacaaggcattagttcagttttcagggcacgacgattatgttcgtagtgccagttttattccaggaaccaaccttatcaccactggtagttacgatggaattgtaagaatatgggatccaagagaagatggacacaagcctattacctcattagatcaaaattttgctgttgaggaccttatgtctctcagttctaccaatctgatctcttgtgggggtccgagtgtgaaagtgtgggacctaagtagcaacaagcttattcaggaaatgaacaactttacaaagactgtcacatgtttgtacaatgcagctgaacgaggaatattggctggatctatcgatggtcatgtcaaagtattcgacacgaataaccaaggaaactacgaagtcaagtatggttggaaattcggtagcggtgtccttagttgtggtgtttctcctaataataaacattttgttgccgggttgaactctggactgctggctatcagaacaaggaaaacagagtcaaagcctaaagctattaaagcaccaaaaagtggtaattttgcgcaggtagttagaggaaattatcatggcgagtcagagaatcgtattattaatgacaagccaatgaaacaagccaaaagactgaagagttttgaaagagatctcattgctttcaaatggtcggatgctttggatagttgtctaagtgaggagcaaggaaaagaaatgacggtctcctgcttggaagagttgagaaagaagggtaaggtcagagtggctttgaccaatagatcagaagctactttagaacccttgctgtcttggtgttgtaaatacgtggatgatgttaagttagtcggcttaattgccgactatctggcaattgtcttggaaatgtaccccctaatattctatggaagccccatccttgaggaaaccttgagaactgttcaaagaaaagttgctcaagaaatagagaaagccaaagcagcacaggtaattgagggaatgctgagtttactatctgttaaataatataaacgaaaaactaactatatttcaagaatcatatgtatattgacaaaccaattcatcgatcaacgacttgggataagctggtccatatccatggcatctctcatttcctttaagagactcaacgatactttgaatgtccagctcttgactattttcttctatattagaccttttttggtctaaatagtcccatacggcactaatggtgagcagttcttgatcgcagtcggtgtacgttttagagacattaacgtctgctccacttaaattatgtttcgtgttatctttgagcaatgtgtgtataaactcatttttcgtactcggaaattcgtaattcaaatcttttggttcccgtggattcaggctctgtttcagttgatcgagctgcaacttcaaagagtaattttctttcttggactggtttagaagttctgtaagttcttgaatttttgcctctttacgttgacgaaaagctctttgggccgctctgttttgttcctttttcttgttcactacctggtctttagaagaatcactactattattgtctgggatgggtgttatactttgctgaatgatgtcacctgtggggatgaaatttggggcttgacctatgaacgacatatcctcaagaggtgagacaatgttcccattaaagagatcaactggaggttcgagctcgggtttcagtttccactccatcctgaatgagttgcagcttctatcaggactaagtctggtgtgttaaggagttaggctaagcaaaaaaaaaaagagacactacgcgaaaatagattacctaatatctactcattttattcaagggatccagaaatagttcaactccatcacttattgggaatgctacgtagccttaaaccagtcactgccttcgccttaaaaagatccttgcttagtataaagcaggtacacgggactcaaagtgtgttgaggtcaccggttagaaactcctcaagcatcagcagcgcagacgaggaccctaacttgccatggtacttgaggacggaaacaaaagtggctaaacccattgaaatgcccgaattacctgaaagctctcctcaaaaactacatgaacttgtcaagtactttataaaggatcttggaattgaagatatcaaggtattcgatctgagtatgaacgaagaagaggaagttgatgggtcaaagtttcttgggaagtacatggtgattggaactggaaagtctaataaacatctcgccaaagctggtacagaaatgatgaattttctgaaacacgagtacgggactcctagcagcaatattgaagggttggtcaaggacacccttttgataagacaacagaaaagattgaaaagaaaaggtggaaagctatccagccctcaaagtaatgactttggagttagtgcaaattcatggatcatgattgatacgaatattgatgacatttacgtccattttttgactgaaaagagaagaaaggaactaaacttggagtatctttggtgtagtgctgaagacagaccattgtatcaccaggaagttgctacaactcaatcggatgacattttcagtggtattagaaattaccacacatcttcaagaacgtctagaacttacggtgtttcaaggccccagcatttgccaagtttcacaagatcatattcttctacaccaagtatcaatgagctcgttcatttatcagaatcaggaagttaccaagaaatatccaaatttactaatcataatgatcctgaggtgactcagctgattttactctctcacataaatttttttcagaatttgcccttgaacaaggctatcgcacacgctgacgagctatacaagagctttgaagcagcattcccagcatttgatgcctcctctgatcactggaaaatccgttatctatttttggacatgatgcataaagttgataaatccaggtggtcattctccatcattgaaaacaatttctacggaaaatcctcccatggacacaggctcactgaagaggacttgaagtacttcatcaagtccgtaattgaatctcctgaactttcgaacagatatttggatcctaattctaactacgaccacgattccacgcctttcaaagatgaagggtctgaatcattcgttagtatttctaataacaaattaggaaagattgccaagtttattcagctgtgttatcctgacctcccagagggaaatgtgtttaatcattttgagtcatgggattctacggtactcccattgctcttgactgttgtcagtcagaccacccatgaaaacttcattactcctgtaaagctgtcagaattatcatcaccaatagctaaccacaaacccgttccatacaacaagacgcatcttgatgctctgcttgaagttattcgagtttctcagcctaactttttgttgaacgatgagaccagaatgaattttatttttattctgaccattctggcaaacgctcatgagtgggagcgagtgtataaactttgggatgctgctttagaaaactctgtccctataaatcctggatcaacgttcaaacctgacaccagaccctgggcttacctgatcgatctagttgccaagataggcgaccctgccaatgcgagagtgttcctacaaaaacggtggccgcaaatgattcacaatggtattgatgccactgatcctaagataggcactgctactgccgtgctcttgaaggtagcagaccctgaaaatgtactgttcaaaaacgtaaaatagcctgtatatactggaatcactcatcgttatttagatgagcatttagataatctacaaacagaggaacaattcgatcttcttcaatggttctcattctgttgagtgcgatgtaacttcttcgaatcctttgcaactgtgcaacgctcaccgttgtaggagggagtgatattagaagttccttctctctatcaatgaggacttcaccacctacgctttgcaattgttgaaactgaaggatcttggaaataacatcagaagtgtgtttatctagctgttgtaaaaagttgcctgtggtagcttgtttcaagacagttgcactattaggtcttggtgcctttttcagaataattgactcccaaatagattcaaatggtaaaggctcgtcatagggaacgggaattaatggagaatcccatctgttaaggtggtttggctcttcatatctcataatgagggcatctataagatccttgtcccatttagtgtcctttgttaaatctctctcgtcgttccatttgtagcatgattcagttggtgcaattatatgcaatagacaatagggtgtccctaaagctttgctctcacaatgcagctgataacgaaatcctttaatgtatgctaaagagtccaaaataacaatggtttttcttcccaaatctcttttcacagctgatatttgagttcctctgacgctcttctcgctgactgattcccgatacctttcctttactataccaagggattcatcagaatgcaaaatgactgcgatcccgtaacccggatcatttggtccaagagctgctatcttttcttccagcttctcttttagatcttgggcccgagtagacttgccgctgctgggatgtccagttattacaactaaaggcatttttattcagtagattgaaattttggggtacctctaatggaacatctgtaaaaaaaacttcgcgaacaaaataatacttctaatctgatctagcgccaattccatccataccttgtaccttggaagtatgaaaggtgttctacaacaggagtaaccaagaactttgacaccgcaaaggcttggagaaggagggaaatggtgagaaaagcgactcataattcctagaatggcagaaaacgccgttcgtcatctagtgacgggtcttttagaagactcaactcacctgccattagatcaaccggtgatcagttgaagcagtaaatatcttcattagcgtagaattcttatagtaggatcaggttataccggaagattagagacaatagaaaaagctttatgcacaccgaataaataagcctattgtgcgagaagggcttggcactgtccaaagagatttcatccgatgatcttaaagatgaatagtaatatgttcacatcgcaaacatagccctgttgcaaaaaaagaaaactctagctaatcaagagatgcaaaatagctaaagttgagatggtgtaatgacaccactttgcaagacacattttacagcaaattgtcaatcatggcgccatgcctagtcaaatctaatcaggtaccccggaaagcttagtaaaaatgggtcatctgatttaaaattcattcatcccccatggcctccatcaacgggcttcgaacttttcattaactttcacgccattagtgtgattaattccagcagtagggctatgtattttctgctagtagcggaaaaattactgatgcagccgtattagttgttgcaatcaagcctcagttgtcatctgtatccacactttgatgcaatcacgtgcaaaaaaatacgttaagccactgaaaaaaagctttgttcttagacgcattatgcaaggtcttattgtttcaaagatgagattctgaactttttgaggtaccgatataatctcccccactgatcctccacaggaagctgggtatatataggctgagttacctccggagattgcagatatcactatccagcaccccaatatgagtagttctgactccttggaaactaaagagaagcccatagctaccgtgaattcacttcacactgcggaagatggtgttccaaccttgaccatcattaataaggaaactggagaaactaccgttatcagaaaagactggactgatgaagaagagaagaagcttgttctcaagctggactttattgttattccgcttctattctttgcattcttcttgctacaactagacagagggaatattggaaacgcttataccgatactaatctaactaaaatgctgcaactgaacaattaccgaatcaacatcgcaagtgccttgttttcgataggtatagttgtgtttgaaattcctttcaatgtggtcttacaaagagtgagtccttcagtctttttgagttttcaaattcttgcctggagtttggttgcagcccttcaaagtcaatttaccaatttggctggtttctacgttactagatttttgttgggtactatggaagctggttttattcccggtggtttgtattatcttagtacatggtacaagcgatctgagttgggtttgaggcatacgttctacttctacggaaactttactgcttcagctgttagtggactcattgctgcgggtatcttgaaaaatctatcaggagttggtggtttgagtggatggcaatggatctttttacttgagggtgttgtcggcatcggattttcatttgtgttctttacatttttacctgattctgccaaccatcctgctgccttttggaacacgagatggttttatttcaacgaaagagaaagaagaattatgcgtgatagaatatacgttgatgatcctgcaaaatctgtgtcgaccaggaaaaccaaccacagagatgtttggaaaactgtcaaaaagcctattccttggctacatttcttaataactgtcagttctatgcaaacaaccgcggctctttcaagctatatccccctgattatcagatctttcggatatggtgtatttgagtccaatgctaggtcctccattcctcaatgggcttccatggtcttacttttgcttttgagtttctcaagtaagcacatcaaacccagaggtgcttctgtcgcatttgttctcatttggcaactagcttcgcaaattgccctgagagaacttccagctgatgcatctgcgactgcaagattcacagcattgtgctttctggtcacgtcaggggccatcggacatgttttgaatacatcgtggttgagtgtaaacatcaagaacccaagagaaagaagtgttgcccttgccatgctcattatggcagctaatattggtggtatttgtggtggacaaattttgagagacaacgataaaccattatacaggagggcattcctctctcttattattcttgatgttgtttctatcgcagctatactattcactattgggttctactaccatcaaaatagaaaacttacaaagttgttcggaaaggttgatattgaggactcaagggaggagagtgcagaaaaagagtctaccactgctgaatcgttgcatgagacagtatatgttggattcaatgataatggggtcgttgacaagaaagaagaggaaaacgctctcgtaaagaagcccaagtacagatttattccatagttggttctatgttcatgttgtataataataactatcacatcttagtaatcgcgatgcaagatgcaacgttatctggagcggtgaaaaatcgaaaaaagctccgcgttacgtcgtgctgtggctgtaattctgacttcgcttttgcaattacatgaaaaaaaggctctctgtcggggtttcacttacaccgttatggcttcaaagtgcgccgtctttttccatattggtaaattgatttcctcacttttatgtcttcgagtcgtgtggatagcaggaagaaccaaacatttcatgattacgtaatgttgcttcttccacatctggagaagtcactatctgatcctttttgtcgattagttcttatcacctttaacatcatggtcaaactgattcacaacataaagtacattcagattgttcgattggctaatgtgaggttgatttcgactggcggctcactattggccaaagtggacccgaaacctcctcgcacttccaatttcatacgaacttcctttcatccagacgaggagctcagaatcaaagaaagatctcttgcaattgaaggcgtggttgatctaactcagggtagcgagaagtttttggagaatcctgaggacaattataagcaacttccagaagattcggattttatagagaaacactacgacgaactcaagtactatagaaaccttttgaagaaacctttcaacagttacaagaacgcaaatgacctgctcagggatctatataaaatcgaagaaactgatccggttgccgctactgtaccaaaaacccaagagacggcggaaacaactgaagccgaatctaaactaagtcaatttgagaagttcgtaagggatattaagattactcttcgattaaatggtggtcacttattcgttctagatctcttaatacaaaacaaagaaatgttcgatagctttgaaaagaaaaagaaatgaacttataaggtcagcatctcctttaacaatgagtttcctgcaatcttgtccttgaactcgttacccatcaaatctttaagtttggatacaatttcatcactattggcggagagatcagcctcacttttccattgtttcagcaagtccttcaaaagctcgttggctgcttcgacttcttcgtcagtggcctttatcttcttcgcagcagactcatacactgcatcatcgtccagttcttgtgccttccgcttagccatattgatgatcttttgagggaatttgacgatttctgccacgttgattccaaaagacttatcagatattcccggtttaactttgtacagcaatgtaatatcgtcgtctttaccgtctgtagatgtttgtgcaaccacgtgcaggttaataaccgttggaataagctcactcaattttgtcaactcatggaaatgagtagcaaaaagagtgaaactgtgcagtttgttagcaatatattcactgatgccgtatgctaagccaaacccatcgtaggtagaagttcctcttcctaactcatctataatcaccaaggagttgctcgttgcagtcttcaaaatagaactcatctccagcatctcagacataaacgtagatactcccttcagctgggaatcggacgctccaacacgagccaggatcgaatcaaatacacagatttcggcctcatcacaagggaggaaacatccaatctgggccatcaaagcaataactccaacttgcctaatatatgtggattttcctcccatattaggacctgtaataatggcaaactcggattcatctttggtcaaaacaacgtcattggcaataaatgtcagatcatcttgggtctccaaacatgggtgtcttgcacctatcaactttagctttctcgagctatcatctaaaccgtaaagctttggacgttggtatgggattggagcaaacgagaaacgtgggcgaaggatgtcaatacgtccagctttgatataacagcagataactgtaccaaaatcggactgtaagtggatgatatttcaataatctccttgacgacacctgattgaattttgctgtattcttctgttagttccgcaacgttagaggctaattcagatagtttggcagtggtgaaaaaaacaccagcctttactgtttgaagctctctgtatcttttgtttcctctgattactgacgagtctgttctagtgagtctaaaacaccatccatgaacatgatggttctctagtttaagcttctttaccatctccatattaaggtcgtcgcttgcaaattcatgctcttgttgcatttgagagttcatctcttctagttctttactcacccttacgagattctcgtcgaactgagggttcaccgaaaccattgaactggaaatgctagtggcattttccaatgcatccaggtcaattgtagtctcaactaactcttgaaattttaataaggacgagcaaatcttctgtaaagggttgataaaccattcgtcaatcaactccgaggctctggtattctctttatcttctgcaattagaagacctaatagatcgggcagtttcgtgcatagttggtagattctaaccacatcatccaacttagctttacgactggccagttttttagtcagttttgagatatctggaacagagttgaggaattgctcttggagaccggctctcattgtcatatcatccacgagaagctgaacaatctcttgacgctctgtaatagctttaatgtccaaaagaggttgtttaagccattgcgaaagtagcctagaccctccaacagtcttgcaatggtttagaagaccaaaaagggaattattcttgttcatactgttttgattgttgttgctcacagaggggaataaattcaatgatttgacagcggaatagtctagtcttaagtattgagacagattgtacagttccagagtccagccactatcatcactattcaaaagattaaggtagagtaccaaagagttcacgcagcccaaagcttgatccaaagaatgaacatcgttggtggaaaacaccaaatcatcgccggttagtctgacaagatcttgttcaatattcttggtggaataatctgaattcttgacatgagttactacaacgtcacatctattcataacctgctccaatttcacatagtctggatcagcagcttttgaggtatttccagctagaagacattccttgatgcccaattgtatcattgcagactccacgttggagaatagatcattatcaacaaactccaccaccccaatgatcttgttaacagagtcgatataggacagtccaatattcttaccactcaatcgaagagaggcaatcaaagcctgggtgttcaaatcagaggaattgatcaaatgatctacctcagctagatttcctggactagcagtcttggaaagcgtccatgttttatcgtagatctcgatcttatggccgatgtctagaacacacatctttagaaaattgacgaatacttgaggcgatagcgtgacgtatttgatttccttatgctggcctgaagccagagtcgcattgcttgttttcaccactgaattcgtcttgtatatcaactctgccactagtattgcatcctggtccaataccgtgtagtagtcaccacggtcgactgcccacactgttctatcgggcttttcgcccaacttgagatatttacggtaaaaccctgtctcatcggatttatcctggaaccgtagttctggtcttatagacgacattgatggtaaagtggaaagagagagagcgtaacacgaaatgagctgtagattgcaagaacacgcagcgaaatatttttaaagtatgtagcttacgcgtatttttttatggggcccagcaaacggtacttcaaaatacgcacctagcctttcagccttttccaattaatcatcatgggtatcaagggactgaatgctctaataaatgagcactctcctaaagctttcagaaatggcgaaatgaaaactttcttcggaaggaaagtggccattgacgcatcaatgtgcttgtaccagttcttaattgcagtgaggcaacaagatggccagcagttagccaacgaagaaggagaaaccacctctcacctaatggggttcttttataggacaattcgaatggttggatacggaataaagccgtgttacgtctttgatgggaaacctccagttctgaaaggaggagagttagaaaaacgtttgaagagaagagaggaagccgaaaaacagagattggacatgaaagaaacaggaaccttggctgacattgccaagtttgaaagaaggaccgttagggtcacacgtgaacagaatgaccaagctaagaagctgcttgaattgatgggaatcccctatgtagacgctccatgtgaagctgaagcacaatgcgcagaattggctaaaggagggaaagtttatgctgcagcttctgaagatatggatacgctatgttatgaaacgccatatttgttgagacacatgaccactgctgaggctcgtaagttgcctgtcactgaaattgattatgctaaggttatggaaggtcttgaaatggagcttccccagttcatagatttatgtatacttttgggttgtgattattgtgagactattaagggggtaggcccggtaacagcgtttaaactgatcaaagaacatggctccatagagaaagtcgttgaggcgattgaaaataatccaaaatccaaacaaaaaattcctgaaaattggccatacaatgaggccagggagcttttcttgcatcccgaagtgataccggcttctgagtgtgaattagagtggaaagaaccagatgaagaagcattggtagactatatggttcgccaacatggattcagtgaacaaagaataagggatggcgcatccaaactacgtaaatccttgaaaacgggcacccaaggacgtttggacaaattctttgtggttaagaaaagaccagcagaagaaaagaagggaaagaacacaaaggaagagaaacccaagaaaaagagaaagtaataattccagcagtaaccggttattgaaaaagaatctcagtctgctaattcgtaaacttctttaaagataaacattgctctataggttagttttataccagttagtgtagatagactgttaaaattataataacatttacaattcgttttgagaattagtatatttggtggcttaattgcatatataagataagtaaaattataaaaagtcgctttactgaccagctatgacctatgaaagcattcttgaaaatatttagcataatcaagaggtatagaacccgtgatagtggttatacaatatcttagtacatctaataatctataattttatctaaaagactctaactaaaataatccctcaatctctccttcgtcattaacttcaacattgagatatcctggatgagtaggtagccctgggattgtcatgatcgcagcagcaagacaactcaagtatccagctcctgcactcaaacgaacttctctaattggaaccgtaaatccgcttgggacgtttttgagggaaggatcatgagacagtgaatactgagtcttagcaatacaaataggtaagtttccaaaaccttgagcttcatagcgagcaatttgtgtctttgccagctcgctcagttctattccattaccattgtacatttttcgaacaattatattaagtctgtcctcaatggtgttgttgtcaagggaatatagctcagattgctcggcatttggctcaggacaggaggcacaagaagaaacaactgccttagcaagctcaacggcacctttaccaccttcagcccaatggttcgatggaacagcatcaaaggctccggctttcagggcctcttctctaattacagccaactctgcaggagaatcagtctcaaattgattgatagcaacgacaactggtgcgccatattgagatgcattagaaatttgtttggccaggttggcgcaaccacgacgaaccagttcaacattttcagtagtgtattcttcaggaagagcttgtcctggcttcacatcaggggcaccaccgtgcaacttcaaagcacgactagtggccaccaatacaacagtgttgggttttaaaccggacgctctacacttaatattatagaatctttctccacccattgtgaaatcgaaaccagcttcggtgacaacaaaacccttctcagatttagcaacgacatcactttttgaagctccaattaacttcagagcaacacgatcagctataaccgaagaagctccaatggaaatgttggcaaatggtcctgcgtgaacaaatactggagttccctctaatgtttgcatcagattaggttttacagcatccttaagcaaagcggtcagggcaccagcaactcctaagtcttcggcggttataggaaccccttcgtaacttgaggctacaacaatggctccaacacgagatctcaagtcttttaggtcctttgagagggccaagatagccataacttcagaggcaactgttatatcaaaacctgtcttccgggtgtgtcccttttcggttggggcctctcctatggtaacttgacgaacaaatctatcgttcacatccaagacacgtttaacagtgattgtctgaggatcaatgttcagtttggcaaacttagttgcctcctcgggcgttaaagagtctgggtcagtcttgttgatgcctaacttttccaaacgcttaagcattgaaggagtaaacttcctcactccttttttagcaggaaccaatctcttgtagaaaactgcgtccttctgagtagtctcatggaaaattctggtatctaaagcagcggcaagcaagttgtttgcagcgccaatggcatggatatcaccagtcaagtgcatgttgaattcatccataggaataacttgagcgtatcctcctccagcagcaccacctttgacaccgaaagtaggccccattgatggttgtctaacattagcaacagccgcaaggttcaaatgagcacccaaagcttgaactaaacccattgtagtggtagattttccttcaccaagaggagttggagttatcccggcaactaacacatagtttccattttctctgttttcagctaatctgtcgtaaacgtcgagggaaactttcgccttgtagtgaccgtacaattctagctctttgtctttgatacccaagtctgtagcaatatctttgatatatcgtggttcctgggctctggaaatctctatatcagaaggaacaggggtcttaagctccagtgggtttgcataaatcttagctggcttcaagtcgttcttcaattgaagcttagcagcatgagcaatatttgaaaccaacatggccacagtcataggccccactccacctggaactggagtaattacagaagccttctctttggcagactcaaactcaacatcaccaactaatcgttgaccggatttcttggtagaatcaggaacgtaattaataccgacgtcaataacaacagcaccaggtttcaaccattcacctttcacaaagtttgcttttccaatggcagcaacaacaatatcagagttcttgacgatgtctgcgatgttgggtgtacgagagtgacatatggtaacagtgcaattggccttattcaaaagttgggcaacaggagtgccaacaatgtcagatcttccaaggactacagcagacttaccacttaattcgactccagaggcttccaacagtttcatacagccgttgggagtacatggaaggaaagtaggatttccaccttttttagcaagttcacctacattgaatctgtcaaaaccgtcaacatctttcaagattgaaacgctgtttgtaatgtgagtttcgtcaatgtggcttggaagaggcaattgaaccaggatcccgtgaacagaactgtcgttgttgagtttatgaatgcggttgaccaaggttggctcggccgtgtcttcaggtaatttgataacattacagataattcccgattcacttgcagccttgagcttcatgcggacatatgcagaagaatcaggtctgttaccaacttgaatgatagtgacagcaggctggaactcaggatgagtggccttgaagacgttgatttcttcaaagaccttcgatcttatgctcttggcgagtttggtaccagacagaatctgagcctgggagaacacagccgaggcatgcagttgtcgagatctcagaaccaaatcgccagcgagccttctaacggtgctagctgctttatttctagatccaattcttgaaagcattctgacagtgtggatgcgtggcttccttccaaaaaatccttgcaagaccggaaaaaaattatcagagacaaacaggctcgaagagtatcccgatatggtaactcgatgagactcattgcaaggctgcgctagagcagccaagataaaggcttacaggatacgtgtgaacttggaaatggggaatggtaattgggggctaccagttgccaattagatacaagggctgaagctctttttgtttcagggattgcaaattaatagccagttttggcaatcaagtgactcgaaaaattagtgtcatgattaagattgtgaagctgataacctgccgaaaggctaaaaaaaagtagcaggactatgcccgaccatgccaggagaggctagtccacgggtaaaaaaggcgcacgaaaaaaagctgcgcgacccccttctagaatcgcgttatttccacctgctgggaagcgcactctcatccactctgttggaaaaaaaaacggtcgctcagaaggagaagcgagtgggggatgaacggatcggaaaaaacaaagcaatactttctaggccatcaacccgactaacacaattcatcacactacacaacatcaattgcctctcagctccaagatcaactaagttaggtaattcccaagtcttagtccattcatagcattcagcatcgtctacaaaagtttacagacgaaagtaaatgactctacctctcattgtgttatgtccaacagccaagaatctttaaaccgacatagtgaatttgaggaaccacttactacaatcaaacgaaagcattctggatcaacggcatcagtacaatcattcaagaaaatgaatccagatactgcggctacaagtttggtcaatttctctgaagaagaccaagtgctggcttcaaagctgcaagacacctacaagaatatcatcaaactagagaatacatgtcagagcaaatttgtcctcctaaagagcaagatggagcaacagaagaacatgtccccagagatcaatgatgaggcctggcatctctatgaacaggttatcaagctactggacatgtattatgactttctgttctacgccctatccccatcccagcttgcagacgatgggtccattgaaaacaaatctccagagtacataaacaggtccaccaaaacaggagagcagatagttttgatttataagattccgcggcgtatgtgggtctatggaatagtcaattttttggagattctaaaaacagcatatatcaattctttggttgattacgaaatcagtggatgcttcacctcctactgttttaatatattggcatgtctcaccgagttgtctagcgacatgactgcttggtggatagaaaaactagccgatctctcccgaatggctatcgccctgtatcccagcaggttcatcgactggaaactggccagtgaatattggtatgtaagagccatcaagctccaatatggccatggtaaggtatattatcacatgtgtaccgtacaagaagacagtctagatgctctgatcaatatcggcaaagctctcctgtgtagagatactttccaacccagtctctactatctttccatgatcttagagaatatacgcaagaaaagagacgtttcactttctaccaccttggaggatctaaccattagtgatttcgtcaagattcacaaattttttctggaatctatagacgcctccatcgagatgtatgtttcccattttgcacaaacttatgccatatccaaacctgatggttacgatttttttaaggacactcccgtttttgctccctacgccgaggatctactggtaaacgagcatatcatcttttggtttcaaaaatctggcggaatggcaatctgtaacatcaaccaactgattgggtttggaaatccaagaaatcccttcgcaaagctttttggtctacctgaagcatttatttccaaaagggaaaagaaggataaacgcaagagatccaaatcaacaaccatggatgaagacaatagtagcatcaacagtgaatcagatgcagtcatcacttccagagaaattacggacactgataattggttaaactacttcgataagtatttgatgagtggaagcattgagttgtctaacacgatgatcaaggactttacaaccggaccgtttgcttgtggccagccacacgtaattgtatggctctatttccttatatctgttaataaggctctacaggattttgagaatagttatttgaatggaactgtttccagcgatggtattagcatggatgatgaagatgacgatgccaattttgattctgtggaggaagaattacgtggtgccgaccaaattccatacagtaatagcaggtacaaagaagaagtcaaccggactaaaaccttatttgagtatttcattttcaagatcattccctgggatgagttggttagatatttgaacactagtttggatattgctcgtcaaacgatggaacttccacaattattttccactagtattgatgaatatggaccgatgttttcctcattttctgacctgcaggaaaatcttaatgctgtttcacaaggcttagaaaccttaccagaagcctggaaactttggggactaatctggtacgactttctagatgttaagacaacttacacacctttaaatccagcacctgttagtgaaaaggtatttgatcacccagtgaacggacctatattttctcacgaagatgaaaggattcgattgctacgtattgttgctcttgcaacctacctaagtgatcttcccggctcggggttaatcagagaaggtggtagtttctatacagctccaccatcaacctattggactaattatgagcaagagatgagagaaaaaggatacttcaaatcctttttcaatgagtcaactcaagaattctgtaatatagcagcatcctcactcgagactatcagacctgaaaagttacaaggctcggacaataataaatggtggctacccgttaggactgaaaagataatatctgcatatgaagatgcccgagatgaaggaagattatggaacatgcgattcaaagtttggaaagataaacgcaaaatcatttcccgcattgaaccctctacagcaggtgaagatgcagatatcgaactcacgtctggcgagatcaacgattacgatgatttaatgaacactatgcaggtaccagcgcaagttagtgctttgcaaggtgatctaggggaatgtatggacagtgcagtcaccatgattactctggataccaacatgtggcttaagcattgtggaatgatctacaaaagtgtggaatctagggttataaacgtatctattccattgaccgtgttccaagaactgagatctttgagagcatctcgtgaactggcgatctcagacagtgcaattagagcagtgataacgatcagacaactgtttacggagaacttgatcgtacctctgaaatttgatggctctccagcagatctcaatgatatctcagatttccaaaaactggaaacttggagagaaaatgctgatgagttaatcattggttctgttaagttgaacgatgagctccgtcgcaacataatatacacatcccgacctactctaaatggtatcaacggaactctttctgaagcagagtactaccagtaccgatacaatactcttatcacagatgatcgtaacatgcgattaagaggacgtgccaacggtatcatggcgttccaaagcttatggttgacattccatcttaagcgtatagcagatggcaggtgtatttgttgaacttggcgtcctaatagttaactagttacaccacactttccatctaaagtaaatatcaacattctcaagtagtgaaattgtgccctctttatcaaacagccgcaccatatgcggctccttgtccttcttcagccgtgcaatggcaccgcatggctcgtaatgacggggcaccaccaatagagtacgctggttatttattgtagcaatcgcactgtggctgtttataactgaaatattggtagctggtagacaatctgtgaggtcgttggtagtaaatgcaaactgatgggcatggcaccaactgttccttttggtaacatgggcagagacttgattcgtcagaaatcctctgttatcagagtcgggaagtaaagatgatgagtttatgacagtaaccgcggaactcccttttttatctttgatctgcttatatttgaatgagttcgtggagtcgggacttgtcgatttggttggtttgaagagtcgattatgatttgcagtaggtcttagcacattgttagtattacgggaatgaaaaaccagctgttttcccttcaatgtatcctttgatatgctgatctgttttttcggtttcttggagccatttcttcttgatttggtaggctttattagagagagatccataaggtataaaagcgttggggtacggtttttgtttactaggaacgtgtatattggtaagtgcacgatgaaatatgtatataaagtttcatcctgtcctaaaattttctcccctcccctatataacccttttctttctgatattgatttctagtcttgtttccgaaacgtattcactgtacaggagtgtaggaacacgttttatttggcagccgaaaaagaattacatgatatgatgatttaacttatgcatagttcaactgaattaaattgaagataaactgttaccatcaaatgtctttcacccctatctgacatgtaattcatttggttgccaaatattcgttcgtattattccggtttcagggcatacatacggattggatacaattctcttgggacacctttttgacggtctacactgatcaatttccaacctgcctcagcaaacagtcttctgaaatttgtgtctgaacgggtctttgagctgtctgtgtcatcaaacatatcttcatctgtagttgtattgttttcttttatcactaggagtccatccttctggatggctgtcttgcacttatttagccactccaaaaatgccgggtctgggagatgaccgcagcaccattgacaccatatcagagagtatcgagactcctctggtttccagtcttgcatgggaatttcataaatgtctcctatcttaccttgttccatcagtgtttgtagttccaccctcatctggtcgacaaatggtttaactggttccaataaatcaaccttatcacaaactttatgcagaaaatctcttgtcacgcggccaataccggcaccaaagtctataccatatttgattttgtcaggatcgttagagaaacgactctttaactttcttaaaaaggtcatcgatccaacaacatctgcttttggaaccgaagttgtctcaccgtacccacccaaaactccgtcgacagatgctgggacgctgttccagtatttcagggcatcgtcatagttgatcaaactgtccacctgtttagggtcatccccattatgttctgtcattgtggtaaaaatgggatacagtgatatattgaaggggaatggttataagagcctacctgagaaataaaattattatgcgccatccgacatccagaaaaattgatgaaagattggctattgttgacggttcttgatcccaaaaaaaaaaaaaacaagaaatgctgccgtcctagttttgcttcaaagaatggtttcgtgctatgccattcccaacccaaagagctgtcccatcccattaagttgtgctgactgattatgttgcacaatccagtgtcgtgattacctccaacatcgcacgcgaatttcgccatggctgggaaacccaaattcttcggtcgtccatcaaactctgaagtcatttcaacaccaaactcaacagctatcatagaaaaatatggcggggttgcgttttttagacattgcaagaccatttgtcagctggatcccggaagttgaacttccttatgaaaactgggggttcgatgaaaagctgatttactcatttttcactgctgccatctatttgattctgtccctgcctatatacggtgtcaaatcctctgaagtcgtggacccagttccccatttgcgttctgccttagggagtgagaagggaacattgctggagcttgggttactgcctgtgattacttcggcatttatcttgcagttgttggctggttggaaagttttcaaagtaaactttgatctggttagtgacagaatattgttccaaactttgcaaaagatcacttcagtcgttatcagcatcgtatatgctgttcttctcacattttgtgactactttactccaggtgtgtccactgataacgtcttgtggtcccaatttctgatcatcttacagatagtggtggtcaacttcttggttactctactcgttgaagtcattgacaaggattacggattttcttcaggagctctattgttgcttgcggtttattccgccaccaacttcgtttttggcacgattggtcttagcaccgtcaacacctccagatcgaacgaatctattggtgctctgattcaattattccgcaatttgagctctaaaccaattggtgttgccatatatgactccttcttcagagtaaaccttcctaacttgactcaattttatctggggattgccattatttgtgtttgtctgttcttgaataatgcaagatacgaagtaccaattaagccaaacaaggttcgtgccatggcctcagcttacccaatcaagctacttttcaatggttctttgccacttctgtacacgtggactgtgctgtacaacttgaaccttattggtttctttgtcttcaagcttaccaacttttctcttttagggaacttcaaagtggacccattcggcaacaactactacgaaattacatctggactgctgtatttattgactcctactttcaacgctgaagctggacttttacccaatgttgctaagccatttgttttcattgccttctatgttggtgttagcactttctttgctagatcgtggtccaacattaacgggtcgtcaggcaaggacattgccaagtttttcaaggctcaaggaatctcattgttaggaaaaagagatgcctctgtgtctaaagagtttaacaccctagttcctgttgcttctgcctctggagctttcctattgtcttttccagttgccgtcgctgagttattgggtggctctggtgttccaacctctatcggaatcggtcttttgagtggtttggctattttggaaactgttttgcaagaatggcaacagtctggaggtgcctcacagttctcccaatacttccagacttcttaggtttagaaatccttgaagactatccagacattcacccgcacctcaatttaccttctacatacatcacatattctatagaggagagttccattgctcgtactgaaccccacaccactcttctttataccctacaaactcttcgtccaactcaatggcgtcattcgtgtcggtatagacaataatggtaccccagtccatttcaaagttgtctttttcgatatccatgattaatttgggcattatttgaagttcgaactgttttcctggcactttagctttgatgatcgtttgatatatttcatccttggagttatacagtagtggctttcctcccaggtggtatcgtaaaacctgggaaggattgtgctcaactttttctgtaaatgcattgaaagtatcgtcatcatcaattgcttgcttgatatctgaccctttcagtttagcggacccttcagtctcgatctcagcatctaggaccgattcgtcaatctccatatttgcaggaaggttgaacttccttggtgaaagtgtctcctcttcgacatacaaaaaaaaggatggaaatgattcttgtgacgttttctccggttttgtagccgacgggggctggatggagcttatcgttgattctggctgactggtgactgtctttggagtgtctacttttccttttttgtcaaaagggttcccagatgaaaatgggtttgctgaagcaaatgggttggaatccaatgtgagttcgccaaaaagatctttgactggttctacaactcgttcttccgcttcctgctctacttggcttttattctcttccatcagtttgggatctttgcaaacaccccgtatagctctcacgctgccatttttcttactgcattcagctttgggacacatgaaaacatatataatcctatcgtagagctcatcttgaaaaggtgcaaacgcttggagtagaagggataactgacctccacagttcttgcaatttgttatttcagtaggtggtctaacgtccttgaaataacttggctggccccctacaaatatatcttcaaagctggtaggctcatcccctacaggctcgtcaatgaatcctagcagaaccattgtctgagtgagtctatgtgatggtactagttttcatcgtaccttaattttttctttcttatctgtagaaaggatgtaggatgtctgatttcgctgactccacattctaactctaccgtacaatctggtttccacttcaggagattaatcactctcttgtacccaattgatggaactcagtgcttgagagcatcagagtgtgtctaacgtatttgactgtcccaattgagtgcaagctacaggcttattcattgacctactgtattgaacgaattctttcgtattattcgtattccctcactaatccccagatatgtcagtcgttccgtaccaaaaggacctaagggtggtttggaagcatcctgattccagatccgtagttctctactccaaagagcatcagagcttccagtatatttctttagacagagttgatgaagtcaatggatcagatagtgactattttcacagtaaaaacggaagtaaccaacgaagaagatcatcgacagtatgtccgagatgtggctttaatatgagtagatcatctccagaatccatgttcaataacaactacttcaagctgcttgcaaacgttcaaagcaataaactatcagagcaagaaaaagatagccatatgaatttgctcaatagcgccataaagttcccatcctttaaattgaaccgatccacttttccggacaatctattcagtcagggctattttgcaaagttcttcacagaattagatgttttggggcatggtagtaacggggtggtgctcaaagttgaacatgtattgaatgattcatgtctcggggtatttgctctgaagaaaattagtattggagagaagctctccaaccttgaaaatgttctcaacgaggtcaagatattataccagttaaccaacgcagatgtgcaattaggaggcaacctggttagttataatcatgtctggctggaagttgatcaaccgactgatttcggcccaaaggtcccttgtgtgttcatcttatttgaatactgtgatggaggagatttggaaagcttcattgatcggcttaaacaccccaagctcgacatagaacaggagaaacaatatagaaggatggtaagaaagggactaactgcagaaagaggagtacacgagcctcggtctcttaacgacgtggagatttggaaactgttcaaagatattacaaatggtgttcaacaattgcattcttctcatatattacacagagacttaaagccatctaattgtctattaaaatacaggtatgaaaaggaggtcacccagttggatgagtataatgacattccaaaagtcatggtgagtgattttggagagggaacttttgacaatatcgaacgttcctcgtcaggatacaccggaaccttagagttcaccgctccagaagtgtttggctcgaactattcacgagctagtgatgtttattctctaggattgatcttatatttcttgtgtttcggtgaccttccgtataaaacacaggatataaaaagagaaattcaacaatacgctaaaggagaatcggacctctttacagaaattgatgttattaggaacgatatctccaaagattgggtcaaactgattcttgaatgttgctctttagacgcagataaacggccttcagcctcagaaatcttggcaaatttgaatactatttacttgcaattggaagccaaacaacaaaataaagaacatcctgagccagaagcatacggtatccaccctcctgattcgttcaactatccaaaatttcttgcagtgattgtaaatgtgttactactgaaggttcaacaaaacacattcaaaatggtaacatgtttcatcattggcctatcatttcacgttacaaccaaaaacatgatcatgctaagtgtgttgaatgcgcttttttcggtgctttcgattgtctatcttaacagcaactagactttttgcttttctgatccaaatccaaagtctcccgagactcgacaaaaataccgtcatctatgctatctacaatgtatttgaataattcgtcgactcctgtaccttcttttgcacttgtcttaaaatatggtaccttcaacctttcaaccgtttccgatatttgattgtcattctcattcttggataaatctgacttattgcccactagtagaatctgtatcttatgttcttctctgttgtatgcctctaattcggctatccagaactctgccttcgtcaagctggatatatctgtgaggtcaaatactattatggcaacagaagcatttctatagtacattggagccagggattggtaacgctcttgaccggcggtgtcccaaatctggaaattaattagcttcacctcgtttgtttctggatcagttacatagtatttcttgacaataaaggcagcacctatagtgctttctttatctgcatcaaaagcgtttgatgcaaatcgtgtaaccagggaagatttaccgaccgcagattcgccaagcaatactatcttgagatcggcctccttgcttgcaatgggagtgaaaagggactgtgaggaccttttattttgcacagacggtctagccattatggttgatgagttagttgtgtagggattgtttgataagatggatggggcacacgcgaaaacgtcgtaaaggtttgagtagtccaccagagatttgaagtagctctctgagatcaagcttatataagcattagcagttcctacaccctgttgttccctcgcgatcttttagtgataaggtaaggccctgtcctaacttgtacacttataacacggtaatgctaacaattgtccctaacaaaagcgttggaaacttccaattgggctccagtattacgcagataacaaaaattctccaacgcgagaaggagttcaacaacaccaatttcatcttctctcaatcgcagccaaatagactgcctatcgttatcgagttggagaacagaggtattcgtcttacctttgacccattcggccaaaaattgatactgatccagatcctgatgaataaaacgaaacaaagataccaattcaagggcaaagttcttccggaagatctgtatttcaaagaagtctacaacaggatctttggacccacctatcctggtaccatctataatccctcttcagagaacaactcggagggtcacgatggagaggagtcacagaaacagtgtcaattggggcctcagtatactctgtcatatgaagggatttgtttccagttcaatctttcacccgaattgagtcaaaaactaacatcctctgatgacaacgaggtggccatccaaaacgtagatgagcctcttctttgtcagggaataaacatatttcagggaaagacatgggcagaatatcttgagggtactgcattcatgttgcgacaaaagttgacggaagaacttttaactcaggagatagctaaactttcttctggattttctatcatctatgcattaataggtcccggcgaggttgaattcaagctcagtcagcatccaagagggctttcgagtttcaaaatagtgttaaccaaaacagaaatgagtgctgtggtagaaacttttgggccaccggacgattctgttctgaaagaagacaaagaccagtggaaaaaaattcacaactatttcagatacggctttgatgtcttctacgatgttggcaaaccattagcacctgtgcaaaaaattgtcattcacaataatgtcgttacttcctatgagttcttgaaatacgagaaattaacgtggttcatgtataaccaagtaaatcagcagctcatatgcgactgtcacacggagaaacataatcttcctttcaggtatgattctgctaatgatggtgatcaaatttaccacgatcacacccactccgatcataatcatcaggcgaagttaggtgggtatcaaaataatcatgcctcattgaatcagattaaaaagaaggatcatataatcctcaaccgcaaagagtatggattggacttttcagaccagaatagctccagatttgagctagtggattatgatgatcaattggagtgccagatgaactcaaatatggaacccaccggtaacgattggggactgagtaaattgtttggatacaatcggtacgtatttgagattctggttgatagtggagttatgagcagtatcacattgttctaattcattcatctacaactcactggatgcctatcctctgtaactcccaagaggtacttgctgctgttgagtattcttagacaacagtatccttcaccttcaagtcctgcttccttcaattcccaggttatagtagtgatagcagttgtaaaagtttgtctatctgtctcatagcaccgtataatacaggtatttcgttcgttgtgtaagatatcaaagtgtaagctttggcctaggagaccgtacaagttaagagcatgtgagacaagtagcttccaggtgatcaaatcaactgtagcgttggtctggggtatttgtaatctaaagtagaaccagtcatgagacaagtttaacttccacggggacataaataacaaactggtgttcaaattgatagagattttctcaagagctcaaacatgaaaaaaaaaaatcagatagaaaactgagaaaacaaaaaaaaaatcctactgaacaggatcaaaatacgcagatagaagattcacagaatgacagaaaaaggaccttctcaaggcgatttgaggaaaaagttggcatctctgcaagaggagtcaacctactggagcaacatcataggaacaattcaaaagtcatcatcgacaaaggatatccaacccaccacattggaggatcctgtcaatgaattagtcaaagtgagtaaactattgcacaacgaatccaccaaaatgggattggtattcaaagcccctttacaatccggtccggcttatcgtcaaacagagaagtttggagaaacacagatactgatggtatccatagcgtctcagctgaattccctgcagagcagagaaaaactctcaaatctgtttgtcgacgctgtgctatcaggaatagaaaaatgtttagttttgacctctgagatatcgtcagaatatcagaaactgggggaatccagtgtgaatgaacacgtggaagacgatacaagactggctcccgttgcaaaactttgggaagccattgatgggctgaagagtgtctgtgagcaaggaagtccatttttgttaaaggaaacaagtaaccaatctaaaaggttgataaaggatgcattggaggaatttgaggaatggattgaagatccaagttctttcagtggtgatccgtttggtatcgacgaggctgatgacgaagaagaggtcattgtagatggaaagctgctagaaaaagcaagttatttcagagataagttcaagctgatcatgcttctcttgaaccctttgtctgtcaaatcttacacatttctaacaggacaggagatcgacaagttggctaacaaccaaagaaagttgagctattttgtcgacgaaattgtaatcagcttaaccatgaaccaagattctgaagaaagcagtgctctgtatcaagatctagagacagagtgtgggaaactgtttgaattggtcttgcggtgctgtggaaacgacgacaagaaaataaagtggttcaccgtctggaaagagaagttcgacgcgaagaattagcagaagagcagagttggcaagagaaactaatcgtaataatgaaaggagaggggataactgggataccttcccttatatagatggaagttccccatactttagtccatatagccgggtaattttgggtctagtgaggcttcgcgaatctagatatccaggtctcgtaggtgctctttcaaagaggacgttttacttcaacttctagtcaatcaagtttgtttccatgggaatcctgactaactcagataaggagatcgtgaagcgatcaattccaggggcctccaataagatcattgattgcacggttgcgaggctttacattgcgtaccctgaacctaacgaatggaccttcacaggtttatcaggcgcagtggccttcgtagatgatttggtgggccacacctttttcctgaaactggttgacataaagggacagagaggtgtcatatgggatcaagagctttatgtaaattttgagtataaccaagatcggtcctttttccacacttttgaattagaagattgttacgctggattactattcgaagatatcaaagatgcttctcattttcacaaacgggttgctcaaaggcagaagcatggatccaagaagacgcttcaaaacaagaacgctatagcgctgaaaaatcgaattgagcctaccaagattgttggaccccgtggagatattggtaccaccacagctgatgattatactactcaacaaagatcaagacatgcaaaaggagttatctactacgaagatcaacctccccctgaatggcgttcattatataacgaacttgctaatgctggtattacagaagatatgatcgccgagaatagacaattcatcaaggattatatcaaacagcaaggaggtcctttggtcggtctggaaccaccaattcccagaaagtatcaacggtctgcccaatccaagacccatgaaagtaatacatcttcaatcaagaaatcgaagaaggcgcctccgcctcccccgccccctctatctcgagatcctactgggtcaccaactcccgctcccaatgatgatgagtataattttgcaccgccttctaatttccagagatcattaccgccaaagatatctccccctcctcatgtgcctacgccggatatctcctctgaaattagtcgtgagagttcggtaccagcttccgttactcctccagaatctcatgagcaccacaatgaaaatactgccgttccaaaggctgaaccaccaaagcgggtattcagagctcctcctccgatggcgtttataggacaacaagcaaacggacctccaccttcttctcttaccgccgctcgccctgctgggccacagttttcttatggttcaaccccaagcaatcccaatctgcaaagagagggggttcctcgtcctccaggtaatcaagctccacagagaaatgcggtacctcctcctcctccctcaaggaacaatgtgcctcctccgttcgtgcctcagcctggatcaccaatgggcaatagccctggtcctggtggaggaagacaggttccaccaccacctccccctcgagctacagggaaccgagttcctccgccagcacctcagccaagacgttccaatgctccccctccacctccatctaggaatgcagttcctccgccgccacgggctaacactcagcatactccgcaatatggagaacaacaacctggtgcctttattccccagactgcttttgaacaaccacagcgtagcgtaccacctaccccagcatcaagctttggtcaaccaggtgcatctgcacctccaccgcttccgccaatgcaccctcaaggtagtactggtagtggtccccctcctgctcctccaatgcctccacaggtcagttccaacggacctcccccaccgccacctcctcctccacagatgtcaacgggcggtggacctccaccccctccgcttccaccacaaaacggctcttctgatgctccacaagcttcattgcctcctgtgagtggtgatcgaagtgctctattgagctccatccaaagcgcaggtctttccagtttaagaaagactgataaaagcaagctagaaaagccatcggttttacttcaggaagccagaggtgaagtccctcctcctactacaactgcaaatactgcgccaacgcccggccaacctgcatctttggccgatgctctagcagcagctttaaacaatagaaaacaaaaagtagctcgaagtgatgacgaagacgacggtgaagattggtaacataaacaaagcagaatccactcaggtgataatacatattaagaacgcataaaatgatatttactactactagttttgaccagcccagtatgcatctcggcccaatagtgccagagctgcaattccgtattgtgcggtaatattggtagtgatccatccgcaagcagcagactgtttgttgactgtttcagacgtatcgagcttttctgtagtccattgttttcccttgtactcggtttcatcagtcaaagtgaaaaattgattccaagcttccttctgcaaagactcatcgtttgttaaaacactcgaatgagagattaacctggcatgcccctgtcgaagaattttatctccgaagctgaacccgtaaagttcaagctgtttctcttctccgccgttgtaggccaaactgtaacgaatccactctcgtttcacagcttcaatcaagtcgtcattctggaagtttataaataattcactcagtatttctgttaaaccaaatactgatgaaagatgggatatagcatatggcgccaatggcaaagaaggtttggttatttgaccattatccaagttcattagaacagtgccagtcgcaaagccataatctaatacctcaaacgtcttgagaaaccctttaataagcttctccgacctctgccaaccggaagaacgacgctcatagttagtgaaccatgccgatgctaaggctgtaaaatctgttcctatatttaccagcacatgtctagggggtagtacgtctggagcctttctcacttttctatgagagtcaagcacggttagagaattttgtgagtcgatcagttcttgcataagctcaccagtacgttcgtcgcctccactcaaatagaagaaaaatctgcggtataaagcgttggagattctgagctgtttgcaactgtctccaaaatgctgcacgccgtgcctggtgcctagacccttccattttccactatggtagacatcaacttcaccggtgtgtctagtcatggctttcgcaacatcccagacccgtatatcctgagtacgtaaaaagtatagccacaaccaaaggtcagttgataattctgagttgtcccaagcataacctccaacatcatatctccagcaatgtcggtccgcatcataagtatgcatcacgtccccaaagtcccaaaatccataccaactgttctctttaatctgagcttcataataatcaaagaggaactcgagattggaatcgacaccagaagcatcagctcctggggctatgtgcggacctggtgcccagtagtcagcaaacactctagtcttgaaaatatgttgagcctcaggaacaattagatttgttgcccttacagtgtttgagaatttctgaaactctttttttgaaggagttgactttggagtccaaagttggaactcgtgggttttagcaatcccgtaagggtcgcagaaacctggctcccaatcttcgtaggtgatcttcattgcatccaattgctcttcataagtaggcaaatccaagttttgataaggccttaaatccataggttcactgtcgggcgaatacaaccaaagagtcagagttgctaggtttaagtctaagttggcaacttctaggcccacgggatattgctcccagaaatttttcagaccgattcctaaccctcgtttagacgaaccgacaaaagcagttccatcactcttcgttcctgaagatattttaacccaagagttcttttcggaaactctttttttcagttcaaacccatagggcgataactgagagagtttaaaatcattccaacgtacgacgtacttcaagagatccttccactcatagtcccagtctgcaatgtctgggagcctttctcccaatacttgtccttttgaaatggcttttggtaccggtttccaaagaccagtaaggttttgagaggcttcagcaagtactccaccttctgaaccaccgagtcttacatatttattaaatggctgcgaagtacccaggtcaatgtcaaatgaaatacctaaacttttcaatctgaggccttcaggaagctggtacaagaatgtatgttgtgcggctatgacatcagaatgcagaccaatataaaaacgaagctgatacggaacctgcgtagggactttattagcaatcacatgagcaccagtgacaaggaccacaatctgaacgtgagatcgtgactctatttccacagataggactttggaatctacgctgatttgcgtgtttgctgactcatcgattacttgcaaatgactacggccattgtagactgtatcgtttaggttcttgataacgcaatcatcaccagcatttccgaactcaactcgcaggttaggggtttcaatagccacattttttgtttcgggaattgaaaaaactgcagttgtgtcctgatgcgtcgtctccttgagtcccaaagacaagtcaccacttagtgttccatcgtcaagagtggagtgagcagaccatttgatggaaccatccggccaatatgcgagaggttttgagctcaaggcccgtgggcttgaagcagatgcaatttgtagtcgatccaaatcattctcatgaagttcgcctaatctccacgggacaccgaacgacaagacatgaggcaacgtttcgagatgagattttttatggcaaagcttaaccatccgtccctctttttcttagaataacctaaaagtgaagctatgcaagagcggaaaaatggtgggaaaatatcagtagtggtacgggtggtcacacaatgggagctgattagtgattggcaactcgattactcatgaaccccttcctttgtagtctgacgacaatcaaatctgtggctcatcttaatgcgtaatctaagttgagatgcagatattgcttgtttctcgtgcataataaaaagccacggtaccaattcaaggtggtatgtcccaactttttctccgtcatttaagtgtttccaccattttcaaaggggtgtttccaccattatcagtctaaaagattgcaagccataatgatgttataattggcctgaagtgagtgcttcttcgtcttcctatggttttcaaacccccctatggttgatatataactggagctttgttatggggtagaaaaatcttctgcaaggcatgtctgacaacgaaaagaaagcggttcaagaaccagacacttactcgatcgggagtaattccacttcgactgctcttgagagcgggcacgccgtgaatcacgaaaatatcaagaagaaagtaggagcagtttccaaagactttgctggtgtaactatccgagaagattctgcggagaaaagaccagatattccacctctgggtgaacctttggtcagaaacgcttacaaaactagttttggtgcatttttcagcaggaaaacaaaaactgaacccgatgccatcgctacacagccatctgcctttgatgatccagatgtcgctgatgtttactatccaaagccaacctatcaagattatcacagatttgaccctctcgctcgttggacttggagagaagagacaaaaattgttaagaaactggataggaccattctggttctggtatgcgttctattcttcagtttggctctggatcgttctaatatcagtcaggctaactctgctggtttcttgactgatcttgggttgactaccgatgatttcaacgttgggtcaaatctgttcaatgctgctttcattatcacagaaattccgtcccaaatgatcggtaagaggattggtcctgatcgttgggtccccattcaagtttgtgcttggagtatcgcttctggtgcccaattttggatttctggtaagaagagtttctttgctttgagattcctgactggtctcttggaaggtggtttcattccagacattatgctgtatctttcctatttttacacaagaactgaactcccggtccgggttggtgttttctactgtgcaaatgctttcagtggtattctcggttctttgattgccattggtcttttgaaaatcaattcgtttggccactatggatggcagtatctcttcttgattgaaggttgtattactctcattatcggtatcgctgctttctttatcatggtgcagggtcccacacagaccaaatccaagttattccctaagggatggttttcagagagagaagaaactataatggtaaaccggttgttgcgggatgacccctctaagagtgatatgcacaatagacagtctgttacgccaaaagaactgtggaaagtgttgggagactacgatctatggcctatatacgcattggccatggtattttccattccccagataccgataaagagataccttactcttactttgagggcattagagttcactaccactgagatcaatctcttaacaatccctgcttcgtttctggcgggaatcatgtcaattgctatttcattagtcagtgagttcttcaatgaaggtttgattatcggtatattgtgtcaattctggttgcttattatggttatcattgaatacacctctgtggaaaagatatctccctggggacaatatgtgttgcaactgttcgttgttggtgccccagtcccccaaccggtactaatcggtctatgttcccgtaactcatattcggttagaactagaacaataagtgcatcattgttcaacattgtggttcaattgtcgaacattgctggtgcttatatctacagggaagacgataagcctttgtacaagagaggtaacagacagttaattggtatttctttgggagtcgttgccctctacgttgtctccaagacatactacattctgagaaacagatggaagactcaaaaatgggagaagcttagtgaagaagagaaagttgcctacttggacagagctgagaaggagaacctgggttctaagaggctggactttttgttcgagagttaaactgcataattttttctaagtaaatttcatagttatgaaatttctgcagcttagtgtttactgcatcgtttactgcatcaccctgtaaataatgtgagcttttttccttccattgcttggtatcttccttgctgctgtttatgagaatacggtcgaacgtgttgctccttagcacagcgggagccttagccttagtctggtttgcggtagtgttttcctgggacgacaagagtatttttggaatccccacaccaggccatgccgtggcctctgcttacgacagttcggttaccttggggactttcaatgacatggaggttgactcttatgtcaccaacatctatgataatgctccagtgctaggttgttacgatttgtcttatcatggcttgttgaaagttagtcctaagcatgaaatactttgcgatatgaaatttataagagcccgagtcttggagaccgaagcttatgctgctttgaaggatttagagcacaagaaattgactgaagaagaaaaaattgagaaacattggtttacgttttatggtagttcagtatttctgcccgaccacgacgtgcattacttggttcgacgggtggtcttttcaggagaaggaaaagcaaatagaccaataacgtctattctggttgctcaaatatacgataaaaactggaacgaactgaatggccattttctgaacgttctgaatccaaatactggaaagctccagcaccatgcatttccgcaagttctgcctattgcagtaaattgggacagaaatagcaagtatcgtggacaggaagatcctagagttgttttgagaaggggtcgttttggtcctgatcctttggtgatgttcaacactttgacgcaaaataataaacttagaagacttttcactatctctccatttgaccaatacaaaacagtcatgtacagaactaacgcctttaagatgcagaccactgaaaagaattgggtcccatttttcttgaaagacgaccaggaatctgtccattttgtttactcgttcaatcctctgagagtactcaactgcagtcttgataacggtgcatgtgatgttctatttgagttaccacatgattttggcatgtcttccgagctacgtggtgccactcctatgctcaatcttcctcaggcaatcccgatggcagacgacaaagaaatttgggtttcattcccaagaacgagaatatcagattgcgggtgttctgaaacaatgtacaggccaatgttaatgctttttgttagagaaggaacaaacttttttgctgagcttctctcctcttctattgattttggtttggaggttataccgtataccggagacggattaccatgcagttcaggccagtctgttttaattcccaatagtattgataactgggaggttacgggtagcaatggagaagatattttgtcattgacatttagtgaggcggataaaagtacctctgtggttcacatcagaggattatacaaatacctgtctgaattggacggttatggaggtccagaagcggaagatgaacacaattttcaacgtatccttagtgatttgcattttgacggtaagaaaacgatagaaaacttcaaaaaagtacaatcatgtgcattggatgctgccaaagcctattgtaaagaatatggtgtcactcgtggggaggaagatagactaaagaacaaagagaaggaaaggaaaatagaagaaaaaagaaagaaggaggaagagaggaagaagaaggaagaggaaaagaagaagaaggaagaagaggaaaagaagaaaaaggaagaggaagaggaagaggaaaagaggcttaaagaattgaaaaagaagcttaaagaactacaagaagagcttgaaaagcagaaagatgaagtgaaggatacaaaggcgaagtaggagacggaaaacggagaaaggagaacggagaacgaagaacgaagggagagagaagcaaagggaagagcaaggtattctggagagattaagaaaatagtagaatagatttaacgaaactgaaactgaaagaccgaaaaaagaatgcagaaattaaacaccatagggcagattgattccgtaatcggtttcttgctactatatctttctaggctgtctataatccttttataatttaatctgctaatatcgctgtcacgattattgacatcgactgtatttcaacacacaggtcttacagatagcatggggtttccagtatttgattgacatttccgtttttgcatagtccataatataaggatcaaaaacatgagatgtcgcaaggcctcttaaacatgaaatctccgtttaccttccgccatacaaccttacgcatacagcagctcggtttctacatagagtcttttcaagaaccggggtaaaaaccgttttacatagaaagaggtaaaacgttgtgatcatgtgaccgctgaacatctccggaaccaacacttcgcgatcttttttcgtctgtcacatactcaaggtaaactaagtttcacaacacgaaggctccgtatcataaatcctcagagttgaagcactggcccccatctaataaatactccgaaatgagtcaaatccagtcaagccaagtgggggcgaaaaatatgcaaaccgcacagcctcaggctcaacaaagaccaatcaatgggtctgtgaccctgagcaatggccagaggataaaccctcagaacttgactccacaacaacaaagattattgcaacagaaagtactgcatcagaaactcaaaaattacaaatttgccgaaacgagtgaggagatacttcacaagtacgaaaaattccctccctctttgacttttcacatccacgaaaatcattatagatttggcgatcaggatggggtcataccaaaaaactcaagtgttattaaggctttcctggagtatgttgcacgagaggaaataccaccggcgttgatagaggtaaccaaggatgctggtgttcaactatatgaagggtgtatcatactcagaatatatgaccatagacacttggtcgcccatatcaatgatgcaaaagattctcaacacgtaagttcagaatcgtccgctaacaacacaaataatgaaaagaaagaaccctcaaaagttcctaagacttacacaactattctcagaccaacgcagttgtcattatatgctgatttgttgtaccaaactgattatttacaagttagatttacagactctttgtctttgaatattgaaacggaaatcctaacagcctcaaaaagaaatcttgacctttctgttcctttgaaccctcacagagccacggctaatttgaaaccagaggtaaagtatccttattacgaccctgagacggataccgtggtgcatgaacacaggccagatgctcgtggtaacatggtgaatgcagacactgttgactacaggaaattgcatgaggatatggcgcagcatggctctgactatgagaggttaatgctactgttgagtgatagattcgatgacgactcccagacacagggttcctctgtcacctccagccagttcatgaggctgaggtttgtagaagcttggaggaaaaaggaagaacgtcttcaagaatccggaggctctagtcaacgtcagagaccccttcaacctggccagattccggggatgttgtcaagctttagtagtaatacaggaaacatgaatacaatgttggacaacttaacaccacagcagaaagctgctattcaacaaagaatgatccagcaaggaagagctcagccacagcagcagcagccagaccaagagcaactacaagagcagcaacaacaacaaccgcaacaggccatgtcacaacaacgtcagcagcaattacagcaattgtatcaacggcagcaacaacataatcagcatcaccagcaaaaccaagatgaactcagttctttggatgacaagaagataaaaaaacctccagctaaaaagcaaaagaaaatgaccaaaaaggaaatgactacacttcatcaaaacgtagcggggaaaactatcccttcagctgaaagtactccgcccacaacagcagccaacaagaaaagaggcacctacaagaaaaaaaatagtacatcctaataataaatgattagattaagtgcgtacgctagggtatagttactctatcgtccctccttccgaagatagagagtagaacagagattctttgttcttaagcagatttgctggagtatcaaattcagcaattctaccattgtctagaactatgattctgtcactgtccataatagtgttcaacctatgggcaatggtcaaaatggttcggtctttaaactcttttcggatagtttcttgcaaaacttgatcagtttctacatcaacggcagcagtagcctcgtccaggaccaaaatgtgagacttgatcaagagggcacgagcaaggcaaatcaattgtctttgaccgactgataaattagatccaccttcagcaagacggacttctaaccctgtagcatcgccttcggccatggatatcaccaaaggcttcaaatgtgccagctctatagctttccaaatctcgtcatcactatactgattcgtagggtcaagattttctctcaaagttcctgcaaatacctgggaatcttggggaataatagataacttatgtctcaaatcttccagaccaatcttgctggtatcaattccatcgatccaaatactaccttgggcagcttcaattattctaaaaagggcaagcgtcaaagacgattttccagcaccagttcttccaacaattccaattttctccttcggatttatggaaacattaatgtctttcagaaccaagtctagtccttctctgtatctagtagaatagttcttgaattcaatctttccttcaaaaggccaatctttgggtggtctattgtcctcaatgatagctggagcctctgatttcaaagtggagtattctataatacgctccacagacacaatatttgtttcaacttcaacggtcattcttacaatccaatttaaagactgagttatttgcaaagcataactgaccgaaagaccaaccataccagcagtaataccgccagactttaaggtaaaaatagaaagaccggatgctccaagaatgataactgatcctaagaattccaaacgaacagccaaccatctgttagcactgatagctgggtgataggcactaatattaaaatcaaccttagattggttcatgtatctgaatctatccaattggttgtaggctctaatggtagaagttcctgtcaatgtttcttggaaatgggcaaaaattggagatcttgaaacggaatctagtcttctcaattctctagatgttctcaaataatattgctggtagtaaacatacagcataagaattggtagaatcatgaaaataaactgccatgtagagtagcaaatcacggctactgtaaaaaatactttgacggcattagtgaaaaattgttcgaaaactctaccgagtatctcatccactttgtaaatatcacttgagaaacggttcaagatacgaccaataggggttgtctcaaaaaactccataggagctctgaaaacactgtcagtcatcgttttgtggagatacttggatccagagattgtgcagtagatccactgcatagcggtctttagcagggagagaagagaagaagcaattcccaaagcaaagtagattcctaagtatagtgcaatgttcgggttgccaccatactcagtgttcacttcagaccaatgcttcagccaaatatttccaaggacactagtaaacattgcaaggataatgaggaacagcaagaagcaaacagcctttgggttgcaagcatttgcgtaaactttgtaaacgttaaacttcacttggccttgctcatgatgttccttgtttatcttttgtttgctttcttcatctaaattgttggatgtagatttggaaaacgattctaaactagctctcctcaaactaactgtgtcagaaacagattttgaaattcccagttgcgacggcactggcgtgacttcagcagtcgaattggtgccactattatctgtcgaagatgctgctttgctaaactccttaattaaaacgcttaacttggaggaagagttagagacaacggtctgataatttccctcttcaataatcgaaccttcctgaatcagagaaacgtggctagagtgtttgagtacgtttatgttgttagttgccaaaatacgacatttgctgctcaacagaccactgggacccaggacatgcgtagttatgtgcttgccaacatgctcatcgacagcagacaaaacatcatccattaagtagacgtctgctcttgcgtaaacagctctggccagtgatagtctagccttttgcccgcctgacaaagatatacctttttcaccaacctgagtagcatctccgtcagttaaaatgctcagatcagtatccaacgcacatgcttcaagtgtcttcttatagaattcaggctcgtacttgcaaccaaataaaatattctccttgatagacccattcattatccaaggaacttgagacacataggcaactgaacctctaataataacagttccctctgacttgtacaaatcacccagaattgatcgaatcaaactagatttaccagcaccaactttgccaacaatacaactgagctccccctttctggctgcaaagtttacatctttcaaagcaaccttatagggctctctacaccataaaaactgaccactctttattctaaccacagtctctccaactttcttagaccttgggaggcgtataacagagtcattttgaagttcacttcccgtcagaaatttagttaaacgggagatagcaacttgagcctccacgattgaagtgataaccattggaataactgccagtggaaaagaaagcaagttgaacagagccaatgcagggaaaacaatatctgtagttagtggggagttcttgttagtcaacacgaacaccgcaaaagtagagcagctgaccaaaaatggagcacagctccaggtgaacgttgaaaatgcttgaaaaattcccatcttcttcaaattcttcaactctttttcatttctaacgtaagtcaatcgttctttataaggagattcccacccgtaaagttttaaagacttgatgttgttcaaaatctcagaaacaatacgagttctctggtctttatttttcatttgaatcttctgtaacttcttttgatactttgctagcgctccgttcaaaggtatcatgataatcataataacaactcccatccacatggagttgcccaccagaccgtgcaaagaaaacaaacacaggattatctgaaaagggcccgaccaaatgatctgaatgttttgtacaaggtcttgtagacgttgagtatcgactgacatgagattgacaatatcaccggtcgcatatttgcttttctcttcgtttgacaaggttaaagatttggagtaaatactggaagtcaaggctgtcttgatcttcattcccatgtcaaaagctctctggaagtactgatgcaagcaaccagtttgcacaatagagaccaaaaacatacttataacaatcatgaagcctttggttaagggaacagtaccattgccgtcgttgtagtcatttacaaacttgatcaaaattctcagcaactgtggctgagtaaatgcaagaatatcctggcatgccttgaaaatacctccaaccaagaaaggggccccgaatgactttgccagcgcccaggttaaagagagttggtctttctttgtcctgagttgatgtgtccaattgtaattgaatttctctgaggtcatcttagccgttagatacttaggaaggggtgggagatcatcttcgcccaaaaaggattcatggccctttttcatcaatccggacatccattggaaagtaatacgagaaaatacgtgagctgtatcgaagggagacaagggatagaaaatttcataaccagcaggtgaggcaggcctgatcggaaatgcagactccaaaatcaacaatatcagggctatcacaatggtgaaaacggtggtcactaacgtggggtttgcataattggagcgtacaatcaggtttcccaggttgaagcatccggatacaaaagtgaacaaccaatagaatagcagggagcccagggggacacttgtcttgaagacctcaacgtaatgagcaaacaaagccacgatcaatgccaccgaactgaaaactggagtgacaaacttgatgtcatgcttgaagtccacgctttcgtagaagtaattagccgctaggttgacgttgaggatgatctgaaaactgatcaagactagcttcaggggtagcgtccaatcaatgttcgtattcgtggtcctagaccttctcagtgcaactaactggtacccgcccaccaagaccagaaagagggaagagaagttgatcaatgcaccgttgataaaacaggttgtaaggtcagagtaaggtgacatgggaccccaaccttcctcatcgaaacatccccaagaacatgtcactggaagagattcattctgcaaagatcctgagttcagacccgaagatggcaggatattcattgaggtctgttcaaacagatgttgaacagagtccgcaataaaatcaagagagttcatcgttggttgagagagaagatgttaattcttactaattaaatttattacatttttcattacaacttgtgaggcgcgaaccaaatgacgaaacctttcgggtttcttggatgtgctcctccagaaagagcttcgaaggaattgcagagaaatgggcagagaaaaggactgtattcgtggggatgcccaactatttgctgttcgacgttaaactgtctaaaattttctagattttaaccggatgatttcattccaacactacgaccgtaacagttttatctctttgatgacagcgacgaacctctgattcgtggaatactctttttcaaatacatccagccaagtaggctccgccgaatcaaccttctgtgcagaaatacttgttccataagctgtcaataacctgtatctggcctcttcgtcgttaattgacttggcaaaagaggatatagcccgtaatattggtccctgtaaagcaagttcattaaacttcgccgttaaaacagcaaaattcaatagcatggtagccaattcgatctgaacgttcttcttctcgaagtaagagctatcgaactcatacgatgacaactcattgataagagtctcatctcttaataacgactctccccaatatctgttctggaaaatgctgttcaagcatctcaaagttagcatgaacgtattaggggccttgtcaaccttcaaaccggtgttgataaggtcaaaaagattgtcaggtggggtaggtacattcgctatgatagaacccagtaagtccagaccaaccagtttcgaattattatcccacttttggataatttgtgttgcgtaggttagtacaacattccggttaacacctccaccactcagagcttgtctaatctcgtcaatttgtgtagcagtcagttgcccttgcttctgagtcgtattcagctttgtaactcccttgatcaatgcttcagtcgaggagaatttgactggcaaatattctttgattggaaagatcttgagactagatctgttaattgatgactcctccaaaggatcctttgatcccagctccacacctttggtattgctaagaatgaatttaacaatctggtcagcataagtagctggtagatcattatcagccaaaaacctcgcagctgcagtaaacggattttcacttacattgtaaggaagtttcaaaggtggggctccttcctgaacatcaatatcgaagatatagtcccattcttttccctgataggttttcttagtgtcattgcctgatcctccaactactgttccaattttcacccacttaccatctgtaaaactataagcctctaccactccaacaggacttttcaccataattgtttggccttctttccctggcgttttgagagcttcatatgacggaagcttttctttgttaatgttgtccatggtggattcactgatggcagaattggctagaagctcttcaaattcagcaattgcttcttctgaagcctgccttgcaggatcttccgaaaaaactctaatattaccgtcggatcctgccagtacaatgtcgccgttaggtaggacagacagatcccacacagaaacacaaggtagattgattacctgttgacattgatgatcactccatatccggcaacttctgtcctccccacaactcactaaatcaccatttggtaaaactcctagagagtatataaaactttcgtggccggtgagtatattagttggtctgggatcgttgtagtcgtagatcctgattgtagcatcgttggagcaactggcaaatccattggctagcggcaataatgctctgacaacatctgtgtgtcccgtgaaagtttggatcaccttgtctcctttccacttcttaaccgtcttatcggcggagcaagtaagaaattcatgattaacggcatcaatgatcttgacatcccaaacagaggcagaatgtcccttcaaattatataaaaccgaaccatcttgccagactttagctgtagtatcccaggacccactaataatcaaggggcccttggagtcgagagaacatacgtttgcctcatgtccgatcaacacggatactggatcttcttcttgagtgctataaggagcagtgagatcaatcagttggttcttacccccagaaataatcaattccaggccatcgtcctggaaataggctaaactattgatgaaaccagtagaacgatggtttatgatcccgtcattccattggttctctgaattttcagccttattccacactctaacagtctgatctcttgatgcggacacaattgtctcatttgaaggagatatcactgcccgaacatcctgttcatggccctttaaagatgcagatagcttgaaggacatggtggcgtagaagcttggaaagatcccagattgaactgcgcgatgacacctccgcctagcatatggcgcgattagaaggaactgcttagtttgaagatcaacaaacattgcggaatcgacgataatgagtgaacctttgattcttggagagtcaggaaaagattatgttgtctataaggcgtcgtccgatgatacagctattcgatttacagtatccgggctttctgtggagaaaaaatcagacattaaaagctccactcaagagttacgatctattgctggaattgtaggtgtcctgagactcagcagcaacacctatctggtaaccatagacggaggaagtgaatgtggtactatcaagggatcaaaagtttacaggatggttggtttctccttttggccaatttctcataaagttcaggtcgaagatgacgctaagtacttggaattggtaagaggtcatctgaagaatgccagcctctacttctcctatggctacgatctgaccaactcaatgcaacgacaaactttgaatggggattctgatggtttgttgggccctgatgagcgattcttttggaaccgtttcttaagtgaaccgctcattagcctcagtaaagaatacagtcaagtaaaaagtttcgtactgccccttatttatgggtatgccaatgttatttctaccagtattaatgggagtccagtttcttttggtttgattacccgaagatccactcaaagggcaggaaccagatatttccgtcgtgggattgactctcagggacatgccgccaatttcaatgaaactgagcaaatactgatagttccagaaggtactaagactcattatttttcgtttttacaaacaaggggatctgttcctgtttcttgggctgaagtgaacaatttgagatacaaaccgagcttattcatcggcacctctaacttaccgagtacccggttgcactttgatgaacaaatctccgaatacggtacaaattatttagtaaacttagttgaccaaaagggttatgagttacctgtcaagaatgcttatgaaggggccgttaataatttgggggactcatcattaaagtatatctattttgatttccaccaccgatgtcgaaagatgcaatggcacaacgtgaagctccttcttggagaattggctcaattgggtttttctactgatgattacttccatgccattgtagacgatggaaaactaagtgtggtaaaaaagcaatcctctgtgattagaaccaactgtatggattgtctagatagaaccaacgtggtacagtcaatgatctccagaagtgttttacaatctcaactagcttcaagccacgttgtcaaagaaattgaacagtgggaacaagataaagctttcaattttgaatttcagaacttctgggcggacaatgccgatgccgtctccctttcttactctggtacaggagcattgaaaactgactacacaagaacaggaaaacgaaccaccattggagctttgtatgatttgtccaactctattaccagatatatcaagaataactacaaggatggaccccgccaagatggatacgacctctttttgggcaactttttaccctatgaggcaatttctagtccattcacagatggccgaccactccaagtgcaatatgccccttacgtgttgattgtctctctttcattgtttgccctgacactattctatcccaggggaccactcttcgcatggcacaatctcaagtttttgggcctttgtttgacttttggaggtctcagtgggctctatattgttaagaatggctaccagtacgttaattggccgcaattatgtgatctagactacttggtaaaacagagaaagggtaacaattatctctttgagaagaatcctgactttggcgacgccaatgtcttgaagaaagattagagagactacagttagaattatatgtgttttcttttcgttataccctcaaatttgcagtagatgggggtgggcaggtctggtccattttccaatgttcatgaatcttgaaccccaggtgcgtacggagtatgcggggcgtaaagtggatcttgacttctcgttcgcgccatgtttgcggcttgctcctatatgccatccgtcatcatcgtccagagaaaacatcgctcgctcatcgtcatttcaccaaactcctagcaatgacttcattagaaaagtcattagatgaaatcattggcgaatccaaagatgctcgccctcccaagggtccaagaggttctcgggaccgtggcagctccaaatccaacagagtaggcaaagggacaccccgttcttcaagagtttcacgagcaaagagagggcctcctcctccaaggacaaatccagaggctgaacgattggccgatggcagggattatttgaggcttaagaacttgaattttcaaatcacagagaaagacttgcatcaactttttgagcgaattgctcctgttctttttgtccatttggatatcaaccctcacactggagacccaactggcgttggatatttgtgttatgaggaaccaagtttcaacaatcaggcaatagaacagttcaatggaaagcttgctgcaggaagaatcatggttgttgaacatgtccacgaaaccccattgagtgaaagaattggcgtgagtagccgtcctaaaggtcctaagggagccaagaagaatggccctaagaaggttcgtcagccttctaaaaacgctgaagacttggacaaagagctggaggattatatgggcagtcgggcagagaatagtaaggatgaagagccctcaggagccactggtgaagcctttccagccgttagcacgggcgacgggatggccttggattgagggtccaaaagatgaaaagtaaagttaaacagaaaaaaaccggttgtatgtatttataataatataagtaataggagtcggcacaatatctacagcgaagtgtttgctttaatgaccactagctccaagttcgacggctggaggacatcccaatgccttcttcaaagaaccgtaaatggcgaattgcagggaagtcagggtacccaccatgaccagacgtgttgggagaccagcgaaagaacctctgatacctaactcaccagccagctgggccaaaagacctagagtggattgaccaggagccttcttggtcttgttgaccttggacaaaagagtatcggcaggttgagagacaaaggcggcggcacatccggcaataacaccagacaacaagttgataccagtagtagcactggtagacaattcactctttggggttggaacgaaaccgaaaatagcgtcggaggcaatttcgaaggtcaagaacttggcaatgttgtaaggaatttgtttgaacaggattggagtgaaaccgttgtagaaagatccaacaccctcttctctgaggattcttgagaaaccaccgatcaaaccgttagcaaaatttggctgagagaccagtctaatacgggtagcctccagagggcacagagcgatatcggcaaagaactcggcaatagcagcggaaccgatgtagatgggagtcttgtatgtgacagcactttcgtaacccagagcatcgatgaatgtcttcttgaacaattcataaccaccgaacttgaaggcaccttgcaaagagtaacccaaaatggttggtcccagaccagtcaaaagagcaccagctccttccttggcaataatttgtctgaaagaaccgatcatacctttgttgtacacagctggctccaactggattctggtcttgacaacatcaacaggagtcaaggaaccatgggtaacaccgcaaccgacggcaccggccaaggcaaaagaaccatagtcaatcagggagtatgatggggtgctgtaagcagctttaggagaagaggtggaagccatcttttgcaattgggttaaatctaggttgattattaaaagaaaagaaggattaggggaaggtttttttgcaacgttttcatgctcgaagatggtgaatccgagggcgcgctatgattggcccccggggtcgggtgcgaagagaaaagaagagttattgagacaggtacctccgccagggtaccggattcggagatcaacggaagagggacctgtgggtgtgtggaaagatatccacggggttggtaggtgcccataagaggacggctgcgctttcagcgaatggattcgacaacccggggtaatcgtatcttgggcaccattgagactgcgtgaattggtgggttgaatttgagcctcagtgtgcctcatatcggttggtacacagtaggctctaacattcctgaaacttttggcagtgttgactagagggtatggagactggtgttctccaactacagaaagggtctctgaaaaaacccaaaatttggctaattttcatttgattattctactccattgattaatgtatcttttgctgacctgttgtttctcggctttctgagaaaactctctcatcgccttctggggcctctgattggagcctgtggttttgtttcattcgcattgaagattggggcgttcttgagaatttctgggacagagaaaaaccgtatttgagaacctctaatgaatatttgttccatatgactgactttgccgtcctgggctgttaatgtaacgtccttgagttgtatattcatggaatcctcagattcaaccagtttgcctctataactctcgccacttgtcaattcagcagatattatatggccttgagcttcgttgagaagtttcactggaatactaagtgccattcttccttgtagtagtttagggtgagagtttttctgataggaatgaaaaacgcggatttaagattgattatgtaatctgggtagtgccagacggatgaaacagagagactgcaaaatgagcagccgacccgacaaaccaattagattctccactcgctacaaactcgtgtgaccttcttccacagctcatacgtcagaaaatctgggcagcttggcgagtttcaacagtcaaaagaaacttactatggcaaacttacaaccatactaacgtcattgcagaattggacatttgacaattgaaattgaggacagtggctattgatacctgcatcgaaacatgccacatgtcagtcttgcttactgtggccgtgatgttgcatgttatcttcacttagattagctgtccgatgagccatttctgaagatgatttaaaaaaaaaaactgtcagttgtgcatcaccacaaattggatgtagtcattgttaagccataccaagatccttatctttatgggaggaagcagtcagaaacttgttcttcttgaaagccacagttccaagtaaaaaatgccaactcaaatctccacaacaattaaatacacaggaaaaccaggatgcatcaaaataatttatttccttgaaaatgagccactggactctttgattcacttgattgaaccctgaacccttaaagggtgctaacgcaaaactaccgctctgcctcggtcttggatagtcacctcatgcatgatattcactctgaggaaaatttctgaaaaaaaaaagcttagcgtgccggaaaaacagagcaaatcgatgcacacgtgatgaggtgtgatcctgcctaccaaaacagctaatgccgaacttcaactccgtctgaatgtgaatgacaaaaatgaactataaaagaccaaccagatcctaccttgttgctgtatccaattgagaatgtcttcaacttcttctaagaaaaacgaggttctagaaagagagaaagaggtagaagtggaacaggctgatgagtctcactcatatttttatcgtacggtggtagttccattccgtcgtttgaagtggggtttcttgcctgtccgcagggaagttcctgatgaagttgaggatgaagcttggctgcttcgtgaggctaaactacaggatgaagtgtctcccgtggagtacagagacgaaaagaataggaaatggtggaacttcttcgatgagtacgaatacagagtcaacaaaacttatagaaagaaacacaaatggtacaaatggttcaatgagacagatacacctgaagagagaagagtcatcctgaaaattgatgttcttctgactttgtattctttgatggcctattgggttaaatacctggaccagacgaatatcaataacgcttatattggtggtctgaaggaaggaattggaatggtaggtaatgatttggttaatactcaggttatgtttaccattggttcaattatatttcagattcccttcatgtacattttgtacggtgttcctttgaattacgtgcttccctctttggatattgcctggtcgatcgtcaccgttgcaatttacagggttgaaaacgttcctcagctgaaagccctcagattctttattggtgtctttgaggcgccttcttatttggcctatcaatacttgtttggttcctggtacactgttgatgagatctcgagaagatcaatggtgtattacttgggtcaatacttgggcttattgacttccggtttgctttcaggtgcgattgtggacaatttggatggactcaatggactggaggcttggaaatggatctttatcattgatggtgttgtttcgattgctgttggattgattggattctacatgatccccggtacaccagaaaactgttattccattttcctttctgataaagacatccaaatcgcaagaaggcgtttgaagagaaatcgtactgccacaattccacaagtgaatcacaaagagttgttcaagtcacttttcaaactggatctgtggaaatcaattctctcctcctggcacatatatgtattgactctctggaacgtcttttgctggaataataataacggtacttcaggatcatacgtgttgtggattgattctttaaggaacagtgatggaagtcgtcgttttgatcccggacagaaacagcagatgactgcattgacacctggtcttggtttactgtggttatttataacctgctcgtatgctgatttattccattcccgttggcaggcaatattgttctcccaagtgttcaacattgctggtaatgttattctagcagtgtggcatgttcccgaaagagctaagtggtttgccttttgtttgcaatactttggatgggctatggcaccagttctttattcttggatgaacgatatctgtcgaagggatccacaaaagagggctattatgttggttgtgatgaacatgcttgctcaaacaagtactgcattcatatctgtgctggtttggaagacagttgaagcacccaggttcctcaaaggtttcacgtttactgcatgtgcagccttcagtcttatcgtttggacttttgttgttctgtatttctacaagagagatgaaaagagagaatgtgctaacaatggaattatactttataactcagaaaccgatagagaacccattggcctacaccaagaggacagctccgccgattttgacaaacaggactaatctaattttcacataggtatcccaagttttctcttggagttaatacaatactttcgtatattagcaaagctgtaaggattcctgtaaccgctcccatcaaaacagtaaaatccagatgagcaaaacttaatagaagaatcagtactccagccggtattctccatataactctccaaaatcttggaaggatgtgcatctttgggggatcgtggggtaaatccagcaatgcaagaacaccgatacaaatcaatacaacacataaacctccagtaaaaaaaagcgacaacacaaacagctttttttgttcttcgtgtgaagttgccaatcgctctgatattgaggcaaaatcagaagaagcaatatcgcctcccgcatcagcagcaaggaccagtccacctacaagagggaggtggaaataaatccagctaatagccgtccaaccattgcgtcgtagagcatgagtagcctttgttgctgtggatccgttctgatatatccagaagaggtcatatgcaataagcaacagaaggattcctctgacaaattttaagctaaacccggcacccaatggcccctccgcaacaaccttatataggaattcacctacggcaatagtgacgaaaactccaaacctctctacttcgtgctcaatgtttagagccgtagacattcgcaatttgagggctttcttggttgctgggtgatagcatacacagaaacacacctgttccagaacgattgttaccactgcaagaataatctttgatcttgtggagacaaatatgacgggaacccataacgagctggtaacaagtatagtaacggcgtagattctcatctgaacccgatgttggggaatgaaacacgaatagagcaacaaactgaatgcaagagacagtctgcagagaatataaggaacaatcgtgaatgctgcccccttacgaccctctaacagctccccatttgagttggcgaacaatgtcaggaggaccagaatccacaatatatagagtttttgagacaaatcctcattataatagtagtttgtgaaatctttgatgtcactccatacaacccaggcggggataaatagtagagcatatttcaggagagcccccatcgtagcttcctcgcaggccgagccagcgaggtttgcaataattcccacgtacatcagatccaggaacaattctgtcttaccggaggttctctcctctttcgtacgatacaacacaccatccttgaagaaattcaaagcgtgaggccgtatgaaccaaacagagcccttcggtttcctaatgtacttgaaattgatatcaccgtactttctaacaaattcccctacttcagcttcggagtctgttaaaatcgacaggtcctcgtcttctatggtttgttcctctggctgttcattgagctgttcattgagctgttcattgagctgttcattgagctgttcagtggaaggtggaccttccacagtcgacgaatatacagtatttggctttcccataaaaatacttggccaagagtacgggggaagcacagcaaagtatctatgcgcttggttcgcgataaatagtgcgcgaatcaaataactttatcaagtagacaatagaaaatgctgcaccaatttgtgaaccttctctttcgggtaaaagaacgaaattagacgagctgctttgaaacacatatcatgtgaatgaagcagcaaattaacaatcctgtcgcattctggaaacctggaacttgacttcgctcaatgttggagcttagagacagaaaataaaggtactaaacctgtagtcgcaggagtgaagttgggacccactttcagggatcccttgcttggcaagagtaaacagagttggtgtgtacagcttggcagccgattaccttttttcccaattagtaagttgccggtcagaaaaggcaaaatgaaaaaaagattgcagcacctgagtttcgcgtatggtctcccactacactactcggtcaggctcttagcagcttaactacggttgatcggacgggaaacggtgctttctgctagatatggccgcaaccagaatcctttttttgtaccagcatatactaaaatgtaaagaaccatagggactggcattgtcctcttacattgataaggtataatgattatgcgatgtcataaacgtcatgcctcttgaactagttaatcttagctgccagcccagcctagagatgtcagatatgaccatgctaaattagtcctgcctaattagtactacggatactctacaatatccaatgggtgagtgggctctctaaataaaaaaattcattaattcacaaattaacgtttaggatctaatctaataacgtactacctctaaaggacaagttttggaccgtggtacttgaagtttgactgggcagtcatcttgaatgggctaggctcctcacgcaatgggaatccgtccaagctctttgcataagtggcgacactgtgggcaattaatttagtattgacaacccatggaacatagtcagggttggccaaatcgtcacaaagagagtggtaacatgggtcatatgcaactccagcttcaccaccaaatagttcagcctcctcttcggtcttcaaaccttctgctccggtagcaataccacctccgggaataccgctcttgatgaatccatcatagtcggatcggccatcaaatggaactagagtgtagttcagaccctgttcaacgtaccagtcaatgtataaattcttaagctcctcagatccaactgggttctcgctgttagtggcattatagacctggtaggcgtagttaggggaagccatcatatcgtagtccataaacaaacgaatctgagatttctccttgggggttaactttgaaacgtagtagtcggatccaagtaatccttcttcttcagctgcccaccaagcgaaacgaaccttgttattaactttgaatttagttaggtatttggccacgttcaaaagagagatggtaccagaaccatcgtcattgatacctggtccagcagcaacagagtctgaatgtgcacctagcatcacaatgttgctatcattaccgtaacgagtggtagcaatcacattcttggttttgaacttcttaacgtaggaatcgacagcgacagttgcaattacgcttccagaagtcagaagctgacgcttgacggcctctccatcttcctgagaaagtgacaacgatggtacctgatgaggagttggggcacctaaggttcccttagcactacctggcacgttgttgtaaatgagagcggctttggctccacggagaccagcaagttctgatttttgaccgaatgaacaagaacccctttgaattaaggcaattccgttagtcacgttgaatggatagtcagaagcttgacaaccataattatcaactaaaacgactggaccggtcactggaaaaccgccaggagtaggaggagttaaatctaaagcttctgcagactttggtgcaactccgttaatggtcaatgagaaagacttaaggataccggtaaaggcttcaaatggctgaacgtcaacgtcgtagtagtgtttgaagttatgtaatgtgtcgaggacatggttgattgtggaccagtgaccaggagaaccgatgactctggtaggatgtccgtattcaaagacggaaccatgtgcaactttaaacaaatagctggcttcgattttcaagtctagctcattgactgcactttgaagagcagcagagtcgacctcaggcttcaattcccatttaacattatcggcaatgtccagtggcttctggtccagtaattgggcgaagttgatgccagcagcgagggccgaagaggccagggtagcaacgagtggcaaatatttcatagcgaaggaaatctgcttcaaaaataaaccaattcaaaaagaatgtttgactggttacaaatagaagactgaatatggaccgtaaaagagggaattgataaagatatatacgctttatctcagggtattcgcgaaagcacatactgccagctgcaggatttcctgtgggcagatccgaggaatcggatgctgatagtgctcatcattattcggtattctccgtgaatcccccaaatgcattgtgtctgctcaaatttctattggggaatctaaaaaatggttgcatgaaaatgagggataaatgtcgccaaagggaattcgtggtcctccgacgatggcctattgtggtagtagatgctttgagattggacggacagtgtagagtgcctcgatacctcaagaaatccgagtacaaattgatagataaaagctcaaagctcacgtcatgcagggaggagactttctgttattttgctcatttctgtaccattcttatgcaactgatgagtcagtcaataggattcccggtatgcttttggtaggtcctaattgcatatcaaaggtgttgtaaagaagggttcccgaatggcgaagatctggactgggtttatgatatggggtcccgattaggttcatgcattatgacaggtaccttaaaggtgctccaattgggaaatcaaatgcggctagtactcggcttcccgattaaggtaattccccatttagtactttcaaatgggtaaccgattagttcaagaagcaggtagttcaagtaagagaattctccgtaacggaaactctctctccggcaacgtttcaatgcaacatcggcctacggtttggtctcgttgcttttgagaaattcttccatctgctcttttattgctgcattgagggtctgtgattcgatcgtagtggtcctagcataatttgcgagagtggaagcgccggatcttgttgccgttccttctgccaatgcaacagcctgggcacgtttggacgaatccaacaacaccagcggatcctgttttactctggactcaacatctgatttgagcgactcgagaagttgtttgtattctggactaagcttgaattgatctagaagctcttttcttttcttgtcgaaatgtccctctcttttgtaccttctcaccagttcattggcatcgagtgataattccttctgatccatccgtgtggagtgaaagagagctgggaagtggaaacgatggtctaacacgctaggcggaacttgaaacaaaaaaatgctcctgcccgcgaacgaagatgaactttctctaccctgtatggttttcctcttatctatggaggctcaagttccaatcagtgccaagttaaaccgtcttgcgggcctcattgaggagcaaggggcccccactgatcaggaaaagggtgatgatctacctagcttacctacaaaagagtttctttttcagcccatcaaactggcagaactcaaacagtcgccagtactgaagaaaaggaaggtgggccctcctccaccgcagaacgaagaccaatcgttgccaattcaggcgtggaaggacgaactgcttcaattcacagaagacaccctgaatggctcaaagtgttcgaaacccttacagtattacaattccatttgcacgtttttatgtaggagtggctacacgaagcaggtttccaaggagttgattcaatcgattgaggggtattttgctaaagttttattgcctgaggtgaaagaagagatcctaaacgatggagaaaatgcgattcaacaccttgtcgacgcttggaatatctggtacacgaaaaccaaaagaatccatttcgtcgtcatttttctgaaccaattgtatttgctaaactcatcttccagacaaagtatcgatgtgcttgcaacgaagctgtttgtggagaacttgctggaactagaaggacacgaaggagatggggaattgatgctttatgatcaaagtcagaaacctactcgactgaaaattcttttaaatctatcagagtggatcaaggagctgaaaacaactggaaagcttacaaaccaaaacctttacaacgaattcaaggagataatcaagaattttgagattgacaataagattaaattgaagaatgtcctccccgatatgataagggtatgtgatgaacaactgaagaataaatggataggagatgagaaattggctaaagattatgtcacaaaggtccagaattcaatgctgattagtcaagatttagctaaggaatgggatgctaagtttgagaagattcggcaaagagaaatccacttctttgttgtggaaccaatctatagaatcactcaggagctagttccatcattgttttatctagatattgactcaattgaattcttgatgttttgtgttaaggataaccccaataattacagattgatcttggacgcttttggtgatattgtaaagaaacagctcgaagaatgtttcaactcggattcgttgtatacggaggattacattttacagccgaacaatatttttgtaacctggaatcaaaaactagaaaacaggatatcatatgtcgagttggaaagtcaacttgaaaaagcattaaccgattctctgaatctacatcaagaaaaagtgattcgtgccttgttgtcttttatagagtccaacatgaagaagcgttcacgctcagattacttggaactagtcagtttcatttttaccaagctcaagaacaaagccgcatttctgaagcaatatcagaaccaattgtcaaaaagactgctatacaattcatccatacagtttgatgatgaagagttcataataaacaatctcaagacggatgatgtaaccgctgagattggtcctcttgccagcatgattcaagacatcaagataagctcaaaactgacgtccagtattaccaatgatacgcccatagaaatggattataagatcatcagggacttgagctggcccaaagttccccttgattatgatgttcgcttgcctcagtacttgctttccgttgtggacaatccggaacttaaggagaaagttgttaagaagaatatggttcgttacaagtggtgcaattttctacatcgatttgagattgagacttccttcaagggcgaggccaagacgttggtagttaacggctactacgccgcaattatcctagcatttaatgactctgaaagtttgacgttagcacagttggcaaaggtgaccgagcttgaaaagcagtacctcatagaatgtcttaaagtcctttgtcttggaaaatataaacttctacttagaaacaatcagtctcagccattgaaaggtacgccattccgagacgatgatgtcttttcaattaacactgacttttcggacagatccaagaaattgttcattaaaccagccaaaggcttcaagaatgatgaaccaattacatcaaattactacgacgctcaaaaggaaactacaaacagaattaatgccttcataatgagaacgatgaaacaacaaagggactgttcacattccaaactactggccgacatcctatcctttttgaaagaatataatatttcaatcccaaaagcgtcgatcgtgaaggaatgcatagaagaactcatcaaacagggatacctgaaacgagatgcgtccggctcctcctaccactacatcccttgaaggctatcaccgattacataatcagaatattatcacaatctccttataattcaacttcgcggtgatcactaggttcacaatttttcccccataaaaactcatcaccaaaatggcaccagctaaggatctcactcattttttgtcagaagagtcgaaaagaagacagccctctccacttaagaccgccttcaagtactttggccaaccagacctcattttcctgggaggaggacttcctctttcggattatttccctttcaacaagattaccgttgagtcaccggctcctccgttcgagaatggtattggatatgcacccaaggaaggtgaagccatcactaagactgaggtcttgaagcagaaaattgaggacttcgacgtgccattgtccagatctctccaatatggtcacactggaggccaacctgaatttttgaaatttgtcaaggaacacactgaactgttccataagccaccctacgacgactgggacgttttggctaccgttggaaacacccaagcttgggatgcagttttgagaactttctgcaacgaaggcgactccatactggttgagcagtacacattcccttcttcaatggaagccgcaaagtctcaggcggtcaagtttattcccattcctgtggatgccgaaggtattttgcctgaaaaattggacgaacagctagctaaattggaaaaatcccaactccctaagttgctatacaccatccctacagggcacaatcctactggatcttcgttgaacaaggagagaaaacaggcaatttataagttatcccaaaagtacgatttcttgattattgaagatgaaccttactatttcttacaaatggaaacatacacacctgatgcgtcaaagagggacaacgctccaaaggggaaagaggagttcgttaatgctctggagccttcatttttatctatggatgttgatggaagagttctcagactggactctctatccaaggtcttagctcctggtaccagaatcggttggatcgttggtcagccagcactgttgatgaagtttttcagactccacgaggtttccattcaaaacccatgtggattctccagttccatcgtaactggtttactttctcgctggggtaatgatggctatttgaactggttgatgggtctacgtgctgaatacaccatcaagagagatgtggccattgatgccatcgcagccagtttccctaaggaaattatcgagtacgttcctcctgtggctggtatgttctttactgtgtttattgatgctgctagacaccctaaattttccactgagtttgacagtgatccactcaaggttgagaatgctatttttgagagctctatgaagaaaggtgctttgatgataccaggatcatggttcgaaatagctcattcattccccgagaaagcgctgtcaaatgaagtcgactccaagatcttcttcagaggaacctatgccgctgttccattggaccaacttaaactgggattggaaaggtttggctctgctctcaaggaagagtttggtttgtagaaattatagatcactcaaatagattttgtgaatgttctagcttcaaagggataacaaaacttttttctatggagaatcctcttgcgtctattgtgtctttagtcaaaagatcgacttcgatatcctcttcaagttccaagtttttctgggccatttcattctctggtattatgtcaaattcgtcttccctctccatgaactctatattttcttcaatctcaacaaaatcgggggccagagcactccatttctgaggcacaatcacaccccacatataaatctttccagaatccaaccccacagcgtagatttcacactttttgaagttccagtccacatctactagctcttctttggacccttcaagaatctttaccagtgatcccatcgtggtttcccaaatgtaaatttcatgagaagatccaaacgtggatgcgatcaaatattctccattggagttgaaacttacagagttccactgtaggcgattgaccacgtcttgatacttgtgttctacttctagaacccaattttcgggctcctcattgaccaaatctggaatcttgaactgccttatgatacgatctgaaaaattgaccgctattctataacctgtttgggacaaaatgatattttttacgttggaagaagttatcttttccgtaaataaggtagatccatcgattgtactgatgatgttcaccaaacctttgtttgttcccacaaaaagaaagtttccagagggatgatacacacccgtcaatatgtagtgatttgaggactcttcagacccctcaacgctgatggggctcatcctgatatcatctttatcttcccaattcacaaataaacaatcgtcttcaaagattgaaataaatatttcaaagggctggtttttcggagagaattccgcctgccatatgggcccttcgaagcggagacttcttatgggttcattggcagttaaatcccataaattgaccttccaatctctcgaagtagatagtaaataccttccacaattagaccaccttaacgaattgatcgccctggtgtgatttctaaggattttaatgattccgtgtgtgtccaagtctataatcacaatgtctccatcaattgttcctgacgccaagtaatcgctattgtaggaggactttatcaaagtcgaatggccaaattccagcttggaaaataaaacctcagggtactccttcgcaactgcaaagggatccagcaatgacaagttcatttgtacttgcgtgtagacaggcaagccctagatgcacttatcacgaaaatgttatgctagtgtcgctcttcccagaagaaatcccccgcgctccatcaggtctcatactacagtggccgatctctccgccaactttctctcaaccccatggactctccagacacgaaggggtctcaagggcggctatactcgccttcaattgtctcttcatctactgtaaacaggtcttcttttgatgaaagactgaaaaccagatttagtgtcgtttcaattgaagaaaacgtactcaagaatggttctagctctccgattaaagatgatgataatgagccgataaaatggatcaagttgaagaagctgtcggcccattttacgcatgctaccagaatcgaacatggagccccaatctcaatggctactggatctcaaatttgcataggaacctccaagggattcgtacttatctttgactacaaacaggaattgcgaacgatattgaaaagtgccacaacgtatgatccgattacggttctcacattatccgcagactctacacacgttgcgtcaggtcaccaaagtggagatatctatttatgggaaattagtaaatctgtacctatactgaaaatccctgctattcctaaagaggacctgctgaagaatccgaaagctaatggtcatttgcataacactcctattcacaatttgtacttcatgggaaagcgaagaacggcacttttgtccactgacataacgggaatcatggtccagcacaacggctatagaaatatcaggggtcttcgagttcaaacaaaaaatgtactgggaaaataccacatgaataataacaaaattaccgactctacgattctttcatttgctcctttggctctgggtactgccatggaccgtactgataatattggagttattgcattgatgacttctaatgtacttctcgtcatctcaactaatccatcacttcaaactcatttcaaagtcggaaaacccaaatctatgaacaagcgtcttccaattactggtagtttagcttggtttcctgctgtaaagacagaaaatggcaagagacagcccaaacttgcgtattgttggtccaatgtcttgacagtcctggattgtaataacgagtcaatcaaggactcccaagatcaagaatctttgattttgaagctagaaaataaaaaaagatgggccggaagggaagccattatcagtgtttcctggcttactaaagacattattgcattgataacagaatctcacaggcttcttttgatcaattacgacacgatgacagtctcgtccattattgaccttttcactaaaagcatccatgttactcagttgttcaagccaaccactgaaatagacaggcttactccattcatgtaccattgtgttttcaaagtctataagcatagacttttcattttgggaaagcatgacatatacattggaacattaaacaactgggccgatagactgttggaattgctttcaaaaggtgactatttggaagcattgacgaaagcaaaagactattacgatggaaattgtgatttgaacctattaaggttgccaaaagatgacaatcgacgtcacctcgttgtttccagtcatattttacagataatgaccgcttcattggactttatattctccaaaaaacaacttcaagacgaagcatttttggaattgtttctagagaattgcataaactgttcgattaccatcgatgttgatcagtcaacttacgatcaattctatgaagcttatatgatccacgggtacgagtacctttttttcaatacgttagagccgttcattttgaacaataagatccatacacttactccttcaattttgaaggcaatgatcccattttatcttaagatgaataggggcgaaagagttgaacaattagtctgcttattggacatcgaacagttagatattgatgctaccgttcaactctgtgaagaatacaagcttcaggatttgctgatatacgtaacaaactatcttttccaagactatattacacctcttgtgaactttattaagaaaatcatccagatctccaatgaagcggccaacctgtctgttcttgaattggaaagtctttctgctgaggcacggtcggtctacggttatatcacttacattctgaccgggagacattatccaattgaacgactcattgattttgacaaggaaacacaggctaagtcaagtgtctactatgttctgttcaatggtacttcgattgagtggcccaagggtgcgggaaaacttcacattacaaatgatttggaacatgagccggcttttccctacctctaccttcttttaaagtacgattgtttttcaatgttatcggctttgaatgaagtgtttgaagactctcagttgaatgacgaagatatcaactactcattctctaatgatcttcaaaattggaaagtcagcagacaatatgtcgtcgacgttctccttggtgttttcaacgacaatgactttaaggaccaagaaaatacacttctcgcaatatttatagccagaaattatcccaaatacaaacagtttatcaggctctcagaatctgttttacacgaagtgttaacaaaattgtgtataataccagatccctcattgaagaaagaatgtgaattgagtctccaaagtttgctgtcagtataccacattcccaatttgaatgagtggatcagcgtgtttgaagaatgtggtttttttaacgtgcttttcaatgtctacaaatatgagcacaaatatgatacatttttgaagctgtggctccaagagaagcaaaaacaagctttgcaagatgtcggcgatgattcagatgaatcatataatgatattggcacccttgttgaaaccttagagaattgctttgagtcagtcggtaagaattcccaagagaaggcaggtattgagacctttctttctgagaattttgaagcactgttttccattgaaaagcccagtaatattgttagagttctcaacaagtactgcccaaaactacattacaatattttgcgaagttcaaacgaagaactacagtacgagtatatatcggcaatggttgaacaagaaaaatgctcgtatggatcagtggtctacatagagtttagaacactttatgttaagcttctctgtgagtttgatcaggaggctttgctggaatttataaaaaaaattgaagtttctacaatagatgctattgctgctgaatcctatttgacaaagtttcatcaaatagaggccctagttttacttttggagaaagaaagaaagcagcgagaagccttacagattttaattcagcatatatctacgttgggtcaacaacttcagctagaaaacacaaaaagcgatgtacatagaatcgaaggtcaattgtggaaatttttgatgatggttatagaaatactgaaaattgagaatgacgaagagctaatggttcaggttatggaaatgcctgttgcattattcaatagttttacagaaggcggaaatgacagtaaagaaaccaccaatatcctgaagcgatttgtccaagatacttttatgaatattataggaatttaccaatccaccactgctccggaaaatgtcaaaagtacatttgtggacgtattctcttcgttccttcaaagagcttcttccaagattaccacacttggcgatgtaagagctgtgctaagggaaatattcattgtttacggctttgagaaggtaatcttgaacatcaccctgggcctaatcaatgaggatatctataaggtgatggagaagctacacagtaagaagtacttaggctggacaactggtgttaccgattgtgtaatttgtggtaaaaagctttggggatcttccatgcctaatgaagtgtactctatgtgggaagaaggaatattggaagacgatcaaagtgctaagaagacctccttttttatcaatgatgaaggtgagctcatgaccaattcaactgtgaatggagccatgcaaattgaacccgtacaattgaacgattacagtccttacgaacttgtcgttttccgttgtcgccatggatatcacagtaaatgtcttttcaatttaggaacgcagaagaagatcaagtgtattatatgtgcagccgacgatgctcaataggtagaacgttagatgttgtagccgctgagtatgcggctcttcctcaatatttgggacatgcatcttgggctagtgtgtccctggttacaaaaactatctgtggtctctccaattatctttatttcgtattgacttaaatgaagtttgttggcttggtgttactgagtgcagttattgtaactgctgacatggcgaaagagccgtttgaaattaatggttttgattctcatgacaaatgcaataaccaagacttggctgtgctgaaccattgtgccaaggaagttctcaaaaagctggatcaatgtggagctgatgatctggcgtgtgaatgctgcgccttgcaatcattaaagcacgtttgttatgacttgtgttccgattctttttcaagtaactttttaaatgttttgtatgaagattgtgaacctttcaaggaagtaaatgcctgcagttttcaattcaaagaaaaagactatgcatccgccataggatcaaaaaagaacaaaaagactaaaaactcagtcttgaaaatggatgggtccaagattgtatctggaaacagatcagtgagccaaggatcgaccacttccaaagttccctttatcacaaaaggaaaatataaaacagaggcccaaaaaaatagatctagggattcgacgcctccaggactacaggttaaagatgatagcagagttagcccagacggtaaattcttgcaaggttctacttataaccacaccaacacatcaaatacaacagtgagcaagcaggatttgtcctcatcagttagactcctaccaaaagtgttagcattgatgcttggtacattggtgagcacaatcgttgtataagcccttcccttctctctttctacctatataattatagacactaatagacgctgaaccaaacaaccgactcaatccatgctttcgcctatcagacaacctcattgagccattccagagtgtatttaattccagtttcgatatcaacctgaggtttatatcccaacagcgtctttgccttggtgatatcgtgatatctagtcgcagtgactactttagctctgaaagcagttaaacctgcctccttacccaaaagcccagcaacagtttgagagagataacctgcaacaatagctaccggcctgggtaaaacgacggtcttggctggaatatgtccgtccgctttccaaacagctctggccagcgtccaaaagtacgctggagcatcgttggtaataaagaaggcttgaccagagacagcatctcgagtgtcagcactcaacaacttctcagcagccaaaacatgggcatcggcaacatttccaacataggtccaatcaaataggttattgttgtctcctaactgaaattttgattgaccagtgcgagcaacttgcctcaagcctggaacgacttgacgatcaccaggaccaataattccggcaggtctcaacgcaatggtaaggaatccgtttttaggatcgttggctttcagtaccatatcttcaccagctgccttggtttcattataaccatccatggcaactttaggtataggccacgtctcattggcattgtagacatcagatccatcaaatattactccagccgatgaggtgtacacgaaagctttgatgttgagctccttggagacttgtaggagagtctgcgtccccaacacgttaactttctcgtaaatgtcctttcctaaaccgtgaacaggagaagccgagtgcaccactacttgacacttgctatccttgatcgctttagagacatcttctgccgaggtcaggtctccttggtgaaatgtgatctcttttgggtcgaaagtgaagtacttggcgagcttctctggaaaaggacgaatgtcaaacacgtgaatttcaacgtctggtttgttggtgcggaattgctgtacaagatgggatcctaggaatccagcaccaccaaccaatagaaccgagttgaactgcgacattgaggagagtgaagcagcttgtttttggagtggtaagactttcagatctcgtttatttgattttttctatacgatacataaatatttcgtgggtggtctaaaagacgaacgagctttcaaattgagccaccttggaggagtcaagttggagcgttttggattccactgtgggaaagtggtactcagtggatgaaaatttgttttgagataagagtacaggtactggtggctgatgagatttggaggaatcttgggtagattctcgggaaaactcctcggattctgaactcttgggagcttgtgcgataggctcattcttagtaagagagaacccattggatggctgaatagatggtggcttggaaaactgagtgcttggggtgaatgagaataatggcttggtttctgtagtgactgcctcagatatgggtgctgttgattgtgcattgaaaacaggtttggtagctgatttttccgtctccactgttgaaggtggagtcaatttcttgggttcttccttagcagtttgcggagtaaagattggagcttgtgcaggtacttccggctttgatagaacagtggctggtgcctgttcttggtcattcttctttccgaataaatcatcctttggtgctgtttgctgcattttctccaaaatgctgatctttggtttttcctgcaccttttctacaaccttgacgggctgtgagataggaggtttaggaatgccattgattttgttcaacttctttaatcctgacacatacgggttggcaaacctggaaacttccggcttggggtttgcttccttttggttttgattcaataaaccttctaacgcatttgctgttccactaagttgctttgggggttctttttttgcaacctcttctatttttttggtttcctgtttggaaataagagtagccaagggggatgaaatgcgaacacgatatggagacggtaaactggaaaactcaactagccttttctttcttgtagaatacacatccatggatttgtttgcaggagaattgaacgatggtttatattttggagtcgattttattggttcaacagtttggggacgcagaattttaggagtactctgtgacgttctggtgtcatcttgatatctggctgactgattcattagcgaaagaacaccttgtatctcaacatctgacaacggctggtcacctttctctgtgaaaaacttagccaatctggcactaggggactgctgaatggagacgtcgtctaccaaggttgaaaacacaggagacgatggcaaaatggaagtgtttgattggttcaccttcttaaacaaagctggagagataggcggtctttcctgcgttatttgtgcagaccgattaaaagttgaaacttgggattgactattagaaatagactgctggtccttgttgatgtctccaaagagaaaccctctcactttgttaaacagccctgatttgggtgaattgccttctggtgggtcatatggtcgctgtgagtgatgctgaccatgttttcgtatcactgacatagctagtttggagtgtgagacggattagtttctgggacaggctttcctttttttttgtctgggatgctcgaggaacggttctaaaagattacataatcactacacagtagatagctactttaagtcacgaacttccaggcatcgcattcgaaagaggcatagcaagaaaactcgttgctaagaccattcttgtgttctggctcaaagtcagtgatgctgcattcggggtatatttgcttcatcactttggctgtcacctgaccagttgaggaaattaatttgtctgaagcctttccggacaacagagctctagtagttaaggcacatcgtacctggcaatcttcgcccaggaagggaggatcaatgagcagtctgtcgaccttacccaggagtattggtggtaagttctcgggagctttatagtcgaagaagaaaaagtgctcgtccccagcaaggattttaaatcttatgtcatattccaacaaatagacatgttcagtgggccacgatgatctagggatctttctcatagcagaatagacagatggtgcactcacaacgcaaattactgtgtcagtatcagctccgtcgaacaaagtccttgcgtaagtgtctgcagtgctatcggcgtaccaaaattgagaaagtccccaatcttcctgaaaattatctatactaaaaatttctttggccttttctggatcttcctcagctgccttcattttgtcataatctgcctgtgcagaatttgagagttcctcaaattgttttcttctcccctcctcttcctgtttgaattcttgcaatgcagctaaagtggaggcagataactgtctagacgtttatgttagtaaaaaacggttctgaggtaaaggggtttgattatttactcttttaaacggttgggggaacatacaaatcgtcaaagtccattatgggcagagagtattgatagtgaacaccttatggttctggaagatgagctggaaataattttttttgaaaggttgaatgtcgttttcctaattgggaagatcgtctctgacgtcataaagattcggatgttggatgcaccattgaagatgacggcaaagtggtgcgtgttggtgaaccataaagctaattgccgatggaatggttggaagatgactttgctccgggctgggatggcatcttatcggaccaattggtcacagttgatttgtcggtaaaactggggtgacaaatatttcaggtcaattccttcgatggcttcgacacttttccctgatcaacccctaaattcaagatgttcgaccgcttgtcaacaacatctctcatgacgcacatcacggacccctttcgaacctagcgcaagaagccgactatctacacattcacatcattttgtccccgttttcacggttcgtttctttttctatttttttttcatcgacctcatctatatgcgaagacccctttgaataggggaatttctgcgcaggtacctttcacaacctgttcagctcgccttgaattacccgcagaaagaagattctgagtgtcctggataaagtaatgccatctgagctgatgggattatatgcccctcaagtgaccattttcctctctagaacgttacccttctaattttccaatcacacttcattcccgttttcaagcttcctgccctattttgatatcaagatggtcaaccatggggaaatctttgaatccgatgataccctacaaaccgaaaatttttcaaaaaccaagtctaacggctttaaagatgagacctacgaactagaagattggcaaagaaataatcctcacctcaacattgaaaaaggagatctcaaagaaacagagttgaaaagaaacttgaaaccgagacatgtttcgatgatcgctctcggtggtaccattggtactggtctgttcattggaactgctactcctttacagattgcaggcccagttaatgctttgatcgcttatattttcatgggtagtttagcctattcagtgacacaatctctgggagagatggccacgtacactcctatttcaggctccttctgcgtgttcaatactagatacatttcaaaggctgttgggtttgcaacaagttggctgtactggtggaactggtccactacctttgccattgaactttccattatcggccagattatccaatattggactgacgctgttccactgtgggcttggatcttaattttctactttgttctggttgcagctaatttcgtccctgttcaatattatggtgaagttgagttctggatcgcttccatcaaagttattgcgattatgggattcattgtctacgccctgtgcatcgtctgtggtgctggtagaactggtccaattggatttagatactggagaaaccctgggccttggggtcccggtatcctggtagctaacaagaacacggggagattcttgggttggctatcttctttagtcaatgctgcctttacttaccagggtgtagagttaaccggtgtttccgcaggtgaaacttccaatccaagaaagacagttccgagggctattaataaggtcatcttcagaattttgattttctacgttgcaactttattcttcctaggattattggttccttacaatgacccagaattatcatccgacacttcctacattgcttcatcgccatttgttattgctattaagaacgctggaactcccgttcttcctcacattttcaacgccgttattttaacaactgtcatttctgctggtaactccaacgtatatgtgggcagtcgtgtgatgtactctatgtccacagcgggaattgctccaaagtttttctcttggacaactacttggggtatcccttacctatcggtgatggccacgtctttgattggtcttttggccttccttaacgtggatcaagatggtaaaactgtctttgagtggttggtcaacatctcagctgtatccggtttgattgcctgggtgttcatttctgtcgcccatcttagatttatgaaggccctagagtggagaggagtatccagagacgagttgccctataaagccaagtacatgccatggtttgcctggtatgctgccattgctatcaccattattacattcatccagggttacgacagtttctttgacttcaacgcatctgactttttcactgcttatatttcgttgatactgttttttgccctatggataggagctcttgtgtggtaccgagaacccattatgcgttcagtcgcagacattgacttggataccgacagaaaagagatcgatatgctcatatgggaggagcaagagcctacaaacatttgggagaagttttggggtatagtagcatagagagactaatataattacatcatattgacagtttagtggtaaaaatgaatacttcatctagaatactactgttgatcctccaccgttgactagctctatttcgttatctctgatgggtcggtactgaaatcttttagacaaatcacctctgtattcaaatttaaggtctttagccacttgggaaacagcagatggtaccagattgttgggtgccagcggatgtggttgaccaatagttgatttggtagaggctttacccatgttagtatataggtggagatgtgacgggtgttatcccaattattcctcactaaaaaacttacctttgaagacatgggggcccccaacaaatttgatagagggcactcgagccaaagatgttaacgatactctcatcttcagttgtgtggtggtctttggagtagttctgttgaaggttatgtatggccccgactccgggttttccatatgcccgtgtagtgcaccggctgaatacgcgactattatctacaactcatctggtatgtatcaagcgatgtgacatattttctttgtagttttatgattccacctgggaaagctagccaattggaatcagagtcggatgagacgcaaattggtgatggcattcttttcacggatacttttactaactcggatagggaagtgattcccgaaaagttcatagttggacagcatcagacagatcatgagccaaacaacggctcggaaaacatatatgcgaaacacagtaagaactccagcaatggtgtctcaactccagagcctctatcagctaaaacgtctataattgaattgagcagttgtggtaagagtgagaatccggttaaaactgcgaacgcccttttcgacaatccagagagcccacacgttcacctgccatttcacacagaaaagctccctttgaacggatcattgataaacaaagtcatagatgaatcggacggtcaccatagctcaactccgcatctgaaacccagtccccaaaacactgaaggcctaagatctaagcattcaacagtacacagaatattgtccaacccaagcaccccatacgtgctcgctctttatctacaacttttttttaacatcttattagtctcaataataggctattttgtctattcttttgtatcaactgtgcgggcagatgttgagcacaagatcgaagattatgccttagatatccttcaggaaatctctgtatgctcaagagagtatattcgaaataactgtgatcctttgaaaagggttccagccttagagaaaagctgtttggcttgggagaaatgcatgaatcgtgaccctgcattagtaggcagagccaaacttggggcagagacctttgccgaaatcatcgatggatttgtcaaaccaatcagctggaaaactatattctttttgttacttctctttcttggatctattatccttgcaaactctacgtttggttcttacaggaaaatgacatcatcactcggacattcagacacacaatagaaaacctctcccacaagaatgcatttaagtttaaactaaccaaaagtcacaacaacaccatagccaccttccatgtggactcttgatgctagaagcatcatcatcctacggtttaatgcatagtcataatatcgattacataatcattaatatcaatcacttcatttttttttttccagcgaccactgactatttttctttttcaaccatagatagacaatatgaccacattatcgttggcagctaaagctccactgattgactatgcctcgctagtggcttccgcatttgttaacaccggaacagataaccaaatcaccttggattttcaggatgtcaaggagttggagaaggacattactgtttctgtctccaaagatgagaaagtagttgcctccaatattgacaatgtgttgaacttttttgccgaagaataccctcaagtcattattggtaaggaggaggcacaagaatggatcaagtttgccaaagatgagctgactgtgaaggattttaagaagctttctgtttccttggaaaagttagagtcacacctgaacttccgttctttcattgtcgggttcaagttcagtctctctgatattgctgtctggggtgtattaagagccaatcctttgatgggatcagttattaagaactccgtttacatcaatgttaccagatggtaccaattcttagagtcagataagagatttggcgctgtcgtggaattgatgaccaaatctatcgctgagatacgtaagctagctaagcaacaatctactggtggtaagaaggaaggccacaaggctaactttgacatcgatttgccaggtgccaaaatcggagaggtggtcaccagattccctcctgagccttctggatatttgcacattggacatgccaaagcggccgtactcaacaaatactttgctgatatgtacaagggtaagctgattatcagattcgatgataccaacccctccaaagagaaagaggagttccaagattccattttagaagacttgaagttacttggaataaaaggtgacaagatcacttactcttcggattactttcaaatcatgtatgactacgctgttcagatgatcaaggacggtaaagcttactgtgatgacactccaagtgaacaaatgagagctgaaagaatggacggtatcaaatcctccagaagagacagaacagtcgaggagaacttgcagattttcacagaagagatgaagaacggaacagaaattggtcttaagaactgtttgagagcaaaaatcgattacgagaaccctaacaaggcccttcgtgaccctgctatttacagatgtaacttgactcctcaccataggacaggtacgacttggaagatgtacccattgtatgacttctgtgtcccaattgttgactctcttgagggcgttactcatgctttacgtaccaatgagtaccgtgaccgtaatcctcaatatcaatggatgctagaagctttggggttgagaaaagtccacatttgggattttgctcgtgtcaactttatcagaactttgctttccaagcgtaagttgcagtggtttgttgataagggatatgttggaaattgggatgatcctagattcccaaccgtaagaggtgttcgcagaagaggtatgactgtcgaaggtttaacgaacttcattatctctcaaggtccttccaagaacatcatcaacttggactggaatttaatctgggctgtcaacaaaaagatcattgacccaattgcccctagacacaccgctcttaacaaggagaacattgttcctgtcaaacttactggtgctccatcctctgctgtcattgaagataaactaaaacacaagaagaacccagaagttggttacaagaaggttattttcatcgacaacgtcttggtagagcaagacgatgctgctacttttgaagagggtgaagaaatcactttcatggactggggtaatgtgattgttgataagattcataagaatgatgctggtattgtaacctccattgacgctactttgcacctggagggtgactttaagaagaccaagaagaagatcaattggttggccaacactgatgacaaggttgaagttgaattggtcgattttgaccacctaattactaaagataaactggaagaaggtgacaactttgaagacttcattacgccaaccactgagtttcactctattgctgtcgccgacttaaatgtgaaggatatgaaggttggtgacattatccagttcgagagaaaaggttattacagactggactctgataaagatggtaaatatgttttcttcaccattccagatggtaaatctgtcaacagatatggtgctaagaaatagataaagtatctagctatattgagtttgagttcttcttgataagtagatatcttattaggatctcaaacccgccgacaatcacgctcattccgatagccacaataacgaagtaaatgaaccttgtacctttcctctccaccaacgagtcggcaaccatgtcgaagaagtccaaaaacactttacatctgtcattgaccacttcaactctctgctcaatctcgagatagtcccttatggcattatacaatggatgcagagcaggttcaaaggaccagaaaaactcaggagtgtccagcactgtagaagacaagttaacttcatttcttagttgaaacagttttcctgtttttattaaaacctttttacgggtgtagttggctagttttccggtaagtgcaagcgctttgggtagtctagaaatgctggtaagaatcactgacattcttgattcgaagagtgacaatttgtttgattgtgcaagagcatgggaaatagcaagtttaatcatatgatctccagactttagcgtgatcatgtcgttgtaaattctgggcgtagtgatattgacattgtattcgaagtgaaactcttcggtttcgatgtactgttcggagactggttttatggccagtggtaaatatggagcgggtgaataggaattacttaagggagtcgattcagttgcggcctctgtagcgtggttaacaccgtccatttcatcatcctcatcctcatcctcatcatcgcttaattcgtattctcccggacgaatctttgcaaatacaagatcagccagaatattcttctcgttcaactcacttaaattccaaaatacaactgttccataatcaaatatgaaaacttccgcgtgcttagagagatctgggacctgggattcgttggaggtagtggttttcaaggtttcagtgtctttttcttctgtcacctctgaactgggctcaattggagtgtcacgaggtgagctgttttctgggaagaactgaggctctgaaggatcaaactctgcagacttggaatgatcttcgtcaaactctaaaggcacagatcttccttgaggatcaattgcctgatcactctcgtattcaacgccagaataatattcataatgatggtctttttgttcagatttatcaatatagttctccatccatatcttaccagcctggactttctcagaatcattcgaccgaactctaaccccgttcaaccctggaatcaacggcaaactgtaaggaacatacaacacctcactataccttcttggagacaccaaatgttccttttccagatattttgcggttagtttgagatcaaagctattagcaacaagataagccgtgacacgcgggtaattctgagctctatgctcctttgacatctcctccgcagttgatctaacgtagagatcagagttgaaaggctggtggacttttctgtacttttgcagttcttcatcactatcaggaattaaaaccagcttttcattgatcttggaagttcttgtgggtagggtcttagacagtttcggaatggtcctgtgttgaatctcgttgctcatgtattcttgggttaatcctctagcatgcctctgttttctaattgtatcatcataacgtccacttctactgggacgtctatttgctagtatagagggcagtcggtcccttctctcagaagatggaacgtcactcctatttccgagaactcctgacacggatacgtccctatagccagagcttgggtgggacctgttagcattatttcggctcaatctgtgaccagcaaagggagcactggcggagttttgcctggagtctgttaccaaaatcgaaggagaccttttggaatgggcattccgatcggtggacatagcaatcgcaacaagttgtgcaatggaaaatgtgtggaaaagacgagaggtcctttgctctttcaaagactacaatttattttaatagcagttactcctaaattgggcaatatccaagttgcattcgcgaagatgaacatcatgtaagttcaacctgaacctttcttcgctcctccccaagtagacgttagtgcttgaaatccgtttgcaataatgtcggataaagaacaggatttggatgaagatcttttggctcttgccggagcaggatctgactcggagtcaaactcagcgtactcgccagaacaggaggtgtcgaggaaatcaaagaaaatcgtcaatgattcggaggacgagaataatgacagcgatggcgaacagcttctgaatccatacccgctggaagacaagttcaaggatgaagctgatagggccaggctgcttggactgagtgaaatggaacgtgaagcaatactttacgagagatcacaggaggtgatcaaattgaaggagaagcatctgttgtctctgagagctaagcagagtcaattggaaaagaccgcaagggaagggcccaaatcaagcaaaacaaacaagcttagtgagcttaagaagcaaagagaacaaaagtctaaaagacagagaagtgacgaatatagtgatgaagaagacgattatagatacgaagaggttggtgataatgacgatgtcgaaatgtctgacaactacattgatgaagatgatgcggtctttgtggaaccaaagaaatcatccagaagtcaagaacttagcaagccagctacgttgagtgatataaacaagattattttcggtagaactgcaatgagcaaatactggtattaccccgaatttgacgacgttgtcaagggtatgtacctaagactgaatactggatcgggaggaaacggcttttctccttataaagttgtcgaagttctgggcagtcaacgtataaaaggaagcgcttatggtttaaacagtaaagaaaacaattgtgatatgtacctgaaagtagcttttcctaatcaaaaggagatggtgaggcctttgtttgtgttttcggattcttctataacacacccagaattcgacctatttctgagagagttggatgctgaagggttaagcgtaatggatttaagggacgttgattacaagtaccatcagttgaaagagatgtcgtctcgttctctatccaacgatgaagtcaatagcatagtgaaaatgaagcagagtctatcatcaaatactggctttaatactgttttgaagaaagctcaactacaagaggagttggaagaagcaagagatgctcatgatcatgaaagagttgcccgtattgaggcagagctgaaaagtattggagccgagtctgtagtggcttcaaaagcttcatcatctatgctcaaaatcgatcaaaggaataaaaaactaaacaatagatttatccgcaaagctgaaatggccgctgttgaaaaaagaaaactgcgaggcacgtcagaatcggatccattctacagattggcgaccacagcaagaatgttctacaagtcagccaatttgggggcagatgattcaaaccaacccaagactaaggctgaattggaggaggaagccaagcaagaaaagaaactagagatgcaaaagttagagtcaatggttaaaagtaactatagaaatggtgggttggaccgaattatttccaaaattgattttgactttgatctggaattatagatgtctcttctgtattgtaattaagaatcgaatacaacatactctgtgagtacttttttctcttcctcattcagtttaggatatagctctccaaatttaccgatgttgtgcacagcacagtctctgaaaaaacttttcagtaaatccttcaacgcttcatcaccagcgttggttttatcgttatcagagtcactatcgtatcctctatgctcatcattgtcaatgtaagattttaacttttcatagctgggtatgccaacatcttccaagtcttcccagccttcagtgtcatcattgtcttgtcctaagtcacctcctcctgctgcaacaactttatcaacatcgatagatcgttcaataatactctttgtatccaattgcttgcactggaatttaagctcgttgatcaaaagcttcaggattttcaacgacgctgtaatttgttggaagcgagttggaatctttttggccattgatctagtgataatgagatcagggtcaacattcggatcaactattaggtcgccattcactatcatctcatctatcctcatgtcaccaagtttgaagatagcgataaacgctttgacgttagttattatctgctcataccctctaacaatttcaaacacgttgaaccagatgggaaggatgatgtataaagcagattttttctcgccatgttcatcgttgatagtaaaatttgttaaaaagtctaaagtttcttcaggtgatatcaaagtcagtgtgctgaaaattaagaccaaattttctatggtgaccaattctttagttactgataatcggacagtaactgatttcaaaatggtctccaaatacttgttaacaatgttctggtctttgaagtaagtgatcaaagtaatgattaaatcacccaggtttaaaatggcactatcggacagttcgggggacaagaactttgatataaccttgatagtcatttctaccccactctcgccatcttctgacgaatactgtgaaactaaatgtgacgcctgtttgagcaaagcattgaaaacttcactggaactctggaggatttggtcatctgacactgacaaaatcagtttagtcaagggagaaaaaatggcagagaaaacgctagctggaagctcattcttaggagcctgctgaatgaaattggttagcagctccagagatagattcaattccggtgaatactccaacgttttggatagtgatgatgtaatcgtctccaatacaataggtaaacctttggaacaatgattcatataattttccaacgatataccggaaaggaggtcagctaaacattccttggcacttaaaattgcttggtaattggaaggatctttgtaagtgatggagtagatcaactgaagggtcgcagcatcaggagctgaattaagtctctgaatatcgatatttataatgatcgataaggcttccaaaagcacagtgtttgtgtcttcctccgaatcctctactaaagatgaaacaatgtttagcaatccatattggatatcagtctcaaacttggaagatggtatgaaatgattcaaataggtaaaactgatcaaaatagaagcatcaatcagctcattagtaaccggcttattcgccttaatggtaaaaatttctcttaatgcatagaccccaaaggaaatgtgatcaatattgacttgaaatttctccagaaatctggggataattaaaataattcggcaaatgtacaagttaaagctggcactatcaaagactccattgtcaaagtaaagtttgattgtgttaagaaatgcctctaatgtggaagaaagagtgtggttgattttcttcccttctgactcattcacaaaacatccctccaaaagaaacactgtactttcctttacctttaagtcgtgaagtatctcggagggattgtttgcaagttcagtagcatgcggagtgtatcgatcaagtaatgtgcaagtcagaaacgaagaatcaattttgttcaaattcgaaaggaaatccagtatttcggatcttatgctgaaatcaatagacataccagtttcagtggtaacaaattcattgaaatcggactcccaaatctcttcaacatcttggggaatgactgctagtttagtcagggtatctaataatgtgtagaagcacgactgatcttctaaggatgaaattttggaaaattctgaaagtgtacctaataaacttaactgttcactcagttcatctttgataactttcagtgggtctgagtcttctatatttacctctttaaaggaatcataatctctgaatacggacgtgatgccagctgagttcttcgtttctataatcaagctggtgcaaaccggctccaaaattgagagctcctttataattaacggtagcaattgagaagctagctgaaggttgactttgagaaagatccatgaaaactcattggcgataacgttcaagattcgatacaattcagctttataactctgaacattgatcaagtctaggaatttctctgatgaaaactcttgcaaaaacgaacaaatgatattaaccagttctggaatgatttctttcaccatcaatactctattatcgttgtcatgaatctcgggtccttgaagttgtctgatacaacttagcagtaatttcaaagtatcagttttcagttcaattggaatgtctctatctgctaataattgctggcaatgtttcatcactgcaagccccacgccttgctcaaagaattgctcatcagtgaccagatcgtcaaataaatcatgaagaactttcaagccacccagaattgtatagtagcgtctgtttggactattagtcagttcgtaaagatcattcaatagtgatggccattcgtctgggtagtcaacaacagcgatctggacaattgcgtaggaagtactacttctgatcttggagcttgggtcactgagaagctggagcaacgaagctctgatttcctgcttgactgcctggtcaattggaggtccaacaaaagattgaaaccccatggaccaatatttcggcacaaatcgcttcaaaaccagcaatgaagcctgcttgatgtctaattccacggaatctttcaacgcaactcgaatcagagacaaattcgttccagaaggatcggattccatgcacgagctcaaattcttctctgcagctgatcgctcatcgttattagcactagccagaaagcgtagggtctggattatattcgtctccattgtcttaagtgtgcaggcctacacgacgcgtagattcgatagtgtggtgagagcccttgctatgtaagaggtgagggagccccagacattgtgaagtgtaccacctaatttctcccgcgggatggaaaatatcccagtgtctgcagaacgccatcacctaccaagataaagctgacaactaccggctgaactataacgaaaatgatgaataatgacgatacattcatatcggatcaagaagaagatgtttggtaagttatattgtgttttttgaagcaacagaaagctcgctcaagacgggcttttcttgatgttatagtgtgttttttttgcttcgttttactaacatgcaactagtccgttatgtgtggaagaaatggatatctcagacaaaaatttcaagccctgtccatgtggttaccaggtgtgtcaattctgctacaacaacatccgtcagaatcctgaattaaacgggaaatgccctgcatgtcgtcggccatatgaagataagaacgtcgaatacaaagtgatttcccaggaagaatggaaacttaatcaggctaagcaggccagaaaagagaaagagagaaagcaaaaggaaaaggaaaagaaagatgcagagcaggcgtctcgacgtcatttggcaggcatgagagtcattcaaaagaacctggtgtacgtggttggcttgaacccaccagtgtctcctgaggaactacataatgtcttaagaagtgaaaaatattttggtcaatacggtaagattctcaaaattgtcatcaataaaagaaatcgcacaaatcaccacaatcataacccaggcttcggtgtttatgtgacttttgctaggaaggaagatgcttcaagatgcatagcggcggtagatggttctatctctgacgggagagttttaagagctgcccatggtaccacgaagtactgttcttcttatttaaagggtcagaattgtccaaaccctaattgtatgtttttgcacgaacctggtgaagaagccgactcttacacaagacaggatctatctactagacagggtttaaaaatgggtgaaagtccaagagctgctgttcatggtcttattccacccccggacatggttccctcaccaactattgaagaacctgtcgctacagaacgtcatgtggatacacaagtatccgatggatctattttaccttctactgcttcctggggaaagaataccaaagcgtcttctacaattcttccaactttccaatctcctagtgtggatcactcaacattgaggaataccagctcgttcccaagttttgcagagactcagcaacttcatgcaaacttgcatactccgcctgctcccaaaaagaaggaaaagaaatcggatgcacacgaatccttggatgaagtatccaaagaaattctatctgctgtcgaaaatattgaagaaactgtcagaactttttttcaatcatcaaattctggatatcaattgaagggagaatataaatatagaaagagggatattccgagattatttttatctggtttccagcaagccccggcttttttcgaagaaagtaaggatgggaattcggaggatatgtcccatttggtggacttgttgctgttttctcctggagttaagaactatagtttctacagagctactccaagtcaacagcagttacagcagcagcagcaatctcagcaggtgcaacaggcacagcaagttcaacaggctcaacaagctcagcaggcccagcaggctcagcaggttcaacaacaggctcagcaggcccaacagcagcaggcacagcaacagcaacaacagcaacaattgcagcagcagcacatccaacaattgcaacaaatacagcaactacaacttgcgcaacagcagcagcaacagcaacagcagcgtcaacaacaggaacaccttcttcagcaattgcagcagcagcagcagcaacaatatcaccaacctcaaacacaaggccaaaatttcccacaacagtacttgatgcaacaggcccaagctcaggcccaagctcaagctcaagttttagcccatgctcagcatgacaactcatccaatccaatgttcactaacatcagagaaggatctggggtctcagctacacctccacccccaggattgtttagtggagtgaccaatcacactacggaaactcataacactccatcatctgaactattgaaccagctgatgaacggggagggtagaaactcgatcaatgcttagtcggtgattatctgttatataagaagtacctattagttgaataaagtaataatattggatgtctgatgttccgaggcttccctagtccgagtcgattgcgcgcgtaaattggtgcttttcccccaccgaaacaataatgaggggatctccatatcacgtgatgcattcggtgtaacttttagtggtataaaccgcggtcggatgcactccgcctaacaaacttctgtgaggtgcgaaacaaggaacccgtaaaggaaaacctcattgattacctgttagttcctactttctcttttacccacaaggttcactctcaccacaatgttgccatttcaagcagtagccaaagcaggcctcaagccccaattgacccgcatgagtgtaaactcattgagagcagcttcttcctcggcgggtccaacaaagttgtctgtcagagacgctttgaattcagccatggccgaagaattggacagagaccctgaggtgttcttgatcggtgaggaggtcgcacagtacaacggtgcttacaaggtttccagaggactgctagacaaatacgggcccaaacgaatcgttgataccccaattaccgaaatgggtttcactggtcttgctgtgggtgcttcgttggcaggcttgaagccaatctgcgaattcatgacatttaactttgccatgcagtcaatcgatcacattatcaattccgctgccaagaccctctacatgtctggtggtaagcaaccctgtaacatcactttccgtggtcctaacggagctgctgctggtgttgcagcccaacattcccaggactactctgcttggtacggatctatcccaggtctgaaagttatctctccctactctgccgaggactataagggtctgttcaagagcgccatcagagacccaaaccctaccatctttttggaaaatgaactgttgtacaacgaagagttcgaagtttctcctgaggttctgtcccctgatttcactgttccaattggtaaagccaagatcgagcgtgaaggtaccgatatcacgattgtatcccacagcagaaatttgcagttctgtttggaggcagccaccattttgaaggaaaagtatggtgtctcatctgaggttctcaaccttcgttccatcaagccattggatgttcctgccattgttgaatctgtcaagaagaccaaccatctgataactgttgaagccggtttcccagcctttggtgttggttccgagatttgcgctcaggtcatggaatccgaagcttttgactacctagatgcccctgttgaaagagtgaccggatgtgaagttccaaccccctacgccaaggaattagaagactttgccttcccagacaccccaactattataagagctgtcgagaaggttctttcgttgaaagagtgattatagagttcaataatgcccatgatatattataaactaattttgaaaagatatacagttggctaaatagacctatccaccctctgtttgactctttcaagactcatcttgacgtctcccttagaaaagttttctagattgtaataaacgggagccaattctatcaaccactcaggtctaattgatgttactgttcggatgtagttcttggtcgtcaagacgaattcattatagattacccactcgttctcctttgcaagaacggtacttgggtggattaaaacgtcttggttatctttcactgtaatgtagcctttggccccagatcttttctttgcgacttgcatgaaaaatccagacgtaagggctttccggatgttatcgtagtatcttggatcttcaaagtcagttgatacgaggtgcaagtcatacctctccatcaacctttctaattgccttctaacgttttcggcgctctttagggatctataggagaggaaatgctctttacaccaagggttcaggcccttttcgtaggcttcctcagactggaaggcatgataaacgttcaaaagagttagatgatcaccatctgagtgggcaaacaaactcttcatttcatcggctttcttcttgttatttggtggacgcacaaataccgagggaactgacaacatagccacaatggtaagaatctcgttcgaacaattgaactctgaagaaccaatcaacataactgccaacattggatcaagagggaattgtgatgctaatcttcccagagctgtcaacgaaccatcgtcgtctaaacaagccagatagttcagctcttccaaagcacgcatcatggtttctggtgctggagggtccataaaatcgaagtgaaccaaatcatcaattcctagcttttttaactctaacacagttgaagccaggttgcttctcaggatttctggataactctgttcaattagttctttctggaatgcctcctcggtgtataatctaaaacattttcctggtctagtacgaccagcacgaccagccctttgctgagcagaggccttagagataggagataccagcaaggactcaactcttattctggggttgtagactttttgttttgagaatccagggtcaaccacatagacaattccgtcaatggtcaacgatgtttcagcaatgttggtggagatgatgacttttctaccaggacggccattgggagtaaatctttcaggtgctttgttgaagattttctgttgcatatgagggggcaaggaaccatatagcggatatacgtccactggaccacagttttgttctcgcaccagtgcatcagcttcaagggaaatcttccgtacagcgtcttcgatttcttcttcaccggtcagaaacaaaagcacatcaccctcgtcttcagtggcatggatctgaagaacggttcgaatggcagagtctagataatccctttgaaactcaggtgtatagtagatctcaacaggatgcgttctacctggaacagctaataatggggcgtcgttaaagtaactctggaacttttcagcatccaaggtagcagacataataatgatcttgagatcaggacgtcttttcacaacttgtttcagtaggcccatcaatatgtcagtagctagagtacgttcgtgggcttcatcaagaataatacacgaatatctggataaattgtgatcgtccatagcttctcttagcaacataccatcagtcatatacttcaaaatggtcttgctacttgttttgttttcaaatctaatactgtaaccaacttcttcccctaaagttacgtccatctcatctgccactcttgctgcaacggacatagcagcgactcttcttggctgggtacaagccacctgcgatcctaaaagatgaggcatctcgtcgtagagcacaaattgaggtatctgggtcgttttaccggaaccagtttcaccaacaaaaaccataatctgactttcatgaaagatcttaaggaactcgtctctctgtgcatgaaccggtagatctcttctcgttttcagaataccaaagtatttgctggaaaactgtttcccagtgaatggatttaagcttgccgattccaatctttcagcatctttagcggttgtcttatgacgttctaaaccgctgaactctccgttatcgtggacttgaagagggtgctcggcatcctttttggggtgacttaacaattccttttctgcttcttcggcagcatgttcgggaacagatgtctccactacctttgccttcttcttcggtctttcccgttcagtcatggggtgaataatttgttagaggaagatgtacagtttttctggagtttagttttttttttaaggcatctgatattcgctaaaccactctcatcgtcccgactctcatctggttggcctcgtatacgactccacctccactgccacccaattatctctaaccatgtccggaagaatactgtatgagacattccttatcgcttccggggcctccaaagttctgaaagggtcagccgagttgatttaccagagaacgtttccctcctggcatctagacagcaagctatgggaggaagcgaaacagaaagctaacgaagccagatccaaagctgaaaaatctgtcggaatccctccgctagattcaaaagaagtggaaacagatattttcgaaattgctaggcaaaaggcaaatagcgtgcgatccactgcagaggttgaaaactccttgggcgaagagcatagacccaaacctccttcaaacacgaaaggaccttctaataaaagagccttccacacaactaggttgaccttaaacgagaaccaggatattaagacaaaaaaggagaaaattctacaagaactggcccaaccggagtttcaaatggaccaatcttcggtaccaagtacaaggttaagcagactcttccattatggctctttggctgccggggttggtgttggaatggcaaaagaaaccttcaaaagctactcaagcggtaaatcgcctgaattgaaaagtctgatcatgtcgccggaaaatattgagagaattgcaaagaagttctccaagatgagaggagcagctttgaaagtaggtcagatgctgtccttccaagattcctctgttctgccccgggatatccaagtcatccttcaacgagttcaaaatagcgctcattacatgcctcaatcccagcttcataaggtcatgacggcagaactaggctctgattggagaaccaagtactttacctcgttcactgatgttcccattgctgctgcctcaatcgggcaagtgcatgctgctgtcaccaaagatttggaccctgttgtcgttaagatccagtatccgggagttgtcgatagtattgattccgatctgaacaatttactcctactgatgactgcgtccagattacttcctgcgggtttattcttggataaaaccattgcgaatgcaagaatggaattgaaatgggagtgtgattacattagagaagctcagagcctggacaggttcagggagctgctgcatgacgatcctgttttcgaagtgccagaagttctacatgaactgagtagtgagcacattttaaccatgcaacatatgaagggtactgaaattgtgaagggcaaatgggaccaagaaacaaacaattggattgctaccaacattatgaggctgtgtttgactgaaatatttaggttcaggttcatgcagactgatccaaactgggccaatttcctttacaaccccgaaactaagaagattgagttgctagactttggagcttccagagagtttggagaagagtttgtgaccaactacgccaactgtttgagagcctctgtgcgaaaggatcgagacagagttgaaaagtactcgttgaagcttggctatctgacaggaatggagaaagactccatgaagcaagctcatattgactcagttcttgttcttggggaaccattttctccagcagataatgctggcagctcctacgatttcagtagccaagatgtcactgacagagtccgaaagaacattggtaccatgttggaggagagacttaccccaccaccagaagagacttacagcttacacagaaagttgagtggagcctacctcctatgctccaagctacaggctaccgtgccctgtgagcagatattcgaagaggtagtgggattagagtacgaggagtaaagacgctgattaatatatagcacattacaaaatgtaaatagataacagccgtatagttattagcagaattcgcgtatctgatatttttttccctctcttgcatcaattgtgtctcagctcaatctataaccctagcagttattgagccaaatgagctatttcggccaagatcagaaagaaaaacggccttctaatcactttaaacgccacaaaagcttcttgagggcgacagaggacaatgcttccacacatagtgacctgggcgacctggatatctcctactccagaatcgatagcatgaaagcccccacaaggaagacttcagtgattctggcagagtctgggaaaaaagtacaaggggttttcacttatggcatggacgactcaggtgatgtcactcttgatggaatggaggtagaagaaggagaatatgaagaggaaggtgaccctttgttggctacttactctcctgatctggactcggagccctgggtggcacgcaaggtgaaagaaatgtcgcatttccagctttcgaagacacagaaaggcgttttgaagtcgtcaattgcctacttcttggcatctttgtccgtctattgcacccccatatcaaatttgttgggaaagattgactctaagcatgttgtgtgcactgtatgtgtctattttcatgccactagaactaagggttccatgattgaatctatgggatttgccattcttggtgtgacatttgcattcttaacatccattatttgcatgacagcctcaacattctacttcgatcaggggcatagaatcctctccattgcaatagatttactggttagctctattgcactgggattgatttccttcatgaaacaaagggtagacaagcccaacttcaacgtcgcatgttctctttctgccatctcactgatttcttgtatcgttaaagaaggaagtttaaacagtgcgcaagttccagttgagaagattagataccttctggcaatagtgtttatgggatcgtttgtttcgtgcattgtttgttttcttttatggcccacaagtgcaataactgagctgcgtacttcattgaacgaatgttgcaacgatatgtcacagctattgcgagttttgcccaataaatttgtcactatcgattccgtggattcagaagatgtcaaccaattatattcttcattgaacaacaatatgaagaaagtatacaagtctctcaatgaagctaagtatgagctgtatttgaggggtaaggagaaagagtttaaacatttttcagaaatggctcattccttggtcaaaatgagtggcagtttgtctggtctgaagacgtctgctgagatgcaatgggctttattgcacgacgaaactgaagctgctacttttgtcaatgatgtgtcgctcgatgaatttatggggaagtctttgaggaaatctagaattgacgaggatccattagacgcagatcatcattttgtagcattgaattcggcagaactgttcaaagtgttcatcttttatttaggtccttccatgaaatccttttctttcactatgagacaggtattggatggagttccgtttgagaataaacaagttcaattggaagtcaccaacacagctccttttcaacatagtttgaagctagcttctgatctgttcaacagtagacatatgaaagctttaaacaggctttatggccagaaattgtttaccgaagacgctgatgttgaaagcaaaatcaatcaagaagaggttgctgcaagttgtggtaattttgctgcattgttatctgatttctccaatgaattaagtgggttcttgtccgttctagatgagtaccgaattttggtagactccaagagctacgagtttctgaaattctggaaacgtaacccaaacaatagctaccaagcttttaggaacaataatcgttccaggcctaccgtcacattgaatgacgcgctattaaagctacaaaatgtaaaaacaacggagaacagtgttcaaagtggatccttgagcttcaacttgtggcgtctgttgcggttctttcaaagggtggacgttcagtttggtttcaaagtgggtattggagcattctgcatatctctatgggcattcgttgaagagacaaaggccatattttcagaatggaaaggtgagtgggttttggtgacgtactgtatcatcatgaataaatcggtaggaggtactgcaatgacgattaattggaggttcctgggcacattcttaggtgcattcagcgcttatgcagcgtggtacatttttgaaggggaagtctttggactagctttggctggatttctgatatctgttccttccttttatatcatacttcaatggaagacgaataacgcctttggtcggtttattttattgacttacaaccttaccgttctgtactcgtacagtttatccagaaatgactatgattctggagagggtgatgatgaagaaggtggaacgaatccaatagtttccgatattgcaatgcaccgtttctttggtgtttctctgggagttgtttgggcactggtaatcaccttgcttttctttccaaatagcgccagaagtagattgaggaaaggactatgcgttctttggttaagaatgggaataatctggaatagtgatcctcttagttacaaatatgatgagtttacgcaggaaaacaagatggttggtattgctgatagaaaagccattcgtcgtattattgcagaacttgaggtttgtttgaaacaggctccaaaagaactgagactgaagggtccattcccgcaagatatttacacccgtctcctgaagtctacacataaaattatggatgcatttgagaatatgaacagtatcattgacgtggatccaatgatcactgagaatgaaaaagaggtgattacatatatccagtcggagagatctgagctagaacatcgcgtctttttaatcttctacatggttgcttctgcaattcgattgggcttcccgttagccagcaagcctgcatcgactgaacatgcaaaggatagaatgctagctaagctaagtgagatccgacatcgcgtagccaaagataaggaaaacagcatgtatttgacgaaccaagactttgttttgttgtactcttacattctggttacgtccaccatcactgaagagctggacaagattattgcagatgtcattgatcttttcggtatagtcaccgaagaaacctttgacatttaaagggtcaaggtttttccccatagtttttttccaaatcgaggcataagtcgtcctcgttggttgcgagcccggtggcgttaagagaaaaaaaagtcagtcttataacagagtttcttcttcattcattcaatacacagaactttggccatcatgtcagacacacaaatcacggcggagaacgagttaggtcagcagctgaagtctttggtgttgaaaaagcttcaatcaatcaatttcacagacgatccagaatacgtttccgagtttatcgtgattctaatttccaacaacaggtcaccagatgaaatcaccaatgagttgtccagtttgtttggagacgccatcaatcaacaatttgttctgtccattttccaggatatacaaggactgaggagtgacgcacagattcaacatcaacagccccaatatcagcaacaaaatggacaggaacaagtacagttacaacaacaacagcaacagcaacagcaacagcaacagcaactagagcaacaacagcagccacagcaagtgatctctcaagcaccaaccacaaacagcctaccccctcaatcggcttttgctaatattcctgatagaccccgttcatttgccacaaacaacaaacgaggccgtggaggaattaataagcagaatggtagaaacaataatgccagatccaattttgcccttaagaatgaggagaattttttaagtgcaatggattcgacaatgaacatagcccaaccatccaatcctgaccaggaggtcgagggatctagttttgtttccaagaagggaaaccgttgccaatacttcccacattgcaagaacaagcagtgcccattcggccatcctacaaagacctgttttgcattccccaactgtccaaatcccgctggaacttgtaattatcttcatccaggtgaggatgatgcactgattgccgagctggagaagaccagaaaagaattccaagaaagaaagacgtttagccaggccaaattgatgaaacaagtggaacgtcaagttcaggagcagttgaagaaaactttggagcaaggtcaaatcggtatatgtaagtttggcaatatgtgttccaaggaaatgtgtccatttggtcacccaactccagctaacaatgctgctcgagtcacggtgctagaatggtgcccagaagacaagcaatgctctaatccggactgtccaaaggctcatcgatcacctgaacacaagatcaccgaagaagagaaacaacaaaaacaacagagggctttggaacaatgtcgatttggtaaatcatgccgtaattacaagtgcccaagacgtcacgcaactactcctgtactgtgtcgtgaaggcaacagttgtaccagaccaaactgttttttcactcatccaattgatgaggattgtaagtttgcagctggatgccgcaaccctaactgcccatttaaacacccagaaggtcgtgagattagtgctggtgcaccggtgactaatgctgtgtggactcccgaaactggcgctactagtgaaagacagtttgctgtcccagaggaccagattatggaacaagttccgttgcaaaactaataactaccacatttgtacattaagtaaagtttgaacaggtgaaatagattaatatttgactatttaatatctctttctgtaagaagcagaggcctcgtcggcgtaaacgtcgagaggagactcggacaactcgtagtcgtcccacaaagttggggtcaagaaaccgtaagtgttaccaatggcaatgaaggcagctttcaaagtgttctccaaagttctggtggaaccaccggaggaagtgtaaacatcttcaacaccggccagttgcatcatcttcttaacggctggagaggcaacaataccggaacctcttggggcaggaatgattctgaccaaaacggaaccacacttaccagaggtcttagaagccaaagagtgaggggcacccaagttggaaccccagtaacctcttctgactggaatgatagacagcttagcgatgatgatagcggctctaatagcggtagcaacttccttggcagtcttgatacccaaaccaacgtgaccgttggagtcaccaataacgacaacagccttgaatctggttctttgaccggcactggtttgcttttgaacaggcttgatcttcatgacctcatccttcaagtcaggcaataagtggtcgatgatttgaaattccttgactgggagagagtgcaagtaaatctcctcgatggaggtgatcttaccggcctttaccaatctaccaagcttggtgactggggtccaacccttctcttcctcacctcttcttggtcctctctttggtcctcttctacctccacgggcgccaccaaattgtctttggccttgtggggctgatccttgttgagctgatgctggtgcttgagacatattaactacactgaaaaagtcggaatgtacgtggaaagccgatggtggtggttttcgatcgacggtattcaatgattaaagaggagagtcttttgaaaagtctgagattatttttttcccagcctgccgctcgcgcgccccaagcgttttgaagcaaaagtgagtatttattgccctggataaaaatcacgtgcatagataacaagtggtgtttgggtctccgatttccgaacagtcatgtgcagcaaggcgggaaattgcttgattgcttagttgcttgagagagaggcaaggcatgaatggcatgggccaaagggtttgaagggggaaaatggttcgtagtagctcaaccagagataccacgtatgaagccgtcgtagttttcatatatcttaaccaattaggtttctccataccattttttcttgcttgatagtatgcttgctccgcgctctaaccccaggcggaaagctcgcgtgtgtcacaaggaccgaaattgcgatgatcccccaatcatgcagcaaatgtatgaggttatcgcaagacgtggatttgaccacaattcttttccccctcccatttccatctttcagttaacttttttacaagcatcatgaggtaagtaagagctatcgcagttggacgaggcagacggatctcccgcctgcctcgtctcgcacatcaaccaatccccgatattaacactgatagtacctacgccgaagctgccacacccccagaaggagtttccgctggcaagccaaaaccagttccagaagtcgaacaaacccaagaccctcatggatcagtgcaagttgtcgacgagattgccgacgacgctgagaaggtcgtcaaggatgcatcggacgagttcaagaagagccacccaaagactgagaaggacctgcaacagttgttaggcaaaatcaaaactacccttgttgacttcgccgccaccgttaaagaggccgcctccagcgctgctgtccgttctcaggaggagttgaagaaccctgtcgtttcatcccatgttgtagccgctggtgttggagccgccgttgtagttgcctccaaggccggcaagatcaacaacgttttctctctagaccaattcaccaagaatcaaagagtgggcgttattgccggagtaattgccaccgtgctcattgtggacggactgctaaccagtaaatattatcctaagtacaagaagaattgagtacgtttgcgttgtcttgatatcgaccagtaaggtaagaggattagaaatcgttccccaaacaatcaagataaaaaaagttaagtactgagcgatacgggaatcgaacccatgtcacatgcttggaaggcaagtatgataaccactacactaatcgcccatctcttcggcgggtattttacgagtgctgttaaatagtacccatggcttaatttttccgtacactaccttcatgcaaagaaacttattctgcaacaggtacttcattaactagcaatccacttgtttgctattgatttcttattttggttaactcaggtactgtttcagcacacgcttgtgctaaccagccgaccaacaggatgcgtcacgcctattgttattggtcgaatttgtgagctgtttcacttactttttcttttcagtcagaataaagccgcaacttctcaatgttgactgacagctgtaagcgctattataccaacccgtgttgataactaccaaataggacgtgtgcctgaatcgggaatcaagttccgatccaaattgtagactggaaactctacctactggacccatacccgactttcatccctagcttgtctatggtgtagccgcttgagtcagaaactgttcaataccaacttcccgggccgtccgatccataaagttgtgactcacaaatggtgacaaaatcgctgacgatccacctatcttgacacaacgtgccgatcctatctcttctggcagctgtcaaagtatgattacacgatgcagcacgccatggtttcaagattgtgacaccacaattacgttcgattttaccgaaacacgtccaatttcagctaaactggttccaaaatgacagactgagatgatgtaaaaagtatcgcagggtgcagaacaatagagctggataatcgctcaacataatgtggaaggatatcgcaagttggaactgctccagtgtctaccagctagtgttgacagtccatcttacgggtatgcattgcatcctcgctgcaggaatatgcaagacagagcaaataccactcgatacaccaccacacccataaacaatgattagtcaccatgttcaagtggtgtttggatttacaaattctagatttttgatggctcaactaaggaaggagttttattctagggcacaccaccaccacccaccaactagcttccaccctactttcttttctttttgttttattttatttttttttttttcccgttttccctgccttcaatccaccttgactttcagccccacctactctcccctcttgtggattgtcctagaaaccgtgccgtgcgatcttttcattttcatcctcctttccgcacactatcaacccttttcggtgctgagaatccaattctggggctcccaaaacggtggctgcgagatgtttaactttttgctcatgcaagcataactcttggtttgtcctctgcttttgaactattcacaatgccacttttcgtcgactttcgagcatctgagaagtttctgaaaaagaatgcgagtacttgcaggctggttgtgatcgaagggttggaatatgcccttgtgcataccgcataaatgcccagttaggatgcagtacttactcttcaggataacagggggctaatttatatatggtctatcctgtcgtcttttactgccttcctttccaatactggttcagttcaaacaaataagattcctttgtggcctttcagtacaggacccacagaaactgacttgacaaacactattcagtctgtttctctaggtttcactcagttgttctccccacttaccgtcacttttccaacccatattagttgcttcccaagatgcagttttacttagctactcctaccactcctttcgttgataacttgacaataccctctggtagcggggcttatagcaaatccaacggcaacaatagcagcagcttcggtcatagttacaacggaaaagaagagctcactgatgaccttctgactgcagatttcgtcgacccaccaatcgacgacgcaatattgtactcgatgctatctcctttcatgaatgctactaccgaacaaccacaagaattccagaatgaacagcagcatcagaacctttccggttgctaccaggagctgctggttcaaacagaggaacaacaacaactggatttgttgcctaatatgcaccccgagaatattttcaattctgagtcttctatgttcgtgtactccagtatcccgcaaagaaattctgttcactcgctgatcagtgtcaacacctcttctcttgcccccgattctgctgaggggggaggcttatcgtttgtggacaccataggcccatcatttgaccattctgttgaaacctcactctcttacggaatgaactctacggactcaactctaccgtcctcagcacgctcctcggtaggacttgacctactacccaccgtggcagctcctgcgtcatccgtttcctcattggaaacggtcatcaactccaagagacaaaagctgcaattcagacagcacaacaggattgaagaactcaattctccacacggtatcaaagcacaggcaccggtgttgcttaactactcaagtcttccgctggttcgtggacttagctctggtgggaacaacagcagacctcccaaagagccattaattcctggagcacagtacattactgcccttctgagactagagaacagctcctgcgaggacttatgtctaccagaatggaacgaggacgaactgaaggactgcagaaggatcattcgcatagagagaaaacgccactccaacgagatagtggcgtcattttctatagtcggttctgccacgcagaacccacaaatcaagccagcatccgactctgacgtgcaagtgttggaagtctcatgtttacaatgcctcgtcaaccataacgaaactgacgaggggaaacaaggaagctccccaaacgaaatacagcatagctctgcagagccaccgaaatcgaacctcaacaggacattgagtagtagtagccacagagcagctgggagctccgtgggataccagtactacatcaccagtgtggaagtcatcaagattatagaactgctagtcggaagccatttaatcgaagactcgcagcaaaagagaaaagaaagaggccgcgtgagatcaaacttggtgcccttctggtcaaaacatcccgtgtcctcgtctaagaagaccttgaggccccgttctggaccagcttgcaacgatgactaccttgcagagttggcccatcgtatcatgacatacgagatacgcaggccgcgaatattcgacaagaacgtacgaattctggaatgggccaagcttgccccggctttgcagcgggctcttcaaagctactatgtggcggtgcccctagatgaatccgagaataaacttgtataaatatatggggctaaaattgtactatattttctattcagtatttttgagccgtcgggaaagggcttaaccttcgagcagcccatttctttatctaggaccaaattcaaatctacctagaaacccggaaaaaccatgacaatatcgtaatgagcaaacaacatgccgtaaatatgcagcatggctcaaaacacaacacaatcggatgagatatcaacttttagttgaataatgcgcaattagtaccctttacatatcaaaagtgatagtcaccatgcatacagattaggatgcatacgatacataatcaataatttaatgggggcaaagataccgctttgccgcgtgaaagtcgagcaaaagtgctgtgtgcctccacatgagcccacccacgaatgtggaagtctgtattcggcaattgtatgcgtcgattactatccgtatttggtcagtttttccattcctatttttcgcgttcgacaggtctgctgataaacctgccatctggcatcgagaaaatacataacgcgactggtacaaactatctcagctcctcataaggcccgctcaaacaaccgttcatgctgtgtcaatgctgatccagccgttacaaacagtgttgcagaatgctccttccttatccacgggtctgcccacacttgattcgatcttggatgggggaatccgtcgaaacagcatcttggaagtctctttcgtgccaggcgctggatctgaagctctggatctgattctcaacgtggtgctggaagtactagaagcgggagaacgtgttttgtggattcaaatgggcagcttgtttcccatccggaaactggtacaattagacaggtttcacggtccaatgctggaccaaatcgcagttattaccatctcatccctggcggagttgacgtatctcttctccaacaagctcaagaaacagcctaggggtcaagatcaaaagtacggcttgatagttctagaagacctggcgtcgctggtcaactactcgtttcacaagttgacaaagacttttaccaagagaagagcagttgtcaccgaccacaataacaacctggaagccgagaaaaaacttggaatctccaaggtgagactgcctagaaatccgtactctgcggccgatcgaagactgcatttcctccaagaattgatgctcatggtctcatcttacaatcgcacacacaacagtgtcagtcttctttgcggtcccttgaacacaaccaaccgaaaggtggggaagtctaatgtcacgcaaacgatattgcaaccaatgttgggctctactggcgtctggctgcatcaaatagctgatcggttcgtaatcttcaaagattggtgtaggacgaacgagtctgctgggctacaagttttgccccatatcgctgttcaagccaacccgcggaatcccaaaacaccccatccgacaaaagttgttgttttcagcagatctagggagggcatcattgaggtttccacaaaaggaagaaacatggatccagagacatcaacagagaggaaagcgggtagtgaagccgaagccacaacacagcccgatttggaagggagttcacaatcaaggtgagtccagccatttttttcttttttttttttttatttcaggtgaacccacctaactatttttaactgggatccagtgagctcgctgggtgaaagccaaccatcttttgtttcggggaaccgtgctcgccccgtaaagttaatttttttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaatgcaattctctatcgtcgctactttggctcttgctggttccgctctggctgcttactctaacgtaacttacacttacgagactaccatcaccgatgttgtcaccgagctcaccacttactgcccagagccaaccaccttcgttcacaagaacaagaccatcactgtgaccgccccaaccactttgaccatcactgactgtccttgcaccatctccaagaccaccaagatcaccactgatgttccaccaaccacccactccaccccacacaccaccaccactcacgtgccatctacctctaccccagctccaacccactctgtttctaccatctctcacggtggtgctgctaaggctggtgttgctggtttggccggtgttgctgctgccgctgcttacttcttgtaagtatctccagtcgtttagattgttagatattttctttgtgtattcgtttcagtctgatgtttatgctacaaacgtcatctggactttaatccaataaggatattcttcaacttaatagtatcttaataatatttttttttcttttgatttcttcgtaaggtgttttgttgcactcatgatctacgacttttgttcgtgactgattctatttcttttggtagactagtatatacgcatccttcccgtcgttggtagaagcgcctacgacctgctgtggagtgagtgggactatgttcgtgtcgtctatgcgaagccatgaatcacggtcgttcttgacgtcaatcgtgtagtgtcctccctctgtgctgttcccgtggtggtatatcacaccctggagctggtactcgttgttagtctcgccacgagacaagcaagcctctggaatggtcagtgcatggccaaactttattatcttctgaatcttctgaatacatcccatctcagcatcgttgtttttgctgtgaaatccgttctgggtggagccagatggagaaggtgatggagatggtgaacttgactgtggaactggagtgcctacgtcggatgaactctcctgtctcacgtaggaaaaccttttcagatgaataattagcacctctggtaatttatcgatcatattttgcttcgtagcttggaccagattgccgttgcttgatttgtagggtataacctcgatctgagacagatatgtgaatgcatcttccacagaagaaacattgggttcagagatatccaactgaacatgcaaaaatgggtctaacgttatggatctgccgtttttctgtctaggaacgttcagcactgacctaaattgtcctccgaatatctcggtgatcggggacggtttcacttcaactgtacgcttggcagataatttattgttggatccaacctcgcaccacccgtcatcgtcgtgcttatcctcggtatcatatttgctttttggagacgagcctggctttttttggatcagattcaacgcctcagagatctgtttcttactctcaacgttattcacgctggcaagaagctgactcttttcagtgtctgtgagtttggtcatctgggaaatgaactcttcgtgcaattcgtccaatacataacccatgaactcttcagcatcttcctgttgcccccatcgtaaatgagagaacttgggcagtgatattatagatgtgtaaaatgactcttgtgatagtggttccccgaaatcatccacagatgctgactcgtgtgactctttgtgttgaaatcgttccaacaacagagtcaatgcatccaaaataggtgtgtcagacgtaccagaaacatgagctatcgtcttttctcgtatgcaacggagcacacggaacagtggcttgcaaaagatgaacaattgtagaaccgagttcatgtagcagatgttacccctgtttattaggccatgaggaagaagttttacatcaggaggtttttggtaatccttgtcgtacatgtatcttagtagcacagcacctagaggttggaattgaggggacaattgagatgacgaagctggcaatgaggttgactgtttaatgtggttagagggtgagtcctgtttggttaatttattctggtgataattcgtggagggttttaccaacaacgaagcccacgtcttgtatgctgcaggcttgtcttcgacttttttaatggaggatagttctctttgtactttcaatgtatatgtagggtcagagtgaagccgtctgttcctcagtgacagctgtttaagatggtggaaatcctgtcttgtgactccaacaaaaaaaggcagttgatcatgttccgagtcattgtcagccgctatttggagtttcaaatgtcgtcgaaaatactcatcaattttgtgaagatcatcactggtcagttgaggtgatgactgggtaccagtggtcatggtcgcctatggtagaattgataaattttgctctggaaaagggtagaaaaggagtcgttatcgcgagatgttgggaaagttgttggaaggtcattgctcgcccagtaagggccccccgggtggtagtggcatctaggcttgttccagcgagcacctatggcgaatcgcctaaagtggcagattagagatttacattagtcccagttgtcgaaaggcctgatgttgactgtaaatgaacaataagcgggctaccaggacccatgaaatacaataaaaaaagaaacgcttagaactaaataaagttaaatgaaaagaaaagaaaaaagggcttttaaacgaagagtacgttgagcagcggaactactactccaaagaaagctgaccatttcagggtatttgcttctccaatttgcaaagaaaccgttgaagggggttgagaaacggtgacagatgtactgtgggcctcattctgggacacgtgaatactttcggctacacctgcagtttggtgggaggcttgggaagttccagttgcagcagctgcccagtcagagcctgatgactccaagaccgtttaaagagtactcaattcaaatgttggttcatgcgtctccaccggaacatactttggaacaacagttgtagaaccagagtccacaacagtagtttgcagaatttctccagtcacaatagtagcctgcgtgcaagtttgggcatcacatacctctcttgtgattgtaacagttgatggatgaacataagaaacggcctggctgtgtttcgcagtgtagattgtttgcacaacctcacttccgctaacacttgctgtttttatagtggcaacgtcagttggcaaaggacagtaagtcgtcacgacagtagttctatcatcgattgtgagagttcgctgagtcacccctgttagtgctgtagtcttggtacacttactggtaccacaactggtcacggtaataacagtagttgaaatagcagtgtctgtcaaaacagtttcagtcgacgcaaagtgatcatcaatagtcgacgatggcacaacggcgatggtgcttccatcagcatcggtggtgaaagtggtgaaagtaccggtccaagtagatgtggagtcgatagtagaataaggagtctggacaatcacggtacctggctcagtgccacttggaatcaccgtggtcgtggcttcaaaggtaccagtccatggttcggtggtggttgtgtaattttccctggtaactatttctgcttggcattgttgttggttaagagctccaaattgaaaaatgtagttttgaaaatctgttagttcactcccgtctggcagtgtcatcgtaaagttgaacacggcacgcgttcttatgttggcaaagaaagttcttacgggatagtatctcccagcctccaagtattgagtgtacgtataagagtcggggtttgttgaagcttccccttctttaatggtaaaaagtgagtaatcagttggggcttcgtccaagggaatcaaattttcattgcaacattcaaacgcagtctccctcccaaagaaaagaatcgcactatcatcgatgttccttagtgatagtccataatttccagaggcgtcagctctgaaatagcctttcaattctaaaagcatattttggtagttgacgtttggtatcccataaagtgttgtggtggcaacgcctgcagtgaagatgttgaaccccggattagtcactccagttgtactatgcaactggttacgttgcaagtacccagtgctcataaaaaccgggtcctgtattgaattgtcatcacttgcctggtactgataaatagtagcattgaatccgtcaaaaggtgttgcaccgatgtcgcatgcgtaggcagtgtcactagtggtaccgttaccactttcttgtccatgtacaccaaggacacaaaatagctgcagtaaaagcagaaacgaaaccacaaatttactcttctcaaacatagcaaaccgtgtagtttttatgagcagttaggcttgaattgacactgcttaaatacaaaaatacttgtggaccatcttgaaacgcaacttaaccatatggcacagcattaagaaacttcacgcctcaacgcaatgcgaattcggtaaaatctcagtaacggtattactcaaagtatgtcgtccatgcatgaaaacacaacaaatctggaattcagtgggttgcttttcttcccacaagagcataaaatcaagcttgcgaatctcaaaagaagctcgcaacgcgatccttttaagcatatgcttgcagcaatttgaatacggtttaccatttttggcactaatagagtaagtagttttaattattgatgtaagaagccaagacccgatggcaagatggaatgaaattggatatttgaaaaagatcgattatcttaacagggatctctatcagtactctgaccataccctccaatagacttgattttttcaactcgctcaattaccagctaataagagtattcgctttgttccacaacataatgcttggatcgtagaaagaataataaagttccaccaaatcccgtttcccagcttggccattttgttgccctattttgacacaaccagtatgtccagaccttgaagaaaaaattatgtgggttgctgggcacgatctaagtatgcgtttgaaatacgcagtacctttccctaaacgcatacattacgtcatgtccgcatgttttctgcatgattatagttcgctttcgtgcaacaatatacgccgtaaaaagcgatacggtttggagtttgatgtcttttttttagcatcttcggatcaccaatccgaactgtgcatttgaagctagaatcttgtggtaatatcaataacctgcatcagcttctggatattacttctactgaccccacaccctactctgccaggaaattattctacgttgctatttcacgatagggcctcataaattgtagttatctatctaggttgcaacgaactattgcgaaattgcatgcatcgttttaggtatttaattggactcaagaggtaatcaaactgccacattgtgaaactaccgtttcttctcaagcaatttggatgcaagccttctaaaataaagcaggtgagcggtgcatttgtttgggtgttgacagaaaagttaacaaaatggtaaaagtgcagagtagaaaatatttctgcagtattcttgagttaatatctgtttcaagctcctttaatgtgaagttggcaagctgtgcaaacaagaataatcaacgataactttaaaaaagtaaaaaggaacgttttaatctgcttcaaggatatgactggaggacgcgttacttgaacatcaaaatagaaacgcttttgccagatatatcaaatttttcgggaacagtcatgctcatcagcactcttgggtttaacaactaagccactgactcgtggtcacataatgcatctgatacgaattttctttcagacaggttggattcaattcgaaaatcgtataactttctgctagtccctgtttcaaacttgcatgcagcttgatctgcgagtcttcaaaaaagactgcaaattgattctttgagtatgaaatgttaccaatttgaaaccaccgttccattttgggcgcagccaacaaaatgtaaagcaataagccaataatagtatagcaacagtccaaaaatgtcaactgacattcttgacacaaagattgacacaattgttattggtgaagtcattgccctcgttagacgaaagctatcattttaatcaccatgatggttttaagcctcacataggtgtgtccagcattcatccagcagtatataattgttcatctcaaaggcctctcgcaaaaaaacacccaaatattttctgcgattgatcatgcaatgtgctctttctttttaatcatttcgtcgatacaactgtttcaattgagctgcaaatatcaacgtaatagctagcaaatgtgtactcatgcatcataagtatgagtctcctataacagaggtataaatatactaaggaaccacattaaaacgcagtaacatcacccgaatcagtccaggtgcaactaaaaactcatgtttcaaccactcgagcaagaacaacaactggatttgttgtttgccatgcctccggagaacatttttaactctgactcttctgcacttaccttttccaatacttttcaaaccagttcagttcactcggtcacaggtgttgacagcccttcacttgttaatattaatatcccaaaatcagaatcgttctttatggactcaatgacgggtgcatcttttggacaaacttttcaagacctattcccagcgtttcctttgctaaaacttcctaccatggtagcacctccaacttcgttgaagatggtcatggaccgtaaacggcgacagtcccaaataacacagcagaataccactgaaaatctcaattcctttcatggcatgaatatgccggtaccagcgttccttgaatactcggccttcccgctggttcgtggcttttgctctggaggaaaaataaagccgcctaagaaccaactagttcctggaactgagtacgtcaatgtctgcttggagttgctcaacgtcaactatgaaggcatttgtttacctaaatggaatgagaaagaacttgaggaaagtagaaggattgttcgagtagagaaaagacgtcagtataataaaattgaggctgccttttcaatagttgattctgttcaagaaaatccacaaaccaatattgcagttgaccctaacgttgatgtgctggagttttcgtgtttattgtgtccaatcaaagaacacaactcagaagtagcgcaaaccgtccctacaagctcttcaagtgaagaacacaagtacagcgagctagcaggacacgactttgaagaaaatttgagctgtggtagtgataaagaaattgagacttctgttagatttgaatactacatcaccagtgttgaagtcattaggattatagagtttttaacggaaaatcatctaatccaagatatccaggcgaaaagaagagaaagaagctgtctaagatcaaatttagtgcgattctggtccaaagatatagttccatcgtccacaagtaccatgagcaagggttctaagccatctcgggaaaacgattgtattgaagagttggcccaacgtatcagggcttataaggtgcggaaacctctaatagtcgataaaagcctaagaattctggaatggtccaaacttggaccagctttggagcgggctcttcaaagttattacgtagcgttaccattggataaaattaaaacaaagttatgaggagtaactattgatgaaaagtggtcttaatttgtgaaaagattagttttttttgagagcttttcaataaataaaggcatttgccccggtggtgagctaaagatgcatctttgtagtacacatgttgacttaacaagcttatccgattaaatcattagtctgttccagatttgaggcgtccgcaattgctttcatatcggcttccccatcggcccagcgtgttgcagaatatctgcatatcgcgcatctttacgcttttggaattctgcattgcatattttagaatatgcaatgcttttgcattacatcctttgcatgctttttaatactcaaatttaactgaaaaaaacgcatacgtgaatggattagaacacttttgccaattgcaggtccacttttgtagacatgacttaagtacaccagcaagtgaaatcaaagtactttcagcaaaacgtccaacctagttatgcgcttctgaaatagggaccttcgcgactgcatcgcagtctgcacaataataacccaacagtacatctggtgatactctgtcaaaacgacagatcactggcatctatcatcaaaaattccaagtgccagaatgtatttcgtacgtcagcataaagccacaatgcaataaccacttaaccaattgggatatgcatcaataagcgttcaaaagaagttttattgctaatcacttacttcttttaggacttgagaatgaaacgccaatgctttgcgttttagagatacattatatcgtacaaacctggatataaacagaattgaacaaaagaaataaaatagatgttgggactaaatgactcagttgagcgtactctgtatcacccatctggtcaacagctagcctaatctgtacatccaaaaaatgactcaaaacaattgagtaattgtaaacgaaacttctagtaattgacaactcccaatccattagtaatagtaatagatcccactataaacagcccaataatatcatcccaaacaatgcctcatactcaaaagttactctggacaagacgtttgttaatctattgggtatgatacgtctcagtttgtcattcgtctttctcattaagaaagagaattcatcccggatcaggtatgcaccgttggctataactggactaattacggtgcggggtactcttaaagctcacggtttaaatttttgaaaccacaaatgatgactggaacggttatctgggagcgtgttacaatattgtaaacgtttaaagctttggttcaagtgccttctttgacctcgtctacagagggtcccaataagaagggccaataagcgtctagcggaaagatactggagcaaatctggaatccctaggcgtttcactatcatacttagaacaaggttagcttcacaatatagccaaacttgtttgtattacctatgagtaagcttcggtctcacattttgccgtcatagacaatgaatagcagtgattcggactactgtattataatcccaccctcagttcaacctccacagtttgttacgctgatttacgggtatcgccacctgcttcggttaggcaatactttgtactcctcagtcagggaagtacggttagatcttatcactgctaacaagcctttttgaaagtaaagtatttttactcaccacccttgagcccacatatacaaggacgagcacgttcaccgctttcaccaccgatgctgatagaagtacaatcgccgttatgacattgccaatgtatgcttcggtcgacacccatgtaccaacagttgaattgagtacacttcaaacagtagtggagtcatcgggttctgagttggcagctgtagccgaaagcattgccttatccgacaatgaggcccaaagtacatctgacaccgtttcccgacccccttcaacggtttctttgcaaactggagaagcaaataccctgagatggtcagctttttttggagtagtttcattgcttaacttgctcttcatttatagagggagggtccttttttcactgttcctttaagttcgttaattctatttttgtttcatgcttttcttttcatcgaatgtactgaatcctgaagcttaaattttatatccaaggcacagcttcgatcatagaaattatggtgtaaacttctggtcacttcggacgctattagccctgatatctgtttaggcaggcgtaatgtggtactattacaatgctaataatcgctagacgctggatgtgcattgggtgttcaaaagccatgcatagagatctagtataaggttcattgttgcatgatagtacttttgtagctgattcatccaggattcagcatcggcaccttgtgcatcatgaaaacaacgagaaaatgtcaccaatcatggctagataatcgcagctcatgtgtcgtataaaagaatgattttttttctagaaacgttagcaagttctcttgttagtaccacaatatggcattacagaatcgactgcctgtagttgaccaatgtacatgcacaagtatccatcaataaaacactcaaaacaagcgttctgttcgaaccagaaacatgtaaccccatgcaacaaaacccttcactggatctccaggccaagggagcacacaacccccttcgtattagatagcagcatgcaagatggtgtctctgtccagtaaaagcacaactaaaggatcaggtctccaccatcataatagacagagagaagatagaatgcaatttcgcgtatggtctcccaccacactactaggtcagtctcttggcggcttaactacgattgatcggacggaaaacggtgcttcctgctaggtatggtcgcagcgaatcgtgccaaatcttgctgggttatacccaaaaatatggcattctacaaacttaatagtgttcaacaatatctacgttgatcggtccaattctcaggatcatttattgtctttggaggtagcttgtttgagatgatctagaatttgttaggtctagggaatatcactgattcaactacaggcaacaggatcattaagttacacttactctcgatctacacatttactgcagcagattattgtcagtgtgaacaatattgttgccgttaccgtaaattcttatcctcaatttccactaaatatgaaggtccgctgaacttaacagctctaaacctttcttcagctccagtcaattttctaggtatgtatgtaacgtctaattaattttacttatgaattatacctccagaaacaacgtaaaggattttagtcagtctttgaagctttggtgaactttggctcgctcaacactcatggccttgcaaggcaagcaaaaaattctcaacttaactcattagttgagattcacagactcaaatggtcggatggcttttcgtttggcaattttcaaaggtcacctcaaaagttaatatccagatatatctgagagaagcattctttttgcaatctcacaaggcttaaaactaaaccagttgcttcatttcaccttggtaatttgtcagggaaaacgaaaggcatgtatcgatgaagtcgttcacttcgtgcagttttcagacgtaataacgtttttgcattattcaaggtgatagctgggacgttatgcatgtacagtaattgcgcactaacatacaatgcatcatgcaacggttcatctctctgtgtcgctcttgaacatccaatgcaattcaatgtggcacttactcggaaatgtgaaactaccataccgccctggatctgcctaccaatacccctagcatgcattccgtcaccccaccccttctctctcagagaaaacatagcttacaccatttcagataatcctccatttcctctaggttttctacatgaatcaggttctccgaataattggccaaaaaatctttgttcccgtcgtaaagtttccaggctagaacatgttcacataatttggaactcgattgttccaaaagttcaataaaagtaggacaagaacaaaaacagccgtccttttcaatcctataatagcactccccactgttgcctgcctttggagaatccttcacaacaaagaatgtggcattttggtactgaatctcgtacatcgaacgcgtctctaacaactcaaggcctctgtaaaaggtttttgggtataaagctgccagggcaaccgatttggcgtcatcaacctttatagaagccatttcacttccacggcccgaacggaacaagccttctatcaattggttggctatttggttgaactctctctccttttcttgctcatccttctccatctataaatcgcacaagaaagtgttggtttgggtgttaaaatgaactatacagtggtcacgtgatacttaacctataagatggtcctcacagactttaccccagattttcactccctcggtcatttcctcttctggaagataactaaggcataaacgaacggaatgaagcccccagtgtctgggatcaccttctacttcacatttgtctccactagcaagtaaaacattgtaatttgcactcaaatcttgaacaattgagcgggtgtcgtacttgtccggaagggttacccacatgaaatatcctccattgcctcctgtatatgttgtacctttgggcagatatgtgtctagcaggtgtttcaaagttttggctcgaagttggtaaacttcattgagatgatgaattattctgtctattgttcctgtactaatcagatcagctaccaggaaagacgacatttgtcctgcaacacctcctgatttcacaaaacctccctgtgataatacttccgtcagatgtggggatgcggtttcctgccaacctactcttaaacctggcccaacaagtttactgaaagtacaattggccactgtattcccgtatcgagatgtgcgagtagctctatcgatagtggatagtctaggcaaaagctcactaccatcatatctcaagtaatcatagacgtcatcagatatcagcaacaggtcatactttctggccagttccactagggccactctatgttcatagtctaacactcctccctttggattactgaacgtggggatcaaatacatggcaaaacgataaaactttctgggagcacgggaaggatctgttgcaccctcgacattgtcgctcatgatgtcttgattaatagtggttttttcatccggatcagtgaacttaatcagcaaacgttccagctcttccaagtcaatttgcccttgatcatcttcctcaattgcagtcaatctaccgccaagtccagcatcaatgagcaaactattgacgagaaaatacgtaggagtcacaacgaagacctgtttagtcacctttgggtgggtgcattggttcaaaatagtagtggcaccagatgatgccccgcctgtgatgttgataacatttacatcagtttctgagaacggaaatgatgactttctgaaccatgaatcgttccatttggctataatttctcgaatatcgtcatttccaaagtcattcccatactccagagggcctctattatctgacccgtcaaactcgtaaagatcaggtctttcttggaacttcctcatgacacgaactgatgcctctgcaatctcaccatatggcaatagcgaagatgttgggtgcccacggaaaaagttgattggagttttcattgataggagtgaaaataatgagagtggagacttacgctctgtccggcaaaaaaggtcggtaagagacagccagtcgcgaaaggagatggtgaagtcactagacggggtccttatgcagacttcacactgatcaccctatggaagccgtctgtacccaagtggaatccttggctgctcgatccttcaacctctgcaaatgaaactcaactggagagccttccaattcggcagagatcaagtagtaaagtctaggacttagtgtaacattattgaactgtgtttcgagacactccataactctatccttatctccaactgataagagtgctctgagatgatagaaacagacttcctcgtctttctcaacgtctttggagtgtgcgtaccactggtcaagcaagtccaacgcggcaccgcctttatgctggtttattagtgcgatgacgagactcagtagtaacggtcgacatatttcttctctcttggaattgtagattaggttggcaatctttgtggaatcatccaggatatctgtgcttgctaactgtgtttgcagattgggaagttcaactgcacggatgttcatattgttgagttcaagcttgtagaagagataattggcactagtcgtgccacaacgtagcatatctgcctcgaagagggatatacctaataaccttctccaatcgtacgaggctagaaggacaggattttgtaaatggagaaaccttttcacccgtatgataagcttgttggctccgtattcagatgccagatagacaatgttcttgagcacattttcgcccaggaagacagaccttcgagatcggactatatattttagccaccacttctccaccaaatcgattctaccgtgctctagagcctgggtcaaaagcagccttattagctgggagttaatccgtagatatgatgtgccttcaattaatcttatcatgtaaacgaggggatccaaaagcccctgacgggctacatgataacaatagttgtccaatgtaaatcggttcaagggcacattctcatgaatgcagttatcaatcaaaatgaatgcgtgtctataatggttttgaatggttagtgcgtgcaacaaaacactggatatcaatgacgttctagggagagctagcagaaagtttgttagttctaggcctaaggcttcttcctcctctattaatcttgtagttgtgttcaaaagttcctgctggacgttcaattccgcgtcaatatcagcccctgactgttctgacagtttggacagaatatgcttgaacaattccagtttctgctgcaacggtctttcgtatttttcaatgatctttatcaataataaaagcgagtcgttgtccagctgataaaaatcactttgaaacaccgctttggacagccgatcagacaaatcatactcctctaataccagcaaattcactagcagctggctgatcccggaactgtcgaccgtagaaagttgcagaacagagctgttgggcgaggaaaacaaattgatgtagtcttgggccgattgtttcaaatgcacgatgcttgattgagtgcccatctggacgttcaaactcctgaaaaaatacctgctagacaaatggccaccgcccatagtgcagcgggctactcgtctaagcatcacaggagggacagacgccgaaaagggtgtaattctgggatcgtttgatcaagttcccttccttgagaaatgtaaggtgagatggtttgttcttggatcccaacaccattttccactcgtctaccaacatcatctaccaagacttttcacttcatcaactagagcaaatgtttcctaggatcctgaagtctgggtccagaccctttgccctgattcactcagcgcccaaagttcctgcgctgcgcgctacttttcctcttgtgggtgctaggtttaattcttcatccagttctgctccaattgatgagatctctacgaagctgcagtctttccctgaagctgccaacactttcacagatacagtgaccacgcttacgcatgatcaactgggatacttgaactctgtgggcatggctcaaagctggtggtggcctccagatgttctagaacgtaccctggaatacgtccatgtctactcgggattaccatggtggggtaccattgtagctactactatagccatcagagtggtcatgtttccactattcgttaagagttctgacactatggctcgttctgcaaaggccaaaccagagatggacgagtgtatgaaggttatcagagatgcccagactgtcggtgaacgtcagaaggctgctctaatgagaaagcaaattactgccaaatatggaatcaagtacagatatatgatggccccattcctacaatttcccattgctattggatttttcactgctcttcgtcacatggctcttctgccggttgatgggttccccacccaaggagcttactggttcccagacttatcagctgctgatccatacctaggattgcaattaatttctgctgctacttttatgacttctatgaagcttggcggagaaacaggtgcttctaatttttcgcccggcactcagaaactgttaacatatgttctccccacgctttctattcctttcaccatgaacttatcctccggcgtggtcctctattttgcaactaatgctgcctgttctttcgtccagagtgcattactaaggaacaaggttttccgcaagattgcagggttgcaagaaattgttccacgagtgaagaaaccaggtgaggaggctgaaggtatgtttgatggtatcaagaaatttgcgcaagagacgaagaagagtgccgagtccaaggcagcacaagctgctgctctggaagaggctttgaaggtccgtaaggctcgttccaagacgggagaggtaattattcgtaagagaaagtccaagaagtcttaagaggcactctatccacctctccagaatatcctgtacatacataagcttgaatatacaattatagctttggttcatctccaaatctgtaaataccccatcccagggaaaatgtctcattgttgtacagctcttccacctcctccttctctccagctccgccggccacaaccagtggaaggaaatgttctgcggaagggtgagacttgaggtacagtttccttgattcttcgttggtcaagatggttttgaaactttggagttcgcttggcttcttgaacaggtttctcaaaacttcattgaagccaaaggcgtagggaaccacctgtttgggatattgcatggaggccccaatatcacccaagttatggacggacattccggaacagacaatcacaccgttcttatctctaaaatttcccaaaacttggcccaatttaaactgtatatcaaagtcgtcagatcctgccaatgaaacctgaaccaacggaaagggaacatcgagattcccagaatcggctacatttggctctgtgaaagcgggtttgaatggtacccacacaccgtgatcaatgcctctttgggtcagtttggcttttatgccgttttctgtgagtgtctgtttgattgtgttagccaaatccatacaggacagggaatggaattgttctttgtacatgtgactggggaacccgtagaagtcatgtatcagctcattttccgatgcatcaagtttgttgtccatctgaagaaggttgggcactgcaatctctacggtatccttcaagttggactgccaatgggccgagacgacaatgagaaagtcaggattcaaaatattcctaatgtactttccgatggatttagttttgttgaaagccccagtatctccaccaaagtctgctttaggatacatgaaagtggggccaccatggcttaaaaaaaatactggggttttgtagtccttctggactaaatcgaaggaagtatgacgttttgtcattgcagttttcacaggttgagttgaagtgggaaaaaacgaaaatattttgttcgaaaacagggacatacaaagtgttaccgcagcaagtagaatgtagaccgtgttcataactcaactgtccattcaagtgacagtcgctttcttttatgagcacggcacaggcacacaaaaacacaccactccggccggcagatactgggatgagtaagagattattaagtgcatattgacatattacgtaagatgacctcaaagggaggttactctgaatattgaaaaatgcgggccacttgggcaataaataagggttgtgtattatacaggagtatttcagtatctaagcaatggactgtaaagttttggcaatttggtcagcagagaatccttccaggttcgtcttgacttcatggcccttttcgagtctggcagtgacgcttggtggaattccgtaggcttccctgattagaattggtaaagttgggtttgcctttttgatagctgggtacgttttggtcaggaaggatctgttgtgttagtctttgagtttatgggggcctttgcattagcttgtggatgcatgaaagtggcaccaaatgtagccaaatttggcttaaaaacttaccttaaaggaacagaagcctcaccagtctgcgacaggaagaatctgagttccttgacgacttttggaaaaacaaacttggaagacatggatgttgatagcttgatggatttgatgctgattgaaaatgtcgctattgggtaagcacgatcagaaagtacacgaccttgatttggaggtctgggagagctggattgaatgaactgtatagggaactcaagaaagaggtacgatggtattctgttgtgaaatgaagtgaatgaataatacacctgaatgaccaatttactatatggctgagaatggaattcaagttgagatgtgggagttgttctgagatcttgcaaaatacctttccagctttccagcttcctagcactcatcttgaagatatcaaatattctccattcaaaccaacatcaaaaaatagaataattataatcagtttgaagagcaagagtaattttaaaggaaacacattcatggtcagctagaaggttgactgaagagtcgcaagatatctgagaataaaaaagagcatagctaacaagatgagtaaacacggcaaacagatttaggaacaggtgaagggtttctggctcttcaatgtatatcctgctagccacccattcagaaataacacaaagtaggaccctactgaaaaataaatttaatacatcttcatcctctcattaaaccaccgaccactcaaaccataccagccttgtccaattccatgcatcgtgctatccgtcagaattttcagtgttaatcgaatcggtcattatagctccgtctggggcgacaacttgtcatcacagaatagcacaattatgcgttggaatcgtcaaaaaatcacctccaggtctgtatacatacagaactggttgtaacgacaaccttgtttgattgaggtgactggaaggtggaaagaaagggaggaaataaatattgcaaggaaagaaaaaaaaattgttcacagtcacctcttcaccttcgcgatttcatgtttctttcatgtgctaactgatcccagggcttctccagcgcccttatctgttagatggctccaaggtgtgttccgcagtgttccaaattcaagtggagagacctcgtagagctatcaggtgatcgatcagagttttctcagttgtcagtcgtagcccatattgatgtcaacgccttttttgctcaagttgagcagttgcgattagggttatctaaggaagatcctctggtctgcgtgcagtggtcgagtatcattgccgtgtcttattcagcaaggaaatatgggattaatcgtatggatactttggagtctgctctcagcaaatgtgaagggctgaaagtgggccacaccgctgtgttcaagaagggacaatccgattggagctatattgattaccttccaagtcctaaagatcataaagtgtctttggatccttatcgaagggagtccaggaagattatgaggattttcaagcttcgttgttcaaaagtggagaaggctagcgtggacgaaagtttcttggacctgggtaatgttgtatttcaaaagttgctagaattgtttcctgttttaaagaatagtttggacaagtcgtttgacgattatttgccagaaattccagaagaattaccagagggtcttgattttaaaggcgaagttattagatgtccagaaactgacgaccaagacggactagttctgcaggattgggacgatattgtcatgcttttagcatccatggaagcacatgacatcaggaaacagatagaaaaagcgctagactacactacttcttgtggaattggaagagtcaagacaattgcaaaactagcttccggtcttcataaacctgataatcagactattattcgtaattgcgcaatcgataattttttgaacacccatttcaagttcacagacttttggggtatcggtccaaagaccagtgggattatcaagcaaagactacttgtaccagaagaggattcgatcggctatattaaggagaattttacccaggaagagcttgaattgaaactaaaagatccccagctggctacgaggttataccaactagtgagagggctctatcaagaagcaataaacaccaggattgacatcaagtcgatgggctcaaacaaaaactttagagggaaatcggtgaacagcgttaaagatttgatcgactggttgccagtatttgttggcgacctcattcagcgattgactgaattggacgaagagcaaccaaattgtatccgaagaccaaagacggttgcagtgcatctctggtcttggaacggagcatattcaaagcaatgcaccgtccctaaatttatggatctattcaagcttaaggaagtcataagtcatgaagccgaacatctcataaaaacatttgcatcaacctttgataactcacctgtcagcctctttcctttgcgtagtttcagtctaaatctgaccagctttgaggttatcagctctaaggagtccattgacaagtttgtttcctcttccaaaaggaacagagaggagcacattgactcattattcaagagtctgggtgagaacaccaagagcaagccaaaagttgaaattgaggaacctaaaaatggaaatattacaacttttctaaaaacacgtagccaagttgaaactgtcaccattgccgcttcgtcggaagatccacaagcatgtcctcagtgtggatctcatattcctgaggaagaaatggtcacccacaaagactggcactatgccatggaacttcaaaaacaactggaaactgaaacacagcctaataatcagcccctcacagatgtaaattacccacctactagtcgaaagaaagccaaattggataagaaccaaactcgtttaccgttcttcaaataaatcctagctttatcatatttattttaacttaaaacctaattaagtaactatttccttttctgatctcgaaagcctaatctaccttctccacatgcaaatcacttcccccactggacaaaccatctgccttttcctctctcctctgttttcctttcttcagaaccaagcttaccacccagcaagaagcgcttcacatatctgccaatcttagatatgcccccgtctgaagagatcaagctgagagcagtgtctccgaggcccgatttcaaggccaattacttagagtttgccaatgctccggcaattgtcagagccaaccagaaggactcctattttgaaacagtattacgggacaaactccaaaacgttattcagatctttaaagggcaaagattcacccatacccatccagaagagattggcgtagctgcaaaggcattatatttatctctaacaacgctactcggaactaaaacactaggggaagaatacgttgacctaatctatgtctctagagatggtaagagaatacctagatatcttgcaagagctgggtttatatttgcgtacgccatcttgccttattttttgaccaggttatttcggcgattaaaatcctcgtcaacaccgaaagatgaagtgacggaggaaaagatcaacaaagagctaccaatctcattgagaattgagaaatatttatcaaatatgtcatattcgaaggtgctggacaccatcatgaaccttcacatcgcagtgttctatttttcagggcagttctataacatatccaagaggtttttctccatgaggtatgcattcggtcacaagattaacaaggaaaggacaccaaatgggaactacgaattactaggagggttgattgtactccaactggtcatgaaaagtctgggtggcttcaaaggtttgattggctcattcaccggaaacgacgagcatgatgaaagcaatttgagggcgaacaataaggatatcatgtatggaatcccctcagaagaagaacaggaagaggcaaagcaacaattaggaatcatagacttatcagatccgggtcaattaccttacattccggagtcttcaagacaatgcatgttgtgtctttcctatatgactaaccctactgcagctaattgtgggcattgcttctgttggagctgcataatagactggtgcaaagaaagaccagaatgtcctctgtgtaggcaaaaagtgttggaacagcaactgttaccattgcattagattattctatatcccaactttaaataagatttgcttcttctttcttttgtcctttttatcggttagagcagcatctaaggagttcaagtcgacaaaggaggagttcgcagaactgttcaatgaagaacttgcagacatagccggagaagatccccattgtcctggtccattttcaactggacgaactctagggtacttcttggttgtattttgaggtaatgcagggaacttttcagggtccaagccaaaagtttttggtttaggtttctgtttggttctggcggattgaatactagggaatgctgtaggagttgataaagtgctttttgcaggtttgggaaaacgttgttctgaaagaacacccttcttgttggctctaattggattattcccccaaccatgtggtgtgaatagatctgtgttgttgagagatgggtacttttgattgaattctgtctccctgtcatgggcagcattgagctggactaaatcaattgctttggaggagttcttagggtatagttcagatagatcatatattaggaggttaatctcttctggtttttgaaatttaaacaattcgttgtaccttgaaaggaggttttgagcagttaaatgtccagcatcgtaggcttcattgacggtgataaactcatcgaacttcgcagaatcataatgaatataatgacgggctctttcttcaaaacgtgttctcttgacatcatgtgcagtagcttgggatgggagtgtggataattgcgatctaaatttattgttattgtgaggggtggtaacactcttagagtttgaaccgccgaacaaattcaatgtctttcggttaccgaccaacatcgggtgttcactgatcatatgagcttgaaggtcaaattcatctttgaataccacaaatttttgatccagacattcttgaacattgcaaggaaaatgcacctcattgaaatgattgaacagctggtcataatctctaaagtattggggattcgttggatctagttcgttgcatacatgacacttttcatgcttttctctgagatgtgcgtacaactcgtcatctgagtagaaatgtttattgggacagagcatgcacacaggatgtcctttgaaacctatttcgtctcctgaaacttggtgggtttgtaatttcttttgcgtgtataactttagttctgagggaaatgcatgcttaaagttggcacatatcaaacagaactgtctgtcatgggcctctctacagtgttggttaagttttttgaaagagccatactccttgctttccttacaggagttcaatggacacgtcagtttgagtaaatccagtgttgcaccagcagcctcttcactagtgaatttcataccaagcttgttgtcattcgggataaaatcctgaggtttgtaatcgtcaaatatgggtttcagctgatagtcagccgtcacaatgacagactcattctctgaacgacacactaaacattggttcttcttgtatagggctctttgccgaatggaacacttgttacaggtcaaatgattgcacgtggtaatggagccatagactatagggttggcacagataatacaagtagttctcttatcctcattctctacagcgtcttccttggactgaaggccctgtgtcgtatttcgggtccatttgattttttcttttcctgagtcatcggatttggcttttctaggaggtctcccgcctcgtcttttggacgtttccgacatttttcgggcgatgagtcaatgtgaaattttgggtcgaaggtattattttctcagttcatcgatgttggtaggtgctaccctcgatttcttgaacgctgggaggaaaaaaactatcctggcagtcttccggcatagagccctcccagcgaagacgtaggtgaaccccagaatatctggttcccagcatgaatgtcagtgcaactgtgaacgtttcaaggcttctcatcaacccatcattatgtttaccccatatgatgatccccacatttaaagatctacccatcgctcctgcatttccgttgatgcccgagaaaggcatcagagccatcgtactagataaagacaactgtttcgccaaagcgcacgacgataaagtctggccagcctaccagcagacctgggatgcccttaaaaaacaatatccaaaagccagtcttttaattgtgagtaatagcgccggaacgaacgacgacgagggacatagacaggcgtccaaattggaaaaagccactggggtcacagttttgagacacgcaaccaagaagcccggttgctacaaagagatactagactacttttatcaaaacaaaattatagagactccctctcaagtggtcgttgtaggggaccgtctcttcacagatatgctcatggcaaatatgatgggttcttggggtatctgggtgaaaaatggagtagtgaaatcagaatctatgatatgcaagatcgaacggagattttacgactacttgactggcaactctatgagcccacctacacctggtaaataataaaagcgatcgatatcgtaaattaatcatattaaattttgaagtacctaaaggtatgccatccaagcagagtctgtgtacgccaaattgcgtggattgacagcttgagatatgagattcaacacaaattgagtagcaacgttctgactgttaggaatgtggttcaattgtaaaactctctttgtaagaagttcaacgttgacacggacaatttctctcaattggttagtttgggcactggcacgatgttgttgagcgaaccaagagatcacttcatctctgacgaaaaggctcaggtactgctccatgtcaaactcgctgtctgataagctgtttgcgatcaccaaaatatagacggatagaattccctcaagacctgcttcaccaataaacttttgaatgttaggtgtaagacggaaggggacagattcagtgttgtagaaaataggagcccctgctttcactgctggatctaatgtactgttattataggcagtactatgtgtctttcccgtagcaacctttgttggtaacatttctgaagtccaaatgtttcctgaaccttcgttgatatgaattttctgaggttgacgactattaatgcacataatataagtcatgaagatgaacgacgcgtattgcgcagtaaattgttttctaaacaaccaataattctcgtaattgctgaacttttcagtataatagtccttcagtaaggtagatggaaccaaggtagattgaatcgaggcaagtacttcagccctgacactaacaatgtctggtttaggaagtcttggatcaaacgcagctctcaacttttgaattgtgtaagcaaacggttcatctctgctctgtcccttacggcgacaaaactcctcgtaaatacccatcagtgtagtatatcgtttatcatcattcaaaattctgatatgtggtgataatggtactgcaattggtaaagtcagtgaaatgttacggcgtcgactttgaacctttcttgaaagagcgtcatcaaaaattctgaacaattggaaaatacgttcttctcttcgacaatgacgagcagctgggaattggacagcaaacggatgcaaacttccatcattacctcttatagtcattctcttgtagcaaccattacttcctctcacgagatccaatgtgggtaaaaatctttcaatctttatgaaatggttgttgttatccttatgcagcaaatattgtcctggaatctctatgtcctcaaacttttgatgatggaacaaactcagatgcaaagaaactcgctccagatcagctttaccatagcttctgtccaatttctcttccaagcagtctctccatttacgtagttttgaaatatacgtttctagattggggttgcaggcaataatgtcttgttcaaagacttctctaatgttctttggcaaaacggaatcagcaaacctggagattgatgcttcagtagcagcaggtagtttaacttcttctctggggttagcaacacgattcatttgttggacaccatcgttgtacagaacgataaccaatctgtatgcatcttcatctgcattgcatttgaatctttggttaagttgatcaaccaatgactctaatgatagtgctaataatggatatgctgtcttgagaattcccataatttcctccacatcttgccatggttgacgagagtctgtggttggtatttctgggggatgtttctgtgagctttcgccattctcctgtgattgagcttgcggggacgcctgagtcgttgctggtctggaaggctgaggtgaaccttgctcttctttgggaggtatgcttggttttttatccgattcggcagttgtccctgaagtctctgttcgagtctgtggttggggtgtgttggtgttcttcaaaacactatccgcagtatcttgtttattggaactctgctcttcagctctgttaactgccatggcttgtctctgaatagcctggtaatcttctttagtggtcctaagttggaaatgtaatgactgaggatagctcttggcaatctgaatcaaaatatgacgcacaatcttagcttccttatgagaaagagaagttaacaattgtggtacaaatgtgatccaataccaaacaggtgattccccatgatggtcttcaaaagttttagctaaagagccagcggcatcatccaaactaatcaaccaaagaatacggcacaataatttacgagtttttccatccttgtacaaaccagctgcctgcaagtagcaactgattgcgttcttagcatggaaaatctcctccggattctccttaaaacggcgatcgttaaagaatccccattcagcccaagctttaggcaagttcaggtcaatttgcacagcagttgcaaaagcctggttcgcctcatcctttgcatttagcttagctaagaacatacccttcaatgtgaaaaattcagctttttgttgagtagcaaagtataccaaattagtgttgctgataacatctaaaccggtgtttaactcagaactgttctgatagtgacatttagcctgttctctaagcttcaagaaagcttcttgaatttcaatgttaggtaaagtgtaaatcttggttaactggttgatacaaacttcgggcatttcatgttttcttgccacatgtgcaaatctgttgatgacccaagccatctcatggtaacctctataagcataagaattaccattattcgtgccatttgattgctgcaaaacaggtacaaatggcatataaacacggttgattacgccaaacacatgttgacgccaggttacaaggtcgttccatatattgatatcatcccaaacattaggtaaacgttctctccatgcttgcagaactcgttttaattcttgtgacttgacatccagattttgagcatttgtagtgactaaactgctgtaaacttggctagcttccatgagttccacgtactgctggaatgtatgtaagagaccaatatgggctcttgtaactctttgtggaagggcattccactttcttaacgtcaattggataccctcatcacatagtctagacacatcttgcaaagtatctttttgttgagagaatccttgaagagccaagaaagtctgaaatatctgtcttcttggggtaggtatatccatgactgttttcactgattgctctaaaggttctctatctgcaatccagtcagctcctctccatccacactctaataagagatccgtaaaaccctcgtgtttagccaactcggtaagaatctcccagtgctgtaacttttcagcgcagtagatccaatggtcttcccacaaagagtattcggactctccaaagggaaacacaccacttcgtgctttgatttgagcggcctcatagagctgcaaagctttgtcccatataccaatctgttcataagatagggcagcattcgtctcaaaatattttgctcttcgtctccatgtaccataaaacatatcgtcttcttgtagcgacatgtaaacttccaaaagagcatcctggttggcatctgatattttctgattatcaattccttggccttcactcagctcttccagaagcttgatagcaccataccaggcattgtaattggatcccaagtatttgaccaagtgaggaggtaggtgtagtccagggcattttccaacaccgtccagtagcgacttgattacgtttggacgagcatcctgctgcctgatatgataatctttgaacagaagttttaccaaagcacgagtgaattccaattcataccggctttcaatagcactataggcaacaggaaaaacgactacccaagcattgtgaatagtttctgcactttgataggaaatgtcaatcaaaggattgaggatatctcccgcggtcaagcttcttacagaatccaaaaactcattatgcttggcaacaaagtcaatgatattctgtggcgccttttcaactggagatttttccctagctaaaccttctgtaatactttgaagaggagatagtgtgttttcttctggtgaaagacgaatcggactgtctaaatgaaaggaaccataaagcagctgtaaagcctggttcagccagggatagtcggagagatattcccagttttgatccttgataatgtagaatagtctcttgtcaatatcgagttccaaactgtcacttagaattgacataagcttctttctgatagagacatcagaaagcctcgttccaaacaaaaaggctgtttccattcgagccgttaactcggtatgagcaagttccttactttcgaatatatccacaataacttggttgaactttttagataattcaggttccccccttaaatcgaagatcatcatctttcccagtataccagctttttccttggttgttgggtaaaaatcagttttgaaaatccattctgtgacaatatttatcaccttaagtagcatatctttgtccacagatctatcaatcagctgggctagtaaagataagaaaacacgtcgttgatcatccaagcttgaaatacgtgcagcacatagattcaagatcttttccaaaaggttagtagtaaccttggcttcaaactcaatgtttgcaaaatctccagattgtggctggtttccctgcaaggaaattgcaatatgatcacggcatagcttattgaaggttctcatgattgagggcaacagactgtccaaagcatttggtctataaagtgataaagtccaacatagagagacgcccgcggccacagaagtcatgttggacaaatcctcaccgatgatattgacaatgagagagatgaagttggtgacctcctccggttcatcttcttcagacccttgtgtttctttatttatggcctccagtatgattcccaagactttttgaagaatttcttgtatgtcttgattgtcagatcgcagacatttctccaacaacttttgcaggtagcttacattttcgataatccaagttgttggtttccacttcaaagcaactgcaagtacttccaaggcatttaggcagtatcctagtaaacttggctgatttagatctgatgacatcaggaaacgttcaaagaattgaagcttaaccgtcacttcagaccagtattttggaccaagtaactcataaagaatgttcaaagcacgtttacctaattcattctctgagggacgctgagtactgatacagatgtatctgatcaagaaagttacacaggcttcccgctgagcaaaagaaacttcgtagtcttcagaagtcaaaatgttagacgaatcggaatcatcacccccaatctggtcttctgctttgggtctctccgcaatgtcttccttagtttcctccttaacatcgatgtccatcttgtcttcactgacagacttttccttctcagtctcttctgcacttcctagcttttcagacttgggaagttttgtctcccatttcaaaatcagctcagctaagtcaatagccaactgttggttctccagggatgtatttgacatgacagttaattttcccatggcagtgataatatttgggatgaaatgatccctggctgggtaaaataaatctggaaactttacaattagttgatagatgttggccacctgtgtgatattaaatccatcctcggataaaactctacgcggccatttgagccagtctagttctgagttcgttctctcggataaaacaggggcaagcagctccaaagcttgtttgaccagatatcttgtatctatctggtgacagcgtaacaatgcaacaaagatacgagtagtcagctcagagggagtatcgaagcgggaaataaaatatgccgttaccacatacgctgcctgtttactagtgttatcatcaagtttgatatagttccaactaaatttgatgatatctttgcgcatatcggtcaaggcagtgggagcaccttttatcaaaagagcagttagttgcatcaactctaaacgataacggtcttctaaagttgaggtatagtcgtcaactaatggcccagtggctttccaaacatcagaatcaaacgatttcagccaagccgggagttcgttgttctcagtctggcttagtctggataaatctccatgcatctcagattcatagatacatattggaaggaaaattcttttgtaaaggtaaactctagcatccaaggagctgacctgtggtgtcattctaatgatagtatccaatgtctgttgaacagttgggatgtcctggcacttaacaacttcattgaaaatgaagtcatcaaactccaaaacaaacggaaggccttccttcgatatcttatcaatgaaattgaagactttttcatggcccaaaggttgcgacttaaagtattcaatgtacaataattgcagtgtttcaaatccttggtcaacctgaaaatataacggagaaacaacattcgaagatcgctttaacgtcaaacatacagaacctgcgtcgagtaattcgcctaaaagttcttctttgtccttgatccattctttatcactggcggcaagtgattcgcatagatcaaccagattagaaaaccgaacacatttttcctctgcagagccctcctggtgtaataacccacgcactcttggaaggctttctagtacttttgcacgtaatgaggagcaactatctaagccaacaaaataaacaaatctggtagtgatttcacgcttgctaaactcattgaaaaagtattcaaaagactcatcaggaaaacgatccagaaatttggccaaaggttctctaaacggagagtattggcatcgatgcagattgttttcgaggtacaatagagcgttcatcagatcattcataaatttgtgagcagttggtggaagaagatgaaagacatctaatatagccactatgatttggacggtggagttattctccaaatcctgacttccaagttgttgaagagtccgaggttgtgcccaagccaataaatgatccaacaatttacttccgatcccaactttgaaatatgagataaataactttagcaaacccgatagagcctcaagagatgccacagttaacttcttgtggtctgataagttcattaacattggacgaagaccattttgtagcaactcttttggaagtttcattttcaagtcaatgactgcttttaatccaccatgggctgccctaataatttcaatagatcttccgcataatgatttgaaaaacacgacaagaattttcactctaatgttagacctttgttgagcagctgcaaattcaggtttcgtaatggccagagataagagttgaatacaaaccactcttaaccggaccaactgttcagaagtcttgtgctcagatattctatgagcgctaactaatgattcatcttccgcatccaccaacgcaagagcttcctgaaccagcctattcagctcttcattgtattccaaaaaactgttttccagacccatgcaaaaggttattgcatctatgtttccaatttgcatctgaaaaggtagtgctcgcaatggcttaccaaagattggagccaataatatatgtttgcagggtgagatcatcgttgcaattggaacttgggtggtttctgacaaagttctcaaagcctcctgggctgtagctcttactatttcattagcattaggaaggtccacaatcaaagagctcactaggttttggaaaacacttgaaaatacatcatttctagtcaattctttattccactccttcaacgagttaagtatcaatctttttgctgtgttagtcacctcacatggtagttctggagccgtatctctcaaaacatagaacaaagctctaattatttccaactgacgcgcattgaagtatttcatcggaatatctaaagagttcaacatcatttctaatccaatgcaaccagctagcttcttatgatatggttcttcaaagcagcagtggataaatttggaacacataacattcaatggcgcaaacttgagagcacaatcgatatttccaaatagttcaacacacgagtcatatatcagttgaacactttccaaacccatggagcgaacagcggagttatcagaactgagcgcatagataatggcatcgaagatacagttctcgttcaaaaacaggtttccctcatggttatcaacggaaaactttctaacaaatttccttttatcgattaccatcttgttgaagtaaagtaatatgaagtgattgcaagtccctctgatcaaagctttgctttcttcgcgtacctcttgtagagaaacagcataaaaaatgctctccaatagcttcaccaaaagctccatttgactgtcatacttggctatatcttttactggaaaatgatgcagtttatttagtggttcatcaggagcaattgtgtcttccagaataatatccatggattctttcaatctgttggcataatcatctggcaattgtgtagctcccaggaatagttggaatataccactgatgtacttgaaactgtttatcctgtaatgaattctaggacgaggatcagtcaatagagaaaaagcggcagaaaggccgggagtaatcgagagtggaacctcgtttggaagaccatgtattttgaacattgcttccacgttctgaaacagttcagagtcagttttcaggttatcgacaggtttaatgaacgtacggtttctgcctcccagttttcccaatattctcaaggtagtatgtgagtgttgatggtagtagggcaatggcttcaagtgtttgctcaaagcttccatgacatcgtcaataactggttcaatgatagggtcaaagtattcggcagttaaattatcgacacatagttccaaagttcttaaaccttgactgacagattcttgagatccgttcaacgcatataccagtggcttcattaagtagctcagatgaggaaccagcacactcaatctgacaggcactgtcaagcaaagttcaacataaatgtctctttcctgtggtcttctagcttcatgaataagcttgcttaaactctccaaaagtacctgtaagagtggcataatctctttatacaagttttcaaaacggccacctcctatgcttctgaatagcgttctgatcaagtaaaagtatacaagcggctccttagccgtggtggaaagcttcagagattttaaaatcagctcatttaaatgtggtagtatgacactctcattggctgccgggaacaaacttacagacatgaagcacagcttaaacagtctgatcagaatatttgacttgataatgttaacttcacctaaatctaccagtttggattttaaaaaggtaattaaaattccagagaaacttgaagaagtaatcacactggccagaaaaaattgtgggatatggagtaaagatgcaaagtcaagcatttgtttatacataaatggtagctcttctctcacaatttcgttaaaagaggcaggatctatgtggataaacatggtagcaaatatttccattaaatctttttcttctttggtagacgttattggtaaatttggtcccgtgatatcaaatgattgtttcattgaggaggcaggaagagatgttttagatgtgctgaagaatcgaagagccaaaatacattctctgaacaagcttttcagtatgttgatgtcttcgttggaaaaccctctagccgtctcgttccaattttgtgcgttgaagtgattttgagacgaaggagggttagagtttttcagccctatcattattgtctttaagaaagtcattaatgttttgaagagataacgagagtctttcaaaagatctatctctggaggaacagaaacttgaataggtaagtattcttgaagcgacatgaaatcggctagctgctgttcagaatcctgtggttccgtggaagcatcgttatcaccttttattgtttcttggtcgcttatttcaggagtcggatcttccattttgacgtcttgatcttcatcaatcagttcaaccttcttgtcatcagaaggagatggcgttgttccatccaacttatttgtgaggagcctttcctgattctgtttttcctgtttttccttctcatatgttgcatgttgtttcatgataccgttataacgagaatttaacatcttgaagcgttttgtgtaggcatctataatcaccattaaaagctgcctactttccgttttactttctgatctcataattttctcaatcagattgaggagaagcttggcactcattatctggaccgttaatgccaaagaatcatcttgcaggttcttgcaataaattgaaaccgatttccataattgcgcaggtgtaagatggtcccgaacgttatgtataaaatcggcaactgttgagtaggccaagggtctcaaagtttcatacgcggtaaacccttcaccgatgagcactctcaagtcaaagagaagatcaattttggggatgaacattttcctgaaatcagtagataatatgtgtctcgtggcatgtaacaactcctttcttgctgcactcaattcactgggacaatcctggagtagccgtattataatgtcggggattgcctgttggtaaggttccaagaaagtctgggcctgcctcctaatgaacaagtaagccaaaaacgaggcagccttcacttggccgatgataaattctccgtagttggctctgtttgtaatttctttgcagacgttaaccaatattatacccttttcttcggcggccttccgggcttctgcctgcttggcgacttccaaagacagcactttcatgacgtgtggtatgaaattgcccagggaagaagcggctaactctttgtacgaagaataaagagacaccatagtgataggggactctgccagcgtcttgaaagaaaacatggcctgtgctagttgttttgaatcgtccgactgacttgaaaatgacggtgaattgggccttgaagtggaatctacattttccttggagtcgatctgattgccgttgaactgttcttccactacttgggggatatttgagtatatttcgatgacaatatcgataaatgggtgaaccttctcttgcagagaagccttgaaagtcttgtgtaacgtggtgatagccttcatgcagagaataccattcagctcgttctccaccttcaaaaggtccatcaacgtgtctacgatttcgttggaataagcctggagggcatcgttagcaggaatacgatgaagaatctccaaggtgatgtttctcagcttgttttcgggcgaattggccacaaagctgacaggaacctctttcagtacgtcaataaacaagggaatcaaagacttgaggaaatattcgtaatcttgggcggcattgaaggtctctagagaatcacaaatctctgaaagaactgaatgcttagactgataatcttcagccgccttcagtcgggtggcaaaatcgtccaattgcactacgtgtaacattgtggctagcagattagaggcctattacaacgtttgaagggaaggtctagtggtagatgggcctacctatcgtacccgtgttttttatgtgtgtttgactgagggtcaacagagtttttgaaaaacgagcaggtagagcgggagacgagaaaaccttggagaactgttttcacgtgaatttcacgtgatgtggttatgtaatcattattcttggattttcggtaacttgattatataagatggctggatcgttttgattccgacccatcgcattttccaggttcttacttaatctcttggtatgctgtaggggtgacatcataggaaaaattactcttagcatcacgtaagagaggtctatcgggacaacctgaaattgcttggtataggcctcaaacgtcaacactcggatgaaaagaaacggtgaaataactgcttgtcacgattaatcttttcaacaaaacttgagcggagggtttcgtaggtccggaccaactctacgtatttttccagaggcacgcttttgccctctttggtttcctctagcaatttggaaggtatcggaacggctttatccacctgttggagatcagagtcaaacatgtcttcgacttgtttccaggaaacttcagagcccgaagatggtagatagtcttgaagaatgggtaatcgaaagttgtgaggggtgatcttcccaaggtcagcattttctttgttctgtagtttctctatcgtactgtggaataaatatctagcggcatcttcaaacagatcttcttccgagcttgtagaacttggcctcttggagggtcgcagcttagcagggcctttgaaggttgtccgtggtttctttttgttcaactccgagtcttccaagggattgttgaacaaagcgtcaagattacacgatatttgccctgaaaacagggtcccttcaacagattgcggagtagcaggttgaccagatttccgcaacgaggaaagagtaggcatggcataatgaggacgagagctcctgttgggcgtgcagacctgggacgagccagtgcttttgagacgagatccagggttgacattctcaatcatgtcagtaagttcgggtatatttgtggctacagagactggtacacgaaatgctcattatattcatgtttcttacataatcatcatcaaacccttccaaacggttatagggcgcccttgtctttaatcgtgtggctgtatgcatatgctcttccgaaggtaaggttctcatagacttcatcaacgtcttccagcgacagacccttggtttcaggaacgaagaagtacacaaagaagaaggcgaacagagtacatcccataaagacgtaaccgtaggcgaaatcaatggcacctgagataaatggagtgaagaaggcaatgaggaaaccccaaagccaattggaaccttgagcgatggccatacccttggatctaattctaagtgggtaggtttcagacacaacgacgaaaacacctggagcccaggtacatgcaaagaagaaaatgaacagacaggtgaagacaatcatggcgttacctgctggtttggatggatcatccttaccgttctcataaagagacttgacaccaacggaactgaaaatgaccaaacaaacaaccatggctccagaacctcctaaaagtgttcttcttctaccaaatttatccatggtgtagatacctaggaatgtggaagcaaaattgacaacaccaagaatgatagaagtttggaaagaatcgtccaatccgacagccttgaaaatggtagttccgtagtagaagaaatagttgttaccggtcaattgttgcaaagattgcatgaaaataccaatcaatagacggtagaaaatctttggcttaccagtgaacagttcaccccaagaaacgctaccagcctccttctccttctcaataccgtcagaaataagtctcatctcattgtagacagatggatcgtcgatagagaccttgttaactctggcaatggacttcatagcctcgtcgactctgttaacctcaaccaagaaacgtggggactctggcatgaaggtcataccaacaatcatcagaatggcccaagcgaaacacaatcccaaaggaactctccattgggtggagtcggtgtaagtcttggttccgtaagtggtacagtaacccaagaaaataccggctgtaatcattaattggtagcaggagactaaggaacctctgatgtgtttaggagaagtctcactgatgaacatgggggataaaacggaaactgcaccgacggccagacctgcaataattcttccaatgaaatactggtaccatttgtcaatggaagcaatttgaatcaaaataccgaccatatagatgaccatgacgaacatcaaagccttctttctaccccaaatgtcaccaagtttacctagagtgacacctccgatagcacaaccaatgttgaaaatagaaacaattaaaccaactctcactttagaaaggtaatacgtttcaccgttaaactgtccgaaacgtctcgtaaagtcagacatgttaacgaaacctgagatggtaccggtatcccaaccgaacacgaaaccaccgaatgcgactagaagacataacacagacaccaagatataggaacccttgggtttgactgggatgtctagttcacttttgttgtcggccggagcctcatgaatatcttttatttgctcattggagggactgctctcaatggcgtatatcttttcattgtcaccttgatcaccttggatatctgttgaactcatattatattatggggaataatgaagagaaggggaaaagctggggctcattcggtccttaagtagttaattttttccggggacgctaaggtcaggagaggaatttggcagacaagaaaaaagaaaaactcggataaaagaaaggggcgaaaaacatcaccaggttttggggtaatttttccgtttttctttaggtttaaggggtgcatagtaccacttatttttccgtgaaaaataggcatgaagtgatctagcgaccagattccacttttcaaacgaagcctcaaattttggaaaaagaagcacacaatctacaagggaatatcaactcaagtaaactgtcctggcaattccaggagcgctgagtccaaagctacgtagattgagtgaaaatgtacggcttcggagatgacgtacggatcggaacatttcggaaaaactggatccaattaaaagggggttgtccttaccactttttccgcagccaatattcttcaagtaaacaggaaacgtggaggcctgagacccataaattatgcgggcaaggaaaaatacagagtttgcccaatttgagtctgctgataaatctcggtactgcgttaattgttggagaaagacggagtggggtatgagagtctacaggtagtacccaacagcacgtggacaacatattatggggctacggattagtgaaggctgtatagtttttcgtgattaaggtttcgtgtggcagcttttgtgtagccaattaacatcacgaggaaaactgtaaaaaaagtggaaaaatgggacacatggaaaaaaggaaaaattcaggggggcatgctgaggagaatactctaaagaacgaaatggaaaaataaactccgatgccgggagtcgaacccgggtctgcccggtgaaagcggaccgtgctagccgttacactacatcggatttttctaaactcaaagttgtcctgttgtgtatagcggtttgaaatttcactgaacttaatcaattagactactctcatgaacagtttcatgtcgggctcaagcgataccagcgtcatttgaagtggatcatcacttttactacttttcgtccttgattctactatttattttgagccagaaaaagagtaggcgttattacgatcagaacggctgagaagaggatgttatctgacacacaatcaagcttgtttcagcctctcccaactaggtagtagtttggactatctttttcaccgttcttctggcaacaggattctattttctattttaggcaagtctgcatgttcgaaacaggcaattcagaacaacaaatacaaaaaacccatttttgcggggaaaaataactagcataggcataaaaagcaagcttcaagcgcgccatatctcccactatcaagttgtgagttgcttttccagcatccctttccttccagcacaactccaacacttcgtttcttactctttgttaaacaacttcaaaggatgcacagaacttactcattgagaaacagcagagccccaactgcttcgcagatcaattcccctgctccaccaccttcgagcaccaagcagaaccgtttcttcggcaagggttcactaagcaacacgttgcgaagacagaccgccggttcttttggaccagagctttcaaagaagttggctcagctggtcaagatggagaagaacgtcatgcgagccatcgaatcatcctcttacgagcgtaaagccgtcgctaagcagctttccctatggggtgctgagaacgacgacgatgtcagtgacattaccgacaagttgggtgttttgatctacgaaatcggagaattggacgaccaattcatcgacagatacgatcaataccgaatcacactcaagggaatccgtgacatcgagggatccgtccagccttctagagaccgtaaactcaagatcaccgaccaaattgcctacttgaagtataaggaccctcaatccccaaagattgtcgtcttggagcaggagttggtgcgtgctgaagccgaatcgctggttgctgaggcccagttgtccaatatcaccagagagaagctgaaggctgccttcaactaccattttgactcaactagagagcattctgagaaattggccctgattgccggctacggtaaggctttgttagagcttttggatgactccccagtcactccaggtgaaactagacctgcctacgacggatacgaatcctctaagcaaatcatcattgacgctgagaacgctcttgcctcatggactttggaaggtgctgctgtcagaccaactctttccatcagacatgtcgagggagaatacgacgacgaggatgttgagggtctcaatgaggacaccgataaccttcacctcactgaggaggaatggcaaaaggagcaacaggttcagaacgcctaaggtgcttgaggagaaggaaaaaaaaagtgtaatcaagctcttagtgatgtgaaaaaaggtatttttactttttctatagtttattttaattgaaccatcttttacattttttctttgccgtgttttcctttagaaacaatgtagatgtcaacgggtgggcctatgattgtgttggggagataatgtgtgcttattgccatcttcttagtatcttgtgattcttgtggctctaagagcagtagttcagaatcctctttgggctcttccagtatttcaggagggttttgcaattcctgtgaccgcgttagcagttgagtgtattcgaaagcaccattggtgcccggatccccaccatttttcacaatatctctgacttttgccagctcttccgagtcgaaatgaacatgacatacccattcttctttttttagctctaaaagcatgtttcccttatcctggggcaagaagtactcttccagttcggagctttccaatttttcagcaaagagaagatccaacggggtatccagtatctttaccagtaaagtgtccaggaataactccagaaaacggcttaaatctctattcgacagcttcacatgaacggcgtttaccagtctcaacagagacttagtcggcctttgaggtgtgttcaagacgttctctgtagctatggcagtttcatggataacctgttggttctcatacacggagagtcggtttataaagatccggagtggaagaacttttcccggggaaatttgaatgaaagttgttctagaaggttagaggtgctctgagatcttgcaaacaccgagaacacttacgttggggccatttcacgtacttgggctggagagaatgggtccctctcacactgcgttcgataagtaaagtacacccaaaacagcaattttcaacagccccagtctcatccctcagtaacatttctcgactatctgattttgccacttctagccaccagcctaccaacaccaagttaaccatgaatcacggtccttacgattggggaagaccctccgacgacacatatggtgcttacaaccatcagatagcagcagcaaacaacagccaatttcctaaaatgaacacacaacagccaattgtaacaggaacttcagtaatcgcagtaaagtaccaggacgggattgtgcttgctgccgacaatttgggatcttatggatcattggccagattttcggatattgagcgtcttcttccagtgggtgattccactattgtgggaatcagcggagatatcagtgatttacaacagattgaaagaatactagacgatttgcaagttcaagactcctatgatatggagaagcctaacctaaaaccagaacatgtgcatgaatatctttcacgagtcttttataatagaagatctaagatggacccattgtggaattctaccattgtggcaggtttgagttccacgaacgagctggtcctcaaatacgcagatctgttaggtgtaacatattcgtctcctgcaattgccactgggtttggagcacatttagccatccccctgttgagaagaaaggttgaaaccgaggaagatgcttccaaactgacagaagaagaagccgttgaattggtgcgcaactgcatgaaggtgttgttctacagagatgcccgttcaattgacaagtactctcttgctgttatcagccagagcaggaaaaagattgatatacacaaaggacttcgttgtgaagacatgaaatgggagtttgccaaacatatccgtggatatggagcacctcaattgtgatggaacgaaactacttattatttactataatctataaaccatccagcattttaaagtcgtttgaaccttttcagtacttatcttttgcgttttttgtctcttttacaatgaatgcccttctcttccccaggctctcctggcatcgtaaaccctaaccgtcggttcgaggcatggttcgatcgcgagcattatcttatcaaattccaagaggaagcatgacagcgttctccaataccgcacctataccctcatggtataaatgaatacagagtactttgaattgaccattttgggaacaagtggaggtcctgttgagggtgcaaactgttcccttttgataggacgaatctcggaacaattagactccccaacggatcatgtctgcattgatgctggaacgggcataaagggtttaaatgatatactaaattattataaccagttcgagtctgcgaaggatgtcaagtcaaagtttttgaacacgcaaaactatttttccgggtcgttttaccccaattgtccctccgtggctgcctatcactccaacacagattctattgtcttccccaactctctacaacgataccaaaagaaatcaaagggtacgaacctgcagattgccgatgcattcatgaacttgcaaatttccacctatctaatcacccattgtcacctggaccacgttgctggtctcataattaacgcacctatgttctacagtgaggtccatccccacagattgcgtaagatatacggcggaaaattcattgtgggccaattgcattcctttatcttcaataaccatgtctggcctgacctttcagaagttgcaaaaccaatcattgagttttgcagcctggatgctgacaatcgatcgtgggtaaagctgaatgagcatatggagtttgtattgttccccgttgcgcatggaactattgaaaaccattcagcggagcctattgtctaccattcttcagcgtttttgctgaacatgagaaagtctcagaagaaactgttggtttttggtgatatggagagtgatttaacatccaacacattttatttgcaatctctttggacttttatttgtccctattttcaccaattgagtggaatagtcctggaatgctcaactaagaatatgccctcagataagccactatatggtcacctcacacctcattacgttataagcgagatgatcagattccaggaaattatccagaagtataaccctgagctgacactgaaaggcttaaacttggtgataacacatgtaaaagaaacaatgacagaagatgatcctagaataagcattctggaacaactagaactactaaatgataagcacaaattggggctggtattctccatagcacttccaggtgtatcttacaaattctaaaacatgcaattgtttattattaagaagaagagagatgatggatcttacacgaacaaaacactgtacatgaccagaaccgtggctccgactgcgctaactgaaacactttgtttattagcagcattggaatactggggactaagtttgcgaattccaaatccgttacgaatgcctcccagtctaggttttgctccattactatattgatcaaaacttgaagtttcagcactagtattcccctgatgaaggtttatcagtgcctccaattgaagtccgtcttcagctgtaagtggaattacagttccttccttgaagtggaacgcttttttagtaggggatccttcttgactaagactgctcttagcagtatgggattgaaattgctgaatacgtgcaagcgttgcgttctcatctcgcccaaacgtaacaattatgaccttattacgagaaccttcagcatcattaccactattgtcgccttcgtcaccatcatcatcatcgtcacaatcgtcatcgtctttcttttttttcttccaagggaacggtaatcccaagttatcgattgaatctgccctatcgggtgctgtttttgcgggatcaatatcaccgggcgctatagtctccgtgctgtcaacgccaatatcggaacttgaagctgatacggtgtttcccaactcctcatctgccagaccagctgtgatatcctcatccccaatatacccaaatccaggggaagacgcctgattaatggagaagtactcttccaattggtcaagttgctcatcagtcaattgttccaatctttgaagatccatctgcacttgctgaggagtgatacttttgggtagtgttggactgtctcttgaatcatcatgtgcaagtgctcccaccattcctaggcaaattaaagcaatacctacgcttctcataatctcactagcaatcgaatagggtgtcagcacaaggttgtacaaaaagagattttggtatcaatttgtgtctgatgatggattttgctctgaaaggcatcaggaaagcggatcttgaggagccgcagccttatgcaatctgacgcaactctgaccacaatagtgggtttctggtgggatggtgtaggcttctaaaatagtttggctcgaaccttctctgcaatagatgcataaaagggtgccaattgagggtctgaaatggcaacgggtttgcctatatcagattgagtgcaaatcttttcatttagggggatggaccccagtacttcaaggttgtgcttggaagcttctctcaacactccatctgttccaaaaacatgggattcatggttgcaattggggcacaaaaagaagctcatgttttgaaccagtcccagtatctatagttctaagttagtaattataaaaaaattgatcgaatgagtagtgaagtctctttacataccggtatgttgaccttgttgaacattgtaattcccttaactgcatctagaagggcaatatcttgaggggtagacactatgacagaaccatcaactttgacctgctgactaatagttaactgggtatctccagttccaggaggcatatcaatgaccaaaatgtctaaatcctcccattgtacttcaaatagaagttgctgtagagctttcataaccataagacctctccatacaacagcattttcttcactaatcaggtatcccatggacattgtttggattccataatttaccagtggaataagctttcctgtttcagtgattcttggttctccagcgaggttcattaacttggggattgaaggcccaaataaatcggcatccaacaatcctgttttcagcccaaggtttcgcaaagacagtgccaagtttgtggagacagtcgactttccaacaccaccctttcctgaggacaccaaaattactttctccacattcggtattttctgccgtataggcagacctttcgacattctgggcatttcgggggccttctttctgggtatacccttggtttgttagcacaattagcttgagcaggtttggaaaaaacataccaatgggttttcatggccatatgctctgatttgggagaacatcggccatcttcgtatcaatttactcatgttgatggggtactaaatatttcttgaacgatcttaggtaatttaatctcgaaattatttcactctctagtctctttccgaccccaatgaaacctcgttggaatccccaattgaggtgtcctagagtcctgaagcgatgggtttctgatgtacgattacccactatttacgcattatccacaaagcaggggcgatctgccattgccgtaatacgaatatccggtccgagtacattggatgtattcaagaggttatctcgtatagatgacgataagaggttacaaagacataggctagccagtgtgagaaagctttacgatccaaaatcgggggttctattggatgaagccctatcgttgttttttaagggccccaactcatataccggagaggatgttttggagctccacgtccatggaggaaatgccgtggtcaagtgtgttcttaatgccatcaaatatttgcatgaatctgctgctccaataagatatgcagacccaggagagttttctagaagggggtttcaaaatggaaagtttgacttgactgaggttgaaggtgtacgtgacatgatcgatgctgaaacagaatttcagagagtttcagcattaacttcgttgaagggggagacgagacatctatttcaccgctggagaacagaaattgtgaagaatgtagctcttttaactacggtaatcgattttggtgaagaccatgatattgaagaggtaaatgaactgtttggcagagtagcaaaaaatatcgatttactggaagcggagatcaaaaattacttggaaaaggtaaaacgatctgaaatattaatgaaggggatcaaattatcattgattggcccgccaaatgctgggaagtcgtcattgttgaatgttctttcagactcagattcagtgatcgtgagtgacataccgggaaccacccgagacagtatagatatacccttggatgttggtgggtataaagttgttattggtgatactgcaggcattagatcttttgaagatgcagatattatcgaaaaggaagggatcaaaagagcaacgaccaaatcgttaaacagcgacgttgccgttatcatcttacctgtagacttgagggagatcaatagtgatctaatcaaacacattgaaaatttgaaaagctcgacgtccagttgttcagaaaacatactagttgctttaaacaaatccgatttactagaggacccgaatcagcattcccaaatcattaaacagttttccgaggcgctgaaattacctgaatcaactttttgtttgatatcatgtgctaacagagatggaattgactcgttgatgggcacattaattgaaagattcaaaattatcacgttaacgaccaattccgatccaataagtatttcgcaaagatcacaggatatcttaagcaacgatgtattgcatggatttcaggagtttcgttcgtataatggaattgacgacgttttagccacggagagtttgcggtactcagtggaaggaattggcaaaatcacaggtgaagctgttggaattgaggagatattaggagtggttttctctagtttctgtataggtaaatagcacgtcaaaccctttcatcaactgccttctcaattgccagagaccacccattaacttcttggatcaactcctctagattcgttacgctgttctcagcagcaagcaaatttttattcaaaagctcaatttgactgtttagctctttcaggttattggcagatgattcgacatcttgcagcttctcgtaaactttgttataatctacaatcagtgagatgttagacttttccaccgttgacattttcttaatgacttcatcagagtccagctccaagactttcttcgcacattcaaaagattctcgtaccaacgcaacattgggctttttgtcaattcctgagccgttactctttcgcctcgtttttggtggacccatgggctgctccaagttcctcaagagtacggtagggatatgcgatacgttggggatgttcaagggtaaatctcgaatttatcatatttatgtgaggtctatttaagaggagccactattggtattctcttcctgaacaaaatttccctgtaagcatagttggtagaagagactgttggtatctttcaacagattagcgggtgtatcgaactcttttatctcccccttatccatgacaacaatcttatcactgtccataatggtatccagtctatgggcaatggtcaatatcgttctatccttgaactccgacctaatagtcttctgaatcaatgtgtccgtctctacatcaacagccgcagtggcctcatccaaaaccaatattttggaggagttcaataatgctcttgctaagcacatcagttgtctctgaccaaccgataaattcaatcctccttccgaaaccttagcatctagacccttgtgaacgacatcatcttcttcagtctccatttgttctatatgagctttcaaatgagacaactccaaaactttccacaactgttcatcttcataaagacctaaaggatccaagttctgcctcacggtaccttccaaagcttgcgagtcctggggaataatactcagactatgtctcaaatcatatagccccagctcagaaatgtttatcccatcaatggtaatatacccttctgaggcttccaaaattctaaaaatagccaaagatagagtactttttccagcacctgttcgtcccacaatgccaactttatcctttggttgaatgtttatattcaagttcttcaaaaccggatccaaattttcacgataacgggtgctatagtcgtgaaacgaaatggagcccttttctggccaatttgggggtggtttctgatcaggaagttcatatggtgcctcagagggtaagcgacagtattcttcaattctttcaacagaaacgatgttggtttcaacagcgacacaggctctaatcacccacgatagggagctagtaatgtccaaagcataactaatgatcaaaccaacagttccggaacttagtggattttttgtcaaagtggatagaattgccattattgcggctgctaaaaccatggtagagccgatcaattgaagcctgaatgacaaccaacggttcgtggatcgagaacaatagactgatttcaggttacgatcaatagtttctgagttcaaatacaggaatctgttttcttgtctgtaagccctgacagtgtcaacaccgttcaaagtttcctggaagtgcgcaaaaatagggcttctagtcacactcatgattctctgtaattctcttgaagccatcatataatactgttgatagtaaaaataaaacacagacagaacagcaacgacaacgatgaaaatcggaagtgtaaatgacaggatagcgacagtaaagaataccttgatcaatgtctgcaaaaacaaagaaaatgtccttggcaaggattcatctactttattcatatccgtggaaaatcgattcatgattcttccaattggcgttgtctcaaagaaagacaatggtgatctcataacgctatgggtcaatgttgagtggaaagatttcgaagctctgatagaacaaaacatccacattaccacagttttcagcgaagaaagaacagcggagcttaaaccaatagctgtataggtggctatgaatggaataatatgaaggttggcaccgttctttaaattctgctctgaccagtgtttcagccaataactactggctacagataacgctgtagatagaaagatacatccgatgaaaagagccactccggaataactgcaagatttaatgtatgctttatagactgccattttcacgtttcctttttccttagtttcttgtgattgagcagttctcttatcaggagtggatgtagtgtgaggaaactttagggttgccaaacttgctctccgtgctacttggtcactgaggacagagaatgtatctaaatcaagggtaggattttcgtctgacccttctgaaaattcttcagctttttcgtccacgttgtattccgtttcagtctcgcttgcctcgttggaagtcaatcttttaccagtttcttgtgcaaactcattcaccaacgtatatatttctccctgtttctcatcaatactacgagcgtctcctctttcaaaaattgtaccgttcttgatcatcagaatactgtcagcctgatacaaaattgggatggtgttggtagtgaggattctagtttttgttttcagtagcccattcttgctcaggactcggtccattatatgcttaccaacatgagtatcaacggcagacaaaatatcatccaggattataatgtcagctcttgagtaaacggctctggcgatggaaagtcttgccttttgtcctcctgataatgagacacctttttctcccacaagagtctcatcaccatcaggaagaacttctaaatcaggaaccaatgccgaagcttccaaggattgttggtaaaatgcttcgtcatatctatgcccaaataagatattttctttaaccgttgcattcatgatccagggaacctgcgaacaataagctacggatcccgagagagaaattttggggggattaatgcggtcggcggagacagttaacaattgtcctagtatagccttcaaaaaagttgattttccacttccgactcttccaacaacacaggttaaagtaccttttttagcgctgaaggtaatatctttcagtgctatttgagacgaatctccaatatttgactcttcgtcaatattttcacttttgggggagggagatgaccacaggaaagtagaattcttgacaactatctctccacgtaccacttctggaggatcatcatcaaaatttataaactcgttcattaattcatcactggtcaaaaacttttgtaaacgatcaagggacacagaagtttcaattaacgcagttaacagagctgggatcgaaaaaattggaactgacaggatgttgaataaggatatagctggaaaaacaatatctggagtcaacgggatagacgaagtaaatgcgaagacagcaaaacaagaacaagagacaaagaaaggaacacaggcccaagcaaaattgaccacagccgctaagcaacctgttctttctaaattctgcaactctctatcatttcgcaaatgatctatcttttctaacattggcttttcccaggcataaagtttgatacttttgatggacgacaaaacatcattgacagcacgggttctttcgtccttgaactgcatttgtcgcttatgataccctctaaggttcttgatgaggtatgtatttattgggatcactaaaaacatcaccagtaggcccgaccaagtagcattaccaacaagtttgtacaacgaaagaagacataagaccagcttcaaaggagaggaaaccatcgtttgcacatgctgagaaatatcttccactcttcctacatcgacagacattaagttgacaatctctccggtggtatgcttgctcttagctgagtttgataagactagagttttcttgtagattaaactcatcaatcctgctctgagggagattccaacctggtagatgaggatgaaaaactggttgaataaaacactttgaataatggtgataaaaaacattgcaaaagctatagcaaatccaacaactaaggggtatttctgataattatcaaagtattggattagatatctcaacagccatggttggaggaagttaagtacattttctgaaagttccacagcacaagcacccatagtaagcaggccgtacgacaccagaatggacttaagtagggatggtttgacagtttttttctgcttgttccattcttgagccaaccgcctttcagaatatcttgattgacagaattttgggactttaggcaaatcttcagtatctaaatacccttgcttgtagcctttggtgattagcgggttcatccaagtgaatgtgatacttgagagggcatttggaattgcaagatccaaaccattctccaggtagtagttgaccacctggtacgtaggtttccacaataccaactctgagaaaaatatatgtgttccgttgataagtaataagaggaacaatgcacttaccacgttggattctacacgaataacggggtattcgccatataactgctggagaaacagacaaaaatttaccggtatggaaaccagccaatagtataacaatgaacctcgggggtttatgtgaacaattggctccaacgcgtgcaacgggagtaatacaaaaaaaacggatccagcagatagcaggtatcccattgttctcacatcgctgacaatgccatataaattgtaggagacaacagccagccccagagataaagcaccttgagtgaggacagagttgattctcatccaatagtgtccattacatgatttgagagatcccggctttggggagagaaaagtctcaaccaattgcaaaccactaacaaatatgacaagtacactcagagcagatacaactaagccgatgaaacaagggttcaagctgtttgattcataatttatcaaaggagagtaggacgagcatctgcctacggtggcattcagcagggactttgacaaagtgacatcgttgtatcccagttgcagatcaaccctttgaactagctccatttctcggaggactgaagaagctgagaggcaacagagacgggatgggacgagaaggttattgcaggagaagctaagcacaccgcaatttacgtatgtcctacgattcgcgtgtagctgaagaaacggagatcaaatagataaaaatgcaagttactaagtttttgttcaatatttcatgaaagggggtaccagatctgctgaagagagggacacatgttaaaggagaaactcctgaaatccatcagtgattccctatttatttaagtggtgtaatctaatttggttcataagtatcatgtcatcacatgattagtaccactattagtggtcctcccaggagcagaccaatttgatacgaatatttgaagccacctgaactgtgttcattctcatcctcgggaagataaatgtctccttttctgggttgaaattcctgttgaacgagattttggtgtttcaatttttcatcagtcagattgcgattaagctgtttatccaaatctttaatcttcgaacttccagttgctttgggcgaagatcccgagcgatacttggtgctgatggagggaattgattgactaggcttagcggagctagtaggatgcgaggatttagcggaggaggtttttggagccaccgaagcatgagattcattggggtcgaaagtattgagcttagggttatttttcattctgataattttgggtttggaaccaggactttcaattctgattgccttatagccatcaaatgtatcgtcacaatcatcttcactgtcactgtcactgtcactgtcagaatcatcatcagtttcactggcagagtcagaatcatcacaatcgtcactatcactctcatactcatcatactcttcagcttcctcaatatcttcaatgtcatcatcacaatcatccatttcatagtccccatgataactgtcttcgtcatcctcctcctcctccgccacttcgtcatcctcttcgtcatcctcttcgttatcctcttcgttatcctcttcgtcatcctcttccacgtcatccttgtcttcatccttttctcttccctcttttttctcttttattttccgaaatatcttctttattccttttcccacctttttcatcagctcttctccgtggaaatccatattctccacttcattttcaccagttccatgttcttttgctttcactggaccgctttcatctggggaaacctctttcgggaaatcctcatccggggaaatcttagtgggggaagcgatttctgggggatatttttcatcgctccttttgactcgcccatctttaaacctattctggtattcgatcccacggctcgtatcaaatgagtctcttccgaaatccaacgtaggccttcctgattctgcatacttgggtgaattatcagcagacgactttttccttccttttttctgacgttgtgcggctggtctcttctttttcactacagatcctttcctagatacagttttggaggacggataagaattccccggattacgacgggaagcagagtagtggttagaagataccctctgtctacggtttttagacctaatctttttctctctgatcctctgggccttgaacttcctggagtcatttctcttactctgtgaccactgggaattatcctcatctaccaggttccacggaacatttaccacctgaaggaaaatttgatcagaatcgagtggctccactccagaattttccattttctccgtggggcttggcgtagaaacggacacagccacgagagagagaaatacttcagtaagaattatcaagttcatatctagcaactaatagtctctgtacttctacagtagtaactaaggaggagtcacgcgtgttgtctcctctgtgtttttaacccgaaagggcagggggggcagcaaaatgtttcacaaaagcagcgcagactcggatgcggataatactcaaatttgtcacgtcagagtttttccgaaagtgagatgcaagaagcgcgcgggggatgagagtgccttaaaccaacatgcaaaatacccccctcaaaaatctatataaagtgtgcccattttctccaaagtatttttcacacgttttttctttcactctacactagagcttctgctacttcatcacaccataatgcctattgctaaaccagctaaccaggttgcctccaccataactagccaacacctttctgatagggtgttggagattcaagatgccttcgaagtatctcccaccaaattgcagcagatcgttgctcactttgtggaagaactcaagaagggactgtctgcaaagggcggtaatattcccatgatccctgtctgggtcatggactaccccaacggaaccgaaaccggtgactatctggcaatcgacttgggtggaaccaacctgagagttgtcctcgttcacctgttgggaggccaaaagttcgaaactgaacaggagaaataccatcttcccaaaggaatgagaactacgaggaatagagacgaactgtttgagtttatagctgattgcttagagaagtttttctacaagctgcatccgaacggaatcgagaaaggtactctccttccattgggattcacattttcttaccctgcctctcaaacaagaatcgacaccggggtccttcaaagatggactaaaggttttgatatccctaacgtcgaaggtgaggacgttgtcccattattgatggacaaaattaacgaaaaaaagctgccaatcaaagtggttgccttgattaacgacaccgctggagccctagttgcttccagatacaccgaccccacaactgagatgggcctgatttttggaaccggtgtcaacggtgcttactatgatagggtcggaaacatcgaaaagttgaaaggaaagcttttaccggacattaccgatgaatctccaatgttgatcaactgcgagtacggatcctttgacaacgaacatgagtctctcccacgtacaaagtacgatattcttatcgacgaacaatccccaagaccagggcaacaagccttcgagaagatgactgctggttactatttgggtgaactcatcagactaatccttgttgaactttacgaagagaaacaggtgttccaaaaatattccaaggattctgaacagattaagttactatataccccatacctcctagacacatctttcctggccgaaattgaaggtgatcaggacttggagaatttcccagaggttgtccgtcttttccaagagttcttgaagattgagcccacattggatgaaagaaggttatccagagcactatctgagatcatcggaaacagatcagccagactttctgtctgcggaattggagctgcttgcaccaagatgaatatcaagaaatgccactgtgccgctgacggttcagtcttccacaagtatccaaagttcccagaacgtgctgcagactccttggctgatatttttggatggaaggaacagaatatccaaccaaagaactacccaattcaaattgtaccgtctcaggatggatcaggagtcggggctgccgttattgctgctcttgcccatgctagacaggcaaagggtctgtctctgggattggctgaagcttacaaaaaagcctagatgttaaatgttttactctacttcctttctatgtataaagcggaaatgacaacgctttaggaacttccttagattccttcatgagtttgatttatatcttcgatgaacataattattttatcatttggatcggggatttgaacaccacgtgaagctagaccgtgcatccaattcaacccctgcagctctttaactgtgcgtaaaaatgggattttgtctctctgtgctaattgtactattattttactatctcctctcaaatcatcttttaaatcgacttgttgctgggccagtttcaattgtggaactgccgccgagtgagtcaagtcaattaggaacccaaatagaaggatatgcacaatcttgtaacgtaggaacattcttgatactgtccaagggagagtttacgcccttgcgatgcttagccttttgcacgatgcactgacttgcggctttagcagcggtgagatcctgaaattctcggaaaaaacctagttcccttcggaaaaactttgaataaaaatccacttaccacgtctcctggatgtatctccccttattctctagctctaaacataaactcttcgactcttcgttcgaaattcccaaatgatcttctaatatggtttctatggtgattctaacctgaatgggcatttttccggatgatccacataggtagaaagtggcatttttattataaataaggtcaaagatcaggttactctgtgcatacaatgtgtcttgaacatatgattttttctcatctctggaaaatgagggaaagagttggagttggctctttgatgcgagagattcccataaatcaccgtaaagaaaatccttatcatgaaatctgtttccagtaaagagatacatgtcttgcagtcctagttctagtctttgctcaatgattgatttgactggtgctattccagttcctggggcaaccattatcaaaggtccagaggaaaacttgacattgttcgggtgaattgaaaacttgattctatcattttcttccaactcttttacccatctcgtgcacacaccttttctgagtcgtttaataattgtacgatactccacgatagcgacagtgagctcaacagtagaagggcttggattcgatgaaatggaaaataatcttggcttgatggttggaatgagatcaaatacatattgaaccggaatgtgtaatgaatgaaactccagtatggtctccaaaattgatcgtcttggtcgattggcgtaatcgtacagagcatcaatgttctcaatgagagaaaactcatatagcttttctctctcacgctcatcggtggagaaatgatgggcaatcatgaagaatgaacgccggggtatagacatgatatccaaatgatgagttaataacgatcttagggtcaacttcttgaccaaaccaccttcgatagtcggcgtgggaccatcgataattaaagggaaatcggcaatattctgccaatcttgatcttcgatcagtgattccacatctttgggatcattgctaggatataaagcgactgtgtcacctggtttatattccaacgagttgctagggtccttgatcactagtcttctaacatcctgaaaatgatctggggacgtgattcgttcattggccccaattattccagttataagatcagaccttgtcaaggccacttctttaacattgtcagtaatctttttgaacttgcttgtctgcggaacaatcccattcatcggtggcaatagtgtattaggatcgatctcatggtgactgagctttttgatcttttctagcagacgcctttcccactccgcataataaccttcgtttccctctggtgattgctcatcactctctgccctatcactgaactcgtgcgctccaagttgaatcaacctcttatggatttttctgattgcatagttgaacttggcataggatgagtcacctagaccaaaagttgtgaaacttagatgagataacagatcactaggaagacccttttttaacatgaacttccaaaacttcttcccgtttctagggatgtccccttgccccgtagtggaacagataaccaccaacagcttgacatccaacaacctcttcaaatcaaagttatccaatgacgagacaactgtgttcaaagataaatataggcattttctaccaaggacctgtgcaaactcctgagaatttccggtctcggagccatacaagatggtgatagaaggatgtcccatttggtatactgaaagaaaatttcgaatggaccccaccgtaagaaaagatccctgagactaaatcaatgcgattacataatcaactctagtgtacgtttgaaaaataagcttatctaagcattaatatatacaggctaacggagttctatttcgtaggtagaactcaaaatatctcttaccctctcttggtaaacgttaatttcatcgtttgttagtgagcggtccatagattggtagtttattctgtagcattggctcttacgaccagttttggggtgcacgaactgatccaccaatttgacgctttctaccaaatcaccagctgtgtctctgacaatctccatcaagtcgttctcgtgcagaggtagtttgtcggtatccggaagccaaaaagaaacgtcacgagtagttcctgggtatttggaatacggtttgaaagtagtgatcgagcctttagtaaattgcgagctaaatctctcatcaagagtccagaacaatctaatatcgggaataccaaacaagagcatagcaattcgatctagaccaacaccaaaagcccaaccaatggtgtcttcaataccagaattcgtcagaacttgttctctcacgactccacagccgcagacctctaaccattctcccttccaccagacctcaatctcgtaactaggagctgtccaagggaaataagcttctatccatctgacacgtaatggttcgttcaagtatggttcttcggatcctgccaacttcgcagattttttggcctcgttgaagacctggttgaccagaagttcaagggttcttttcagatgttgagataccagatccgtctcaacatcagtcatgtaagactgttttggatttgttgcatcactgaaagcagggtttggatcttccactattatgtcaacttttggaatggaagctatgtcctggcgtaatttttcatgcaatgaatccccgagctctgaacgactccagatacgagcaccttccatttggtggaaagccggataatgcgttctgtcaatctcatctcgtctataaacatcagcagagatgaaataaccgggagttgagcatttctggaagcattcgtgctcgtgggcggaggtatgcgttctcaacagtgttttttcattgatgtagtaggtgtctgactttgaccttcctgggtgattttctgggaatcccaaaacgtcaaaattttcaaacgttgtaaccactggtttgaagttattatagaaagtgtatcccatacctttgaacgaattttctattagacttcgtagtattccaattggatgattttggtccagatgaagttgacgatccgtcaaggccacgatacttgcgggcacattggtccagctgtcggtggcataagtttggccattaacagtgacacttgttggcaccttcttagtcgaaaagtacctcgcaaacctgaacaccgacctgttcatttagtggttggggtaactagagttgacgaatcacgagcagatccttggaggagcattcgaggtgctcccaggagcctcttcccttacaagggtcaaggacaaacgaactttggaatagttcgcgcccaacctgaaaagtccactcaatcactgatcaaaaagctttcaaccaacacaccttgagcatgttcggactcataaaccaactggtcaagccaaattttgctcagttctctgtgggtctccctaccagattggggaaacgtttttctcacgagctggctccaagattcaagcatgttggaaagaaacacaagggtagaattactgttagaactggtggatcgatcaagggatccactgtgaaatttggagactacggattgagactaaaatcagttggtgtgaggatggatgccaaccaactaaaagaggccgacaatgtgatcatgagaatgatgagaccggtaggcggaaaactttggagaagactttgcacgaacattgccgtgtgcaccaagggtaatgagactcgtatgggtaaaggtaaagggccctttgattactgggctgttcgagttcctacaggtaaaatagtgtttgaggttggaggtgaaaacttgcacgaacaaactgccaaagatgcttttagaaaggctgctgccaaactgcctggagtcttcgagttcgttaagaaatctgatactccaagagttggactgcacgatgtccagaagccaaaatctccagtcaatgagctagaaaagttgaagcaaaaccccaccaaggagtttctcaatgtgttaaagtccaaacagagggaatacgtcttgtataatggaaggaagaggtaaacccccctaaatcactgtatatatatttatgtttcctatgagacgttcttttcaagtaccaccatgactttagtaatgaaaccctctagatggaagatatcttttgatccaagactcaacctctcatcgaagatggaagcctgttggactatatccatcttaactgtgtccttatcttttatcttggagtcttcgtcaaccaaacgccagaattctatggtcaacttcttgaggataagtttggctggaatagaatgggagattaactcgtaaaggtcagttctactctgctgtagcttggaaactgtcctctcagtgacgataccaattgctaatttcttgatgacattttcccagtctggcattatcattggggttttggtggttatggagggattgtaagagtataaggcttccagaagcaataatccagtccttaaattgtgatctgtaactttggcaatcttggagtaaatctgttgtctctcggtctcatcagcaggaaaagacttggccacttctggttgatctctcagaactttctcaaaaaccgatcccatttcttcatccgtaggagcagccactctaattagtaacgttcttgacttgataggctcaatgatgctggatatagaattacacaccaacaccaacctgatatttgcggagtacttctccatagtccttctcagagctgcttgagcgtcacgggttaacagttccgcctcgttaatgatgacaactttgaatctgttcttgtggtcagcaacgtgtgtaaaatcgatggtttcagtttgggcgacttctttcaagaggtcttggattacaaccctatcgttgttgttcatgtcactaggtgtgatttccagatggttaggagacgacaccacattgaactctaattttctcttagttgctgtgacaaacacctttggatcaactttcaacttctctatgttgggaccatagatttgtcttagcgtggccaatattctagtttttttccccgctccacttgggccatggaacaataaatgaggaaaatcacccgacgtggccaatgaactcagcatattcgaaatcttgccatgatagtctagatcgtctagcgtttttggcctgtatttgtctgcccacaatgacatattgacgtgtattattggggaaagatatttttcagtacatattaaatacgcgattacgggatactggagagatcgctaggggctcatcccactgtctcctcctttgctctaactccataccatactgcatcaggattcagattgtaagggttcccaacgttccttctatgaccctctctagtcaccttatgctcctccatgctttcaatccgtgcaagaacccagtcacgtccattgagatcaatcttagagacatcgttgattaaaaaatagtgcggtgcaccgacattgaaagccgcccaaggttgataggtttcaaacgaggcaactgtagatgctctacgattgactgcttcaacagtatttgccatgttcatattgatagtgtcatctctggttggtaagaacaagaccaagtctccaaccttgaaatctttgatagaaatcctggtgtttacttcttttatcagtccatcgatctccgttttcgaatagttggactctttctgtaattttcttgccaattgctccacatctttgaatcttttggtgacgctttcgactagtaacttttgatccatataggttaagcgagtaaacttatcgaaatcctgattgaacttgaaatcaagtactgtctccaaagattctaactctttgactggctcttggtggaaataaacgagctgtttgtctgcctcagcaacgatctgtgaagagagctctagaatttcgtcgttgccaaggggggaggctgctttagacgttgttgatcgccttctacttctcagtcccttgacacgatgtatcctgataccattagatgggtcattctcctcatattgttcgtctcttttcattaaaagaccaattgcttccaacatcagacatacagtgacgacattctggaatgtccgctcaatgacaagtcttaactttccatagagagacttgataattgattcaagctcctcaaaatgagactcattttgggcaagtttagattcataattctctttgatttcaatcaaattggcctcttcatcttcgagattctcaaccttcaccttcaagtcttcgacctccttaatatgtgtgtttaattcgtttttgtattcttgttcctgtgctgtcatgttatctagcagatctttcttcatcattgcagcttcctcatactgtgtcttccaatgttcattggagagatctaatctgtccttttcatcagacatttgtgtcttctcttcagtcagttggactacttgcttcttgagagcttcaatctcccgttcttgagaagcgtgtatctcattattatttctttcttgaagtgactgcagttcttgattctgtttctgtagagcttccaaccgtatctgcagttggtggttagccgcaaccaagccattaattttctcatcttcgtcaccttcttcatccctcttcatgagctttaaatgcaaaatttccttctgctctctttcatcatctctttctttagaagtctgctctaggttcgcttgcagctgttcgattcgagtttgcaggacttgaatttcgtcaacattctctcgcttctgtttcatgtcagtatcatgaattctggcatgcgtatccataagcatttcagttgccgttgcactggtcatcagatttgcactggaccgctgctgataatcccttatcggaggataagccatattgataggaggaggtccactttggtgcaaactctgttgatagagaagactttcaagtttcttcacgcgtctttggtaaccttgtagtaactcatgatttgaaaaagatggctctttctctttttcgttattatttccgttttctgtttccaaggtactaatgtttatttggatagtaacatcattaatttcaaagtttttcaaaaactttttcaataaattcatgtagctagtatcttgactgtttaaaggccctatagtgccgcctccagcactgattaccttatcattggaagtttcatatatccttcccaaaccaaggtcagtgagatttttctctagctgtttgataaccttgatattcactttgttttccttcaaggaatctatgtagtgataaaagtcttctgttgttatgttgtcaataagagtcaaccaaaattggttaccaaatctatcatccctcttcgttgcaggtgaatgtgttctgacaacctcctcacttgcttgtctcaaattaccaaaattgtaatccttgttgaaattgtgcaatagcttgttgatagcattcaaatgtggtggatgaggatcatgctctggagttggagctctactgtttccctttgagccgcctggagttggtacattggagccagtttttagtacaatgcgggaggaagctagatggtcacgaacgaattgttgcttcaaatcttcatttatctgtaatgctaatatgcgctgtccttgatttgaattaacacatggattagtcttgctgaacccgtcaatccatttggaacgataatttgactcaataaatttgagcatttccaagatttcattagccttgaatgctactttgttaaagttctccagccattttaatttctttagattaccagcgagccacagaccaaatacaagtggtagatctttgacaatagacattttcaactcgttgaaatcaagattgctgatgttcttagagaggtcattatttataaggttggtagccttcaaaatgctcaattgcactccaacaatcttatgtattgtgtcacttagtagggttctctgtaagtcttgcttcaaattcagcgcttcaactttttcatcatagagtttgttggataattccgttatttgaggaataatcgtggaagagtgagtttcaaagacagagactaggacgtttattttctttactgattctgctgacaaagttgtcgaatttccgccagatgtggtcaacaattcgtccagtatgggaagttctttcgagtctttgacaacctggtttaccaactccgttagacggttgagagtgtcactatcattctccgttcgtgagtttgagtttaagttaggaacatccagatattttttcttcaacgattcgtacaagtcattgatcattactcgcttggaaattatctcggaatcaatcctcgatctcaatcttgtcagtttatcgttgacgttgcccatgagtgctttactatctgcagccacattttcaagcattttctcatcaagcaggtcacttagaacataattgcctttaaaacgaacaccttttaaaatctgatagtagctcttccaattttcaagtaaagattgctcttgcagcattatcagagagtctacactttcgttgaaacttttttctagggtcttgaacatgagattggtatattgtatgagtgcattgtgtgagatcagtattatttcaatttcctttttattgtcgcacaatacttcttcattgactttcttgtaataattagttttcttgaggtcactcaacagagctgcggcccagcctgaactcctttttagggaattcagaaccaaccgcagtttgttgagatccaagtcctcagtacttagattaggtctattggtgatatctttcaagtaactcacaaaccgtaggatatctgcgttttccagaggacttctcattggcttgatcatatttagcatttcacactgattcagagactccaaggccgtgtccagcttatcgtctaccatttgctgaccatcgtaaaacctcctgtcaaacacgtacacctctcttacatcgccattcatgatcatggagaatttgagcttgattccgaatgctgtgagtagaaacaagtctgccggggcgataccaaaagaggcagatatgtactgtttgaactggtcatagctattaaagttgtaggggatggctgagatcctgatacccgttattgagttgtagatgtccatctgtgattggtggaggaggctattttgcagcggatgcaaaccatgcctgcttgagtccattctaggagggaaatgaaactaaagagatagatgagctggtttgccgccttgtgttaagattattatctgatcagcaactgaacttgcggggaggggggcaattagaaaggaactctaggaggaaaggtggggcgcaactagaaacgcgaaggggaacatagccaggggagggataaaccttcctcagcgcgacggggtaagtcaaactgctacagcgagacatcacacttcagaaggagtgcgagtgtcttaccggaaggacttgtgttgcgttccgatcaataggcggctcgatggtactcagaagggggtcagcgggatcggatctcttagacgacctgattggagatcaaccaacttttttgagatcttggcaagtttttcaaaggaagtcgtttgatatacaacaggaaccatgttgcaattgagaaatttgacatcgctcgtatggaaccttaggaaacttgtggatgtcttgaactgaaagaaatgtctaagcttttcaattattgctccaactattgctgcctgagctctctcccccagccacagtccttggtctagacatgcaaccgtaagagttaattcacaattattcatttctgattacctcgaaatgttaactaccgagagccgaagagcttacatcataaatacatcagtgaagcacataatttttctttgcagcccaattctacttgaaatgtcaggattatcgattctgctcaaggtcctcaaatggtctgttgctgtagtagctttgctctcttacaaaaccgtcccgtttgcctattatttcaggttctacagtatcgttatcaagaatttgatcttcccctatagacgatggatcaaagaagggaacagaaagcctcacagtgaactagatgtgttccataccactaaaatttcaacgttcgtgtccatttttgagtgtgatttctacctacacaagtccaattcaacctacttcgaagaactcgatatttcaagaactaatttgatgaccaccgtcttcagagaccttttcttcaagtaccaaagagatgcccttggaggatccaaaaaggactctattttcaactggccttacatccctgttgccactgtgtcagcaagtttccacagacaactctccccctttgaaaagtacacaattgaagatggaattttgtgctgggataacaagtggatcttcatcctttccaggttcatgaataaatcgaacaaagtatgcacgacctgtgtgaccaaatacgtgctaaagaacggaaagaggaccattcgtcccaaggatgcgttgactgatattggactttggaatgaaaaagttcaacaaatatcccaatcccgtctacatttgatagaaagttacgtggatcaatcggaattagaaacattagatttgtctcactgaattaataatatatatatcggtcactgttattttctcaaaggtctctcatctggaaatcttcttgttgatagctttcaccagctgggctttccagctggggttcgacttcgttccgcaagtagtctgtaggatccaaaatccgcaaaaattcaacgaagtcttgtataaactctccaccaaactcccattcatctgctcctccatgcaatgtttgctcatcatcaactttcaatcgcagtccaggtatccaattgattatcaacaataccacaaacgatatagtgaatgcatagagggaaaccacaatggtaccaaccacttcccatccaagttgaacataattctggtttacccaaccgccggcaatgtcgttgaatcctaaaatggcaatattcttatcagcaaataatcccgtcaagagaatgcctatcattcctccaatgccatgtatggcaaatatgtccaaacagtcgtcaacatggatcaggtactttaagcctgtggcaaaatttaccaagaaacctcccacaaacccgaatatgaaactcgaccataggttaacatagcctgcagcgggcgtaatcactaccaacccagttatgcatccagaacaaacgcccataatagagagcttcctattccaatagtaatccacacacatccatgttaacgatgccattgccgatgaaattagggtattcacaacagagataaaagaggccaatcctaaagttaacgagcaaccggcattgaacccgagccatcctgtaactaaaaacattgtccctatgacaatcattccggtgttggagtttctgtacctatttttgttcataatcaatatttggtctctctgacctagcaatatcgaataggccaaagtagtgaacccagaaaccaaatgaacgggtgagccaccaccatagtccaaaatatcgatcttgtcaaccatccagccgttagagttccactcccaataagcgacgggacaatagactagtatcacccataccacacaaaacaccagcatcggtagtatcctccctctctcagcgatacatggcatggtaagagcagcagctacacaggccaacagaccttcaaatacagcatgtggcaaagcagggatcaaattatctggtgctgactcgttttccagcaaggacctctctaaatttctcagacccgcaaactgaaaatttccaatgtacctggttgaggcattattactgaacgttaacgaatagccaagaacacaccacacgatgaaagtgaccattgtgacaatcaaaggaatgcccaacatggacaaactcgaccgcctctgcgtcatccctgaatagaacatggctattcctagcacaacgaatatcaggagacttgagcatgtaaatagaaacaagccgttcgccattatcttgggattcgacccgtcgactgccgggtcaaattctcggaaaacttcaaacactagcatcctattgggggtatcatacagagtctctggaaggttagaagaaaaaaaaccaccttcgacaaacgaaccctttgggaggggaggggcagatggatatgatttttttttttgggaccctactgcagttcacataagtactgtcacgtgaaagattttagatgctcctagatagactacacatcccatctgtcgtcctggaacaggcttctaacggccgcctttccaagtttcaatcacgtgacctctaagagtcaacaagacaatttttttttgcactcatcccaggcactctctctgtcccgtttttgtttgaacaacccgccctactagtctctaaccgccctccacaagcagtccgacttcatcatgtctatggtaactttggccggtcctcaggctttgtcgagtttcaggatcagtaatttgactagagacatcaacaacactgttaactccaacgtggtagcttcgatccgttcttgttacgttcattatcttcacgtcgacggagaaaactcagacctgtccgagtccaccagaaagaagctcgctgaattgctggattacgaccataaattggatctttctgtggaagaaaatgtgaggttggaaagcctggttcaattgtctggcgatcaggaaagatcagcttcaatcatctctcaacaattgaacgatgatattctgataagagtgttacccaggtcgggaacgatctctccctggtcttcaaaggctaccaacatagtagaagtcactgaaattgatagcaacataaaacgtttggagagagggttggcaattcttatcaagacccgtccagatttcccgctgttgcaatatcttcaggacgacaagtttgcctgtcttggctccgtttttgacagaatgactcaaagcctgtatatcaatgaggcctctcccaaatataccgacttgttcgaagagctcccccctaaaccactggtttctattgacttgttatcctccaaacaaaacttgatcaaggccaacaaggagatggggctggctcttgaccaaggcgagattgactatttgattgatgcctttgtcaaccaacttggaagaaacccaactgatgttgaattattcatgtttgcccaagtcaattcagaacattgtcgtcacaagattttcaatgccgagtggaccattgacagtgctaaacaagattattcgctgttccaaatgattagaaacaccgagaaatgtaacccacagtttaccatttctgcttactcggacaatgctgccatttaccaaggttctgaagcctatttgtacactccagacatcaagactaaaaaatggacttccaccaaggaattggttcagaccctaatcaaagtggaaactcataatcatccgacagctgtttccccatttccaggtgctgctactgggtctggtggtgagatcagagatgaaggtgccgtaggtagaggttccaaatccagatgtggtttatctggttatactgtatcggacttgaatattccaggtaatagcaaaccctgggagcttgacattggcaagccaggtcatatatcttctccgttagacattatggttgaagctccgttaggggctgccgccttcaataacgagttcggaagaccaaatatcaacggctattttaggactctgaccacaactgtaaagaactacaatggtaaggaggaagtcaggggttaccacaaacctatcatgattgccggtggccttggttctataagaccccagttggctttaaaatctgacttcagaattactccaggctcagctattattgttctgggtgggcagtctatgttaattggtcttggtggaggagctgcttcttccgtcaattcaggagagggatctgcggatttggattttgcatctgttcaaagaggtaaccccgaaatgcaaagaagggcgcaacaagtaattgatgcttgtgtttctatgggcataaaaagtcccattcaatgcattcacgatgttggtgctgggggtctatctaatgctctccctgaactagttcacgataacgggttaggagcagagtttgagttaagaaaagttctttccttggaacctcatatgtctcccatggaaatctggtgtaacgagtcccaggaacgatatgttttaggtgtttctcaaaatgacttacctctctttgaaagcatctgtcaacgtgagagagctccttttgccgtcgttggtattgctacagaggagcaaaggcttattctgaaagactctttgttgggtatgactcctattgatttggacatgagtattctgtttggtaagcctccaaagatgtcaagatcagatagtactcagccattgcaattgagcccattccttacatccgaactggatctgtccgagtcagtttcacgagtgctaaaccttccatccgttggttccaaacaattcctaattaccattggtgacagaacagtcactggtttagttgaccgagaccaaatggtaggtccatggcaagttcctgttgccgatgttggtgtggttggaacatctctcggtgataccgttgtcaaatctggtgatgctttggcgatgggagaaaaaccaaccttagctttgatctccgcttctgcctccgcaaagatgtctgttgctgagtccttactgaatttatttgccgctgacatcaggagtttggaaggcgtcaaactttctgctaactggatgtctcccgcttcccatcctggggaaggagctaagctttatgaagctgttcaagctatcagtctagatttgtgcccacagcttggagtctctatcccagttggaaaagattctatgtcaatgaaaatgaagtgggatgacaaagaagttactgctcctttgtctttggtgattactgcttttggaagtgttggtgacacctccaagacttggactcctgcattggccaaagaagatgatactttgctagtgttagttgaccttgcgggtatcaaaggtccacatgtcctgggtggttctgcgctcgctcaagtatataatgaagttggtgatgaagcaccaacggtcagagatgcagctatactcaagggattcttggaagccgtcactgtcttgcatgctgatttagatgtcctggcatatcacgatagatctgacggaggtctctttgtcacgttggttgagatggcctttgctgccagatctgggttgaatattgacctgggaggatcttctgatattattagcgatttgttcaacgaagaattaggagctgtgttccaaataagaaaggaagattacgacaattttgttgctgtcttcaatgacaacggtgttttcgaagacgagtatatacgtattgtcggcgaaccagtatttgatagcaaacaaatcgtcagcatttctgccaatggtggcttaatctactctagctcaagaggagaattacaacaaaaatgggccgagacttcttacaagattcaacaattaagagacaacccccaatctgctgagcaggagtactctaatattttggataacaatgaccctggtttgagctataaactaaccttcgatttgaattccagagattcgttttctacgagaccaaagattgccattttgagagaacaaggtgttaacagtcaacaagaaatggcatggggctttgagcaggccggatttgaatccatcgatgttcatatgtccgatataataagtggtaccgtttctttggataactttgttggtatcgctgcatgtggtggattctcttacggtgacgtccttggtgccggtaacggttgggccaaatctgttttattccacagcaaagttagggctgaattccacaagttcttcaatgaaaggcaagacaccttcgcctttggtgcttgtaatggttgtcaattcttgtctcaaatcaaggagctcatcccaggtacagagaactggccctcattcgaaaggaacctaagtgagcagtatgaagctcgtgtgtgtaccctggagattgtgagcggagatgaagattgtatattcttcaaaggtatgagaggttctcgtttaccaattgctgttgctcatggagaaggtcgggcagagtttgaatcccaagctacgctaaagaagtttgttgatgaggggctcactgctgcaagatacgttgacaactacggtaataccaccgagaaataccccttcaatcctaacggttcccctctaggtattaatggtatcactacgccaaacggaagagtgttagctttgatgcctcatccggagagagttacgagaaagacagccaactcgtattatcctagagacaataaatggggagactttggtccttggattgagctgttccgcaatgctagaagatgggttgaatcagttaattagatgtgtagtgaaaaaaagaccgtattaattagaaactgttttgatcaagttgagcccttatttccttccaaagtcttttcttattttgtgtttcgacatgaatccctttagcacgttgctcaatatgttcaacatcatcctggacggtagacaattccatgctgaaaaatgataataaaggattgatgaactgacattgtttgatagatttttgtatcaattcattcacaagcgtcatatccccagtgttatcaatgagaaactgtgttttggataattcaattgtatggattttcttcagaagtttctgttcaagagacttggcattatcattttctgtccattcgatatctgtgatggaattgtgattctcatctggtaatgcttctttatcataagtgtctgggaagtatttgtcgttctcctcatcgaattctagttctttaaaactgttggctaaatccggaactgttcttgacaagtgattttcatctgtgttcgaatttttccttgctggctcatcaccataatcattgtacaaatcattaaaatcgtcatcgttctctacggtgttatccatctcatcagctacagctgaactgcgtcttgagtgtggcttaaactctattttattcaaagcatctttagtatcttttgaatcgggaggtggaggcgttatgctaatatggggaacgataggttctctacgggaggcgtcttgaggggtgattaagggcgcagtagcagtctttgtgggactactattgttgatgaatggatctctagtagaaggaaccgaatctttcctcttttctggagaggaatgggagcttacttcattcggcactaagggtaaaacttgttgatgattggacccgcggtctttgagaggcgaggagcctttatgaacgttcgaagttggtagactttgttttcgttgaggtaagttagtttgttctccgtttgtagtattggcagcaccagttagacctcgcaatgactgtttacggataggtattccaatcttttccaatggaacattcaccacatccggcaacttgccacccgtgtatttgagataagtttgtaagagtgtcaaggtaaacatttccgtctcttgataattagtgccgagccaaaaataaggcttccccatagtaagtatgaaccctccatccatcaaagggtcaatttcaattttcttaacttcgtccagatcccaagttcgtccaatttgaatggaccgatctttattctgtctacctttgtgtagtcgaaccctaccagaccgtttcactcccaacatgagtattcttgcctttttatggtcggtgttcccgttgtgtggtggtcttttgttttgatggtgagagtcctctataactcggagatgatgtatgtaagtctcgtggacaacacggtcgttgtccaaccgactgaagcagtactttatgacatctttcttatcagtttggaattgcctagccagagcattgatgtttttggaatcagcagccatcgttggtggactgttagtgctgagtactgtggaaagcagagagggataagaaagggtggaatccctttcgcgagagtcttttagagggagagctgataaagctcatacatctccccgtctggaatctgcatttgcgcggtatcacttgtgagggaagagacgtgattagaataacgcgcctggcagatctaacctttactctacacacaactctctctgctcaaagttctccctttggaaacccgttaaacccttagaatgcccaatggggtagacttagactcttttttagatgatttaagtgatggagaatttgaaaaattgctggagcccgaagtgaacaggcaacagatcacacatgtcgatgtaagacgagagccagcccaaaagactttggatggcgcaattgccgtcggtcagaacggtaccacatacaaagaaatcagacacaaggtcacatttaaaaagacacaccacaaactgtgcactcccaatctggaaacctatatctatcccaccaatttggaagttcgtgagtatcagttcagcattgtcaagactgctctttttaaaaacacattagtatctcttcccactggtttgggtaagactttgattgcaagcactgtgatgctaaatttttatcgttggtctgaaactgcaaaaattatattcatggcgccaaccagacccttggtagcccaacagatcagagcctgttacaccatcactggtattccaccccaggatactgctattttgctggataaaacaagacgtagcagagaggaaatctgggactcgaaaagagtgtttttcactacacctcaggtggttgagaatgatttgacaaatggtctgttgaaccccaaagatattatctgtttggtcatagatgaagctcatagagccaagaagcgatatgcttacaacaatgtagcacaatatatcaaaagatttaacacatcctttaggttgttggcgttgaccgcaactccatctgcggatgtcgaaggagttcaagagattgtggataatctgatgatctcctccatcgaaattagaacagatgaaagtctggacattaagaaatacataaaaaacagaacactggaaaaagtccaatgtgaccccaatgagcgcatgacagcatacactgaattaatatgtgaagcaatagcgcccatctatgaacaatgcgtcaaataccagatctttgaaccaatgggtgttgccaaaatcaatgcatttcaagccagggaagcatcacagaaagttcaagggaatccgaggctaccagagggaaccaaatggatgtacttctttctcttacagctactgattacagctggcgaatcttttcgaagattaagtgtatatggtgttgtggcattctattcatatttcaaagaaaagtacgacgagtttacgacaaagtgggaagcgaagaaatcaaaaaacaagcatgcacatagcttctattatcatcctgctatcaagcagcttttaagagaagtcgaaacccagataaggcaggataaaattgcctctactcacaacccggatattactgagggggcgtttagtcaccctaaacttccagttatgctggaacaattgagagattttttcagtgtaaaagagaatcttctgaattctaaagttattatctttacagagtttagagagtcggcattagaaattgtgaaagtgattgagagtgataacaaaaggtatccacagccactttttaagcctcatattttcattggacaggcaaaagagcgcaataaatttgatgagcaggagtataaggccaagcattcccgacggaaggtcaagaaaaagactgctgaagaaaaagactccaacatggaggaagtgacaggacaaaaaggctcagagacagtcaagatagatacaaggaatcgaatagaaagttccaaactagcccacctgaaaggaatgaaccagaaagctcagaaggatttaatcgataagtttcgtggtgatgaactgaacatacttgttgccacttctattggcgaggaaggtttagatattggagaagtcgactttatcatttgttttgatacaaccaacagtccaatcaaaaatatccagagaatgggtagaactggcagaaagcggacaggaaaggttcttatcctgtgctctaataatgaagaggctaagtttaacaaggcaatggataattacgcttggattcagaaacaaatcagtgacggcgatgtcattaattaccacaaatctgaccgaatacttccaccggatttagaaccaagggtgaggaaaacactcattgaaattcctgaagataccatcgagcttcgtgacattgaggacaatgagaaattgttgaaagttgcaacagaattgtccaagagtaaaaagaaagcttcatccagagcaaacagtaaacgacaagctactatcatggagcttcaactaaatcccaaaaagaaatcaaagacgttcttactacccgatggagtcaacactgggtttcagaaagctacggatctagtagagaaagtgaatagcaatggtgagaaagagaaaaactttttggattatagtgatgaagatgatattgatatcttgggtatgctggccagttccaatagtaaaaaagataagatgtctttcgctattgatctgagtgaagagaacgaaaatactgtacttgccagcagcactcaaaagagtttggtatcaggtcgcccaaggcccagaagtccgatattgatatccgaagatgatgaaatttttgaagagagaccatccaaacctggtaaggagagcacaggtacagtgtcgggatcaattcccaaagagttttctcctcaaagctcttctaattctaattttgttgggatagaagatcaactgcggaactggccaagagttgacccaatatttaaaaataaatttgattcccaggaaggatttttaaccgaaaaggagaccaaagacctattcgaaaaatactacactaatgagcaattgccagcaatagcagatgatcccaggctagatgctcttacaggagggcatactggtcgtatatgccacagtaacaaaatgcatcgatacattgagttagttcaaataatgaaagataagcaaaagagtgatatgctagtggaacattatagagtttgcctcacaaaagaagaacagtcaaaactgaatgacaattacttatttacagataaagtcatttttgatgatcaaaaatagtggaacaaagtaacttactatcccttaataatcccaaaattcagtaatgttgtctcttgagttgtagattagcaagttaggagtgccatagtttagatccgagtcatcaagtacatccttggtactgaaactcaaaatcctagcttttagttgagctggggtcaatgagtcaccggagttatattgcgattcatgcccgggttgtagagagaggtagtaactcaaaagaccggcaacgtgtggagaggccatcgaagtacccgaaagaactcttgtggaggttggaaggccaatgtaggtggactcaataagataccctggggcaaagacgtccacacaggtaccccagttactgaagaacgcacgttcgtcctcgacagtagaggcagctgcagtgattgccttagctgaatttgctggagagtaactgcaagcgttagcattgtcatttccagcggctacggcaaagtggatgccattatcaacagcagcatttacagcgtatgtgagagcaactgacagaccaccacctaaggacatgttagcaacagagcccttagacttgccccttgagctcttgtggtctttgaccacaaactcaatgcctttaatgacatctgaaagggtgccagtcccatcagagttgagcacctttactgccaccagtgaagtctgtttagccacaccatattttgcggaaccgattgtaccagccacatgagttccgtgtccattggcatccttgtcaacgtccccaaatgggatagttgcaccccaacgagcccgcttttcaaactgttcatggtcaacaaaaataccagtgtcgatgacataggcggtaacatttttgccaccatcgacatggtatatataatttctattggtatctagtgtttgcctctgggaaattctagccaaaccccaggttacatgttcgtcaactgcgtactcttttgtcgaatggactactgaatctgcctcgatagccactataggaaggtccatagaggccagtttttcaactagtcttggtggaaagaaaccgacaaagcctttcatggagtcaccgatactgaaaggttcaaacaaagaatgcttgggtagtctcttaatacccatggcaacgaaaaaggggtcttcattgttcaacatgaattcgtatccacctttaatgtagtcataaagctgctgaagttccgaatcagtgatggaactgtctacagtgacaatataggagttctcaatcaccttatatccagtcgaatatatctggatagggtcgggtctcactgtggaagattcaaatgggttagatccctgtaatttcagcgatggagactcagtatgatggggcaaggaaaacggcaattggatattcaattggtcaagagatggtatcaaaagcgagtgtgccagggtagccacggtagccactgatgctaatctgataattttcatttctggagtgtcaaaacagtagtgataaaaggctatgaaggaggttgtctaggggctcgcggaggaaagtgattcaaacagacctgccaaaaagagaaaaaagagggaatccctgttctttccaatggaaatgacgtaactttaacttgaaaaataccccaaccagaagggttcaaactcaacaaggattgcgtaattcctacaagtagcttagagctgggggagagacaactgaaggcagcttaacgataacgcggggggattggtgcacgactcgaaaggaggtatcttagtcttgtaacctcttttttccagaggctattcaagattcataggcgatatcgatgtggagaagggtgaacaatataaaaggctggagagatgtcaatgaagcagctggatagatttcaaattttctagatttcagagtaatcgcacaaaacgaaggaatcccaccaagcaaaaaaaaaaatctaagatgtcaagaaattttcaaactgttaagagaggagatagattcccaaccgatgctacaatgttccacattccatcatctgggggtgggccagctcctttcaatttgagagagaccgtgcaaggcaagagatttattgtcgttgccgctccaggtgctttcacgagtacctgtcacgaggaacatctcccaccatacatcaagaacttgccaactttcttgaagaagggaattgacttcatcctggtgatcactgccaacgatgcattcgtattgaactcatggaagaaggctctgggagccgattccgacaagatcatcttcgcttctgacaccaacttggagctggccaacaagttgggactgaccctcgatctgtcagttgctggactgggtcaaagaaccggaagatttgccttaatcgttggaaaagacggtgtggtgcaaaacgtgtttgcagagaagggccctgaggtcaagcattcctccgccgacagggttctagcaaagttgtaagtacgtagtttcgcttagtttaagactaaactaatgttgttgtaatgccaaatatagcactgcctgtgtcttgcgcactttccgccttggactctcgatttgtccggtattgccgtgtcacccggcctggcttcgccgtagcccttacatcacagattcgcgaccgccatttcagattcagctctggacaaatcactcttcccttccttggaaaacaatccagacaccaggtcattgaactaacgacaagatgtccagcgatattccaatcgagttcacagaaccccttcagttgaccgatatcggcatccagccccaattcctggattttcgatccacgacgttggaatctgatcgtttcgtgtgtgtcagggaacaaggtgccaatggcaacactgtcagcatcattgacttgcacaacaacaacaatgtgaccaaaaagaacatgacagcggataatgccatcatgcatccatctcagaacgttatttctctgcgtgctaacggaacaaccctacagatcttcaacctggataccaaacagagactaaagtcgttcacgatgtcagaacccgttatattctggaaatggctcaatgagcagactcttggtttggtaactcagaacgcaatttttgagtggaatgtatttgatggcactggggatggtccagttagattggccgataaacatgtctctttaaccaacaaccagatcatcaactatgtatcgaacaaggacaacacttggattgcagtcactggtatcgctcaagaagagggacgcattgtaggccacatccaattgtactcaaaggcaagaaatatctcccaggcaatcgacggtcacgtctgtaatttcgccacattgaaattgagcggtgcctccgtcgacacacaggtatttgtatgtggtaacagaacggccaccggtggtcaattacacgtaattgaaattgaccatcaagagggagctcctgttttccagaagaagaatgtggacattttctttcctgcagatgcagccaatgatttcccagtatccgtccatgtttctcaaaaatacggtatcatctatctgcttacaaagtacggtttcattcacttgtacgatgttgagtcaagcaccagtttgtttgtaaacagaatatcggcagagcctgtatttactgccgcttcatacaacaatggtaccggtatcatcgccatcaacagaagcggccaggtgctaactgttgacctctccagagaatcgttcattccttatattttgaacaagctctctaacattcctttggctctatctcttgcttcaagaagtggacttccaggagctgagaatctttttactcaacaatttaatcagtgcttagcctcaggagactacgacaatgctgccaagattgctgcctcttctgaacaactgagaacttctgagacgatcaaccgtctgaagaacttgcagccagccccaggtcagatctcccctatcttgagttacttttccatcctattggacaagggaaccttaaacaagttcgagtccatcgaattggctaagcccgttctacaacaggataagaagcctctattcgagaaatggttaaaggaagacaagctgcaatcatccgaggagcttggtgacatcgtcaagccttttgataccacacttgccttggctgtctacatgcgtgcacaagttccagttaaggtagtgtcatgccttgctgaaattggccaatttgacaagatcttgccttactgtgaaaaggtcaactatcacccagaatacactatcttgattcaaaatattgttagagtgaatccagacaaagcggctgagtttgccacatccttattgcgacaaactccaggtttagacattgagaaaattgctgatattttcttgtctcaaaactacattcagcaaggtaccgctttccttttggacgcattaaaagatgataaaccagcagagggccatttgcaaacgcggttattggagattaatcttttgcatgctcctcaagtggctgatgctattctggggaacaacatgttttcgcaatatgaccgaccaactattgccgcattggcagaaaaggctggtttgtttcaaagagcattggagcactttgacgatatcaaggacattaagcgagtgattgtgaacactcaagcttttccaaccgactggttagtcaactactttggcaaactcaacgttgaacaatctgtagcatgtttaagagaaatgctctccaagaatattgcacagaacttgcaggttgtgattcaagtggccaccaaatattcagacttgataggaccagtaactttgatcaaggtgtttgaggaatttaagtgcacagaaggtgaatactattatttggcctctattgttaacgtaacgcaagaaccagaagttgtcttcaagtacattgaagccgctgctaagttgggacaagttaaagaaatcgagagagtcaccagagagaataacgtctacaatggtgaaaaagttaagaacttcttgaaagaagctaagttggatgaccagttacctttgatcattgtttgtgatcgttatgactttgttcatgatttggtattgtacctgtacaagaataaatttttcaagtttatcgaagtttatgttcagcaagtcaatccttccaaaacaccacaagtcattgcaggtcttttggatgttgattgtgatgaggccattatacaatccctactacaaacagtaattggccaagttccaattgccccattggtagaggaagtcgaaaagcgaaacagattgaagctgttgcttcctttcttagaacaaactcttcaaggagggtctgctgacaaaaccgtgtacgacactttggccaaaatttacattgactctaacaacaatcctgaaaaattcttgcaggataacgataactacgatacacttgttgttggtaaatattgtgaaaagagagatccataccttgcttacattgcttattctaagggtcaaaatgatgaagaactcatcaaaataacaaatgaaaatgcaatgttcaaataccaagcaagatacttattaagtagatctgaccgtcaattgtggtcagttgttctttctgaagacaacatgtacaggagacaacttatcgaccaagttgttggtactgccattccagaacttgaagatcctgagccagtatcattggctgtcgaggcttttatggacgccgacttgccatctgaactgattgagctgttagaaaagattatcttggagccttcccctttcaacgataacccttccttacaggaactattgattttgaccgccatcaaggctgatcaaacaagagttgattcatacattgaaaagcttgatgactttgatccggaggagattggctctttggccacagaagctggattgtatgaagaggcattcaaggtgtacaacaaatttgaactgtacggtaaggctttgaaggtgctagtggaagatgtcatgtctcttgatagaggtgaagaatatgctgaaaagcttgacaaacctgaactgtggtcgcaattgggtgctgcccagctaaatggtttacgaattccagaggctatcgaatcttatatcaaggctggcgatccttccaactttgagcaagtcattgacattgcggagcatgcaggaaaagaggaggaacttattccattcctaaagatggctagagaaaccttaagagaaccaaaggttgacggcgctatcatcaatgcctatgctaacacagatagattgaacgatattgaacactttttgcaattgtcaaatgctgctgatcttgaatctattggtgacaagttgtacgaaaagcacaactatgaagctgcgaagctgctttattccagtatttctaactacagcaagctggcatctaccttagtttacctgggagattaccaagctgctgtcgattgtgctagaaaggcatccaatgtgaaggtatggaagcaagtcaacgaagcttgtatcgataacaaagaattccgtttggcccagatctgtggtttgaatttgatcattcatgccgaggaacttgacgagcttgttaacaaatacgaatactttggatactttgaccaacttctttcattgtttgaaaacggtctagggttggaacgtgctcatatgggtatgtttactgagcttgctgttttgtacacgaagtattctccagataaaaccatggagcatttgaaattgttttggtctcgtatcaacattccaaaagttttgagagcttgtgaggctgctcatctatggcctgaactgattttcttatactgtcactacgatgagtgggacaacgctgctttgactatcattgaaagatcaagtagtgcatttgaacacagctcattcaaggaggttattgtcaaggtgtcgaacttagaaatctactacaaggctatcaacttttacctgaacgagcatccatcgttgttgacggacttgctatctgttatgattccaagaatcgacttaccaagagtagtaaagttgttccaaaaatcggacaacctcccattagtgaagccgttcttaatctccgtcttggacaaaaataactctattgtgaatcaagcataccacgatttgcttattgaagaagaggattacaagtctttgagatcagtaattgaatccaacgataagtttgatgctctaggactggcagaaagattggagaaacatgaggtaatctttttcagacaaattgcagcagtcctttaccgtaagaacaagaagtggaacaaagctatttccattttgaaaacagataggttgtggagcgacgtcattgaaactgcagccatttctggtagtgagaaggttgcatctgaaacattgcagtacttcgttgagactggtaataaggagtgctttgtagccactttgtatgcctgttatcatctagtcaaccccgactcaattttagaattgagctggcttcatggtttgggtgattacactaagccttatgaaatctccattgccaaaaataatcaggacagaatcaacgagttgtacaaggatctgaagaagaggcagagccaagaaacaaatgctgatgatgaacaggcagggtctcaaagattgttgttaaccaatggtactggcattggtctgcaaccaaccggtactggatttgggggattttagtaaaaatcaacaactttacagtagataaaatcaattgtttttctttataggtttattaaagttattatactaagtgagcaagcacagtgccggtagaaaactgaagatggcacagattatctttgggaataagcaggatgaatagttgactaacctgatgcttccacggattgaattaaaggaactatcattaagtgctttaaaagcaatatgcggtacttgaatattaggattccatggtggtttagtgttcagggaacggcatatcaagccagaatatgattaatctaagtttatggaactctgctcggagtctgattcggtttaagcctgtttggcctcttctaacttttttgagttctcaaggtttatagtaatgttgtaaaacacttcggcccaggagttcaaattctcctccctggcttctatcatacggttctcacaatattcaacgtctgccaaataatctctattcttcaagatgtcactcaactggctccaggatccgaactgtataaaacatctttcccattcaggtaagaagaagtcaacatacttgtaccagtcctccgggggatcaataacccttttagtctcaaagacatcattggattgtgcacaatggtgttcttcacaaagctgtgtcatgaactcagggctaggaattgccatcaaggttccataggcaatattctcccacattttcatggtagcaacctgatacggtagatgtaccacaatagacttgtattttgccaaagttttcggaccaccatatttggtgcctagaaccttacattccacgcctgatttttccttgacaagctttgacatcaggtcaccgtcttgggaaacacggttaattataagacatggacgattgatgtcatccattggaatcttttgatcttcgatatctgaaaatccgaacggtctgatgagctgcgggggatcttcggggaacacgtttctgctaagaaggtagttgtattcaaaaggattgtttatgatgaacttggcaggatcggttctcctattaactgctcgttccatatcctgatggtaaatatccttttcgtctccacttgccatgtaatcaaatctattagtgatgatgaagaacaaatttttgcaaatcttttgaggcataaccaacggccatcccaccaatagatcatcagacacaaagacagcgtcgttgtcttcacaaacagtatcatacggtggttcaagtgctttgttcttgtactcttcccttctaattcccaacttgggaagatctttctggtggtacgtcacattggtcaagccgagatggtcggccatatacttaaagtcttcagtggttccgatgtgccttgataagtaagccacacgcatatctttcttgatcagtattttcttggacgtcaagtccaatggaatactgcttgacttgggcgtgtatgccatgttgaccgtcgcaattaccactccgaagagggccatgcagacaatggacttcttataggcagctagccacttcagcctccgcaaccttctgagcaacgcatgctgaatgccaggtttattatcctccgtctcgatgttcagagcgtgaatcattgtcacttggaaccagaatcgacggttgtaaacacgagttgcgtaggtattttcctgtggtgtcaagttaacgagtaaaatagattggataattcccgaaaaacaccctccatgtcaggaaaccctgtctgtattgcacaacaaaggcacataaaattcatgtgttaccatgcatccttttgtaaggtgcttacaaaaggaaacaaaaatttttcagttgctatgcaacaaggcaataaaatatgtaaggatgttatctatgcagaattgctacagttaccacatttcgccgatagcaagaacaacgtgcggataagaaaggtatgtcaaagtgaggctcaatccaaatttagacgggaacgtggtacaaccggtgtgaaatttttgtaaaattttctaggtggaattattaccgcagttagtccaccttaaactgtgaaaggtcaatgatgacagaaaccaccttcatggtttttggttaagtgtattcccgttattgtgtgtaatacgtaggaattgaaaaaaagtgcggatgccatgaattcgcacgattggctccctggatatttccgcctgactttcggtaaataccctttcggtcaatacccacaaaaagccaacctacaggttgaacttaccgtgtgaatctttgaccagatagtcctgttcggtgacaattgaatcgatcaatcggtttggcgtgacgtcaaatgcaggattccacacgtcgatgtttggcgtggcagtcttaatgcgcaaaaggttaactttcccctcagagtccgtaacaaactgatcagagctatcaacctgtccccctagaattgatgtaagctcattggcaggacgctgttcaataacaatgtcatcgccagagtctcgtgtgtaatcaatggtagtggtaggagcagctccgatgaacttcacaccatcatattgagatgcaataagggcaagttggaaggtaccaatcttgttggctagatcaccattggtaacaattctatcagctcccacgatgatgaatttgacaggcgccctcgatggtaatggacagttcaccctctggctgaagagagaatcaattaagtaagctggcatattatcggtgatcagggagaacggtattttctcaaaatttagttcgtatgatgtcagtcgggaaccttggttatacggtctggtttcacaggcatagacgtgggataaccacgatttctgaccctgaatcgttttgtcatcggcatttcttgggttcgctttagacttagcccacaacgagcggattattcccagagctgttccatgtcctgacgtcgcaagagagccagtgttacagatagtcatgaccgcaaacggtccttcaaaatttgatagctcattatcgatgtatctgacgccgttggcaccaattctatagttattcttgaggtcatcctcaaacaatacaacgctgtaccttaacacctctgcgtatagatcgtcaatagtacaggcggtttcaacaatcgctttaatggcagtacaggcattgacgaggttaactgctgtcggtcttgattttatcagataatcaattctcttctctagggctgctttgaaaaccgataagtctgacacatcgtagccgtggttattcttttggccgtctttgaccgagttcaactcacaagtgatggaaaatgacccaacaatagctatggcaggggcgcctcgcacttgcatcttctgaatcaccgagtacccatcatcaatgttcgacacttggatgtatttcgtctgataagggatcagcaattgatcaagaatgtcaagtctggtcttttgtctgtcgaactttatagcttgcaaagacatttttttcccccaaatcttcggtcttagtgaaactggcttggactttggcgatatttcggatggtgcataacttcacgtaatttaccagcgcactaccattctattattatgctaatgaaaactctagctcgaagcttaaagttcccattcattcccctacatcaaatgggttgttaacaatgcctccatcccaaccgaaacccatagtaaaaccaaagtctcaagagatcttcaaagagcactcttttctggatacgtttgcgctgaccgtgatcttcatcaccctgccgtcgtggctgggattgttgattttgagcgctttcggcatattcagctactccaagaacctaatgggcaagatcgtgtttttttggtcatgccataacacacaggtcacggttcaagagatttactcaatgtttatgttttttgtggttgacgtctgtttgtacttccttttattgcaccgaagcccgaaatcattgaagtacgtttatcttttagctaaggcctttgttgcctccaccataacttctccgaaacacaagttttaccgcaatgcattcctgacgttatttatcatatttaatatccagtttttagaccattggttgaaggacttcctgaaactgccctccagggtcaacttgagcacagagtttctttactaccgactgaacgatttactcttgcatcaacaatacctcaagagattgaacaatccaaggttcagcgacctgttagatttctttgtccaattcagttcatctattttttctatgcatatcgtgttaatcaacctgactaaaaaagtgcccctcaagctgaaagctccttttgctccatccactgaaaaggattctaatgaccatgacgacataggactgaaatctatagggaactccatactagaagttgaaatacctgaagacattgaacccctaccatttactaataaactctcatccgcaatgtctgctccggcttcttatcctaccgaagttgtttctgaaactatcagtgtttcctctccattggcagtggttgctagaaatttcgaaaattttgctattttttcatttgtgccatctatccacttttccattgtgagttctaatcgtgccattcttgacaagaagctgagatcgatttctctaagcaaaatacaacaaccaatatgggcatttttgtctgctgcaaagaccatgttcaacaaacaagatctttatagtggtgaaatggacacagaaacgtatcaaaatagaactgccttaattcagcacaatgattcaacatccttaacatctattgtgcaatgtttcacatcttatgtgggagaaaccgctatcgcgtttgaactctatagggttcaaattaatgaagttaaaatccgtgtgaatggtattgtttggtaccaagtttgttcagcttctatcgatgacagggaaataatagttgtcaatgggctttcacctttgtctcagtatgacattgaattgtacaacatctctgagtcaaacaaacaatttctgcttgctaacgttactgttagcacaatatctcccaattgcaaagtttcccaggcgaaaaagaatactcctttgctcacacttcaagaatctctagccaccactaatgagcatgtgaatagagagaaactcaaattaaaaaagacgcgcaaagattacagccagagaactcaggcaatcaagaatgagattgagattttaaagaagaagctttatgctaacgataaaacggacgagaggaattaccggagaaagattgacttaaaacaagaattgagcaaactggatcaagagaactccgagctagaatctcaacacatggatctgtttaccaaagaaactgaactgaacgaagtatatttggaggaacgaaggacgtacgaggcaaaccttcgaagcgttcaaaccacagaaaacgcatactccgagaccattaattccaggaaggagatcttggaaaaattaaaaaacgacgaagcattgataattaaaagaaaggacaagttgcaagcaaaacagcaaaagctccttgaaagcatagataaaattgaaattgaactacaacagtgcatagaagaagaagtagaaagacgtatatcctccagaaaagaaagaatgaaacaaaagcaagaggctttacaaggatacagatctgaaatatccaaatacgaggatgatgtcaatagtctagcacttgaaaataactctcttagggcggcagggggtgtaaccgagagcacttattccttagccagtcggccaacatcgccaattggacacaattcggttcagggtttgtataattctcttagttccatgaataatcagacatggagctataaatgattctattactatgctaattctctaacttggttccaatattatgaaaatgtctgtcaaaatagagcaaacctccggattttttgggctcgtttatcagtatatcatttacttgggctacccaaagttcatggttatttacttgaaaaagatctttcttttcgcagaggaaaactctttcagcatgactgatgatggggatctgaaccttatcgtttatatcttgcagtttccaatcgtctttggcaagactcatgaaaggttttgtgtggactaaatttccctgactgtccctgtgtattctggtaccttgagcaaaagctcttgcgatcctaatagagtctatagtaggaggcattatatgtatggcaaacgaattgaattgatgtaataggtctgaagtagcacttggaacttgcaggttgaattggagcaacggttccggctccacacataatgaggaaactgatgaaatagtcattccatgaaatttgcttacaatcggatcaccgtgaaaacctgctgtcaaaatcattgctgggatgttagttggccataatgggtagaatattcagagctaacttaccttgacttcctatggacgacatcgactctttgtagagtccgatagacggctgtgttgacagcctcctcgcaaagagttttatgggctgtgtctggtagttggccatccgcatttgcagctcacgaaggttatgaatggcacagtggtctatcctcccagatgtgtcaagtaaaggaaaatgattctcgcgccaggaaatgagtggagttggacgggaggggttccaaggttgaagggcctaaattgctgctcagatcaggactacctaatgagaatatggtggactggaggctgttttgaagaacgacaggggaaagagtttcctttggcgatggaattaccactttacacaatcggtttccttgatggttcccatcgacatatcaacttgcttagcgaataatgtctacccagctcatcactgaatggtctgttctaggaacaccatgaaaggacaaggaccaaacatcaggtctaggatcatccagtcatgtcaaacttccccatcaagaataaaatctcccctattaacatccttccataagtgggacggcaaatctaaggcgttggctagtaaatatcagaccaaagaagtcaccgaaagtcttttgttgaatccatttctcaacatactaatctctcccacaagaaatgtatcactggccaagctggtcgttccaagagctcatcttttgaaatttgttgtcaagaaatcgcagacagatctcacaatagcaccctccttggacggcaagtctgtaggcacttcttcgtacgtgccaaacagcagaacagtgcttcaatcaatcgtatcgtcccgcaaagatcgaattagatcccaactgatacccatggatatacggaactctgaaaatagtcaggtatctatcaaaagtgttcaaattccagaccaactcgttgagcaggttgacgaggcatattttgacaaattgagaaaagaactatcgtactttcacaccttggagtatcaaatacctcagaaaggtcctgctgttaaagttaccagctcagactcgaacgaacagactttagccatcgaggaagaatttgtaactattaatctacatcctctcattaaggacacagacataattctgaagaaggatatgtatttggatatgtctaaaaagtctcatcgaatgctatttaccttcctcttcaaactccaagagtactttaatgactgatcagtgcgtcagatataatggaagcccataaactactggtgcacttccgtttaagaatcttaatgtacacagatcccgagaacgtgcaactgcttcacagatattcatttccttcggataaggctcaaaaagcccccagaaatcacatacccctacagtgaacttgtcaatatctttatctgtcacatcccacatattgaccagtaccatgggagcccctgcaattaggtaatcaaagactggaccgtacggttccaataaactattatttccctttagagccccagacgaacagcctatcaacaaagaactgctgcagttattctgtttctttatcgtcttggatttgatgtactgttgaccgcttccatgacccaagtagatcaacagatcgtttcgtaagccttccttgaactgagattctgttggtctttcgtctgtaatccctttccatttggtttttgactctagcttctctttaaaagtagttttcgttctagttagatctcctgaagggttgagaaggtagaaaaccttgtcagttttgagagagtatcgtgttttgcttgatcttgccagcaattcatttaacatttccaaagaaggcattcttgaaactgatctaatttgaagaattggaagtgattcccaaggaaactctaaacaatctttggaaggtaccaatatgatatgttgatcttgcggctgctggtcactgtcgtaatatttttcaagcagatttctgattagaagactttcaccttcaacgtccagtaatttgtttgctgtaacgtatttgataagtttatttaactcatcggatgagctccactcctttgggtttcctaaggccaaaaacaaacgagaattaaacagttcagtttctttattaaagttacagttcaaaacttctttaagatccaaagagaacttttctagcacattcggctcaaaattttttggactaaatattccctttaaagcacccagatgatcattttcaaacgattctaacattttctgcaaccttaagtctaattctctcctctctttccaccaatcctgtcgatccgcctttgttcttacatttgtggtacgttcttgattggttgtttgtgcgcttgcctctatgatatcattaaacctgtctttaaatactttccatgatgtattcggctggaaaggtattcttataataaccgaatcctcagcagaactgaagtaagaaagaagcatatcacctgttaccgagcaaatgtcaacttcaatcactgtaatttcagggaaaagatttgatcgtacttttgcaacaatattaaagtcaagcgcataagccctactttgagaagctaggatgcgtatatcatcaggatcgggtaaaatctggtttggcccctccttgagctgagccacatccttgtcaagtttgaatgccttactaagggcgcattcattcattcctagtaaacgcttacaagtgtcccccctttcatcaagttgatgcttgaataacatacagatatcaaacaatttcttccagtgatacatgtaaaacagtgagtcggtatgacagctttcgatcaagtcctcgtaatcgctgtcatcacggaacgatgatctgggctgctgtataatggcatcatttgaaaggtatggatgagagtaatactcttttgcgagttttactaacggatgagctgatctaaaagagttgatggcttccaatttcaaggatgatgcatataagattaagttcacttcaaatccagtacacagttgtttgatcaaaatctgatccccctcagagtatctgaattgtcttagcatcccattactcaacatgtccttaatttccatagtagtatggtctatctggtttgcacacatcatagtgtcatacatttgacaaaactttctatagcattctgtggcgctatccatctcgtcgattgccatgaaataggatccatgtgctgcaagatgtgagagatccagtaaataatcggttacttgtaattcttcatgtatggtatcagcttgcactagaaactcactagctctagatgtattccctaccagtagtgatgcttcggccataaaatatgatgcgtaacagaagacaacaggaaagttgtgtgattctaagaatttattgaattcgttcaaataaaattcgacttgttttgtcaaactccagcatgcaaaaagattgatcagctgctctagaactttcatcgttaagcgagatacttgccatttgaaattgttaaattcatgcaccgtaaagttagatagattcggaagaaactttttaactaaactttgaagtatcttcaacgacattcgtccaagcttgtagctttggtgaggtatgctgtgagtaaatagaactgaagataaccacaataattctgattgaagaatcaatatttgaactagtttcactctcgtcattgatttactggaaagttgcaagtgctcattatgagaaaaaagttcaattaagtaaaaaaaccttgtctctgcttcttgggtttggccagcattaattaaatagcgatactccttaagtttccactctagtgactctagaaaatcgactcccgtaagattggatgtcaaactttctgcttgtttcttgtttgaaatcaacaaggcattagctttctctaaagactttaattccaatgccaggtcaaacaattttccatcaaggaaacttttttggtagcttgacaataaaaagattctctcagatttatatgtattgatcaaagttgaggaatatgcaaaaagaccatgataagaagcgtaactgacataacaggaaagaatctcaaactccaaacttaataatgattcgtcgtcttcgtaattctcaattacaaacaagctcttcttttgaaaccagtataacagagaatcaaaagatttggttattagtgattgattaacttgacgattttgcaagcaaacaatgagaagaccgaaggagatgaaaagatgactgtagtccgctaaacagctttttttgtcgactgtaacattaggcttcagtttgaaaagctgtatgtctataccggcgatcttgaagtactgaaaagcaacatatatggctaaacccgtatctgtattcgataaaagataggtctcaactaaataaccaattatttcattctttctgaccaatgaggtagaagctaaaatattgaacagattacccactatgagagtcattaactgagagcttcctccagaaagaagaacaaggtctagctttgaagatttgattatcagtttcgccagcagttttaatgaaatgtctaatgttttggcaaacatcttttctttctggaaaaatgataacttgggggatgatttcaaaatgttatcattgtaaattttgaagctgttggacaaaaactcctgtgcttcaagaaaagaaaggttgtttatcaatttatgaacaattctgtcatttttcaatttgagagactcaaatcttgacagcggattttgctgagcagtttcatgttgaactagaataacatattccagttcaatagatgacatccagtgttttaagctagctttgaaacttagttcgaatacatttatcccggtttgaaaaaaaatatttgagatatcctggatgcggttgagaaacttctcatttagattatctggaagcttcttgtaaaaaagtttgaaaacatctgttaaaagagtgtacagtaattcatgatgcattttggaatccaaactctttgtaaatcgcactatcaaatctagaatctctacaaccacggttgtcagtgaaagagaatcattagctttgaattgcttcagtatgacgggcaggtattcgtaatatttagcattatcagaatagataataaatgaaaccagtttgtaaatatgtttgatgaacgaatcgttctgaatgcttgtgctagagaagagatttgagtttctcaagatggattccaattgtgaaaaatctcgtgttgcatcgtcctctttgcttgataatatcaaattattaattaaagtgttaaaatgctgaatagaatcttgactcgtaagctgatcaagatcaagtctagccggcctcccaaagactgatagtactgactgaaacttggggtgatccaatagaagttcttgtggcgtttccagaaatggtagacattgtttctttattggctccaatcgatttccagagatcaatcggtctatggttgaatgtagattatctaggatgagttccaatgggacactattcgtgaacttgctaaacatgagcgtaattagtaaacagcaaatttgtgagcctacaggaacggaaacattagttgggtattgggtgtaagaaagaaataacttgatcaaagtgggggatctcttggtttggctgtcactatctaaggaatgaaaccattgccagaagttggagtttggacgcatggattcaaccagttggtcaggggttgtaagcactttcgtctctttgaaaaggtactgtagaaggacggtatggaaggatgcaatgataccattgaacgctgctggttctttggtgtatggaattgactggatcatttgatgtatacttggagtttcactatcgttcaacgtcacgtttagcattctattcatttcaacgaaagtttttgtcagctgaaggtagcacgtttcaaactgatcattatccatcagtttgaccgcaaacatcaatcttgtcttgaaaacctgttgaacttcgcaccgtttcaagcggccaatttcattatgcaaaacttcaaaagccagttcatacatttgaacttctgagggactcctagaaatgtctaagggcattttcagaaccagcattgacgccaggccaaagggagtgaccgtgtgagatttgagattcaaggagggatacaacggtccagcggtgttcgttctgtcagccaaaatcgttggctcatttcttttatatgattcaagcagttttatatgatcattgactcggttcattgttcagctgtgttagagacttcgtagagcaaatgtcatttacagatatgggtgcataggaggttgattgtttgtttgtttacattaggtacaaatctttgaacggtggggacacgaccatacaataagccagtggggaaagacaatgaaacacattgacggtggctaggccaagggggggggggtataaaatgctgttaggagtccatgagtagttattgaagcgtgatactgatgcatttatcttccggttatctggtgtttagttggccaggatgaagatgaaattttcagatgcataaatgcgacaataacagtgtaacaatctatgtgcttaggaccgccatcgaacatcacaatgattatgtaattacataatctccgcgcatccaacatctatcaactgaaaaaaacaaaatggtcagttttacttttctcattgaaagtaccagagaaagccatcaatgtcagcatgatctacttaattgaaaggatacccaccttacgatgtggccgatctcgattgtcaagactgaaccatgtatatatacctccaaacaccaatcacaggcctctgaagttctacagtggatccactaatgaaccatcagagataaaatggtttcagcaggatctaccgtctttgctggtgcatgagatccaagttccaaaagagttgcttaaattgaaacccaacgctgtaaataaatcactcaagtcgaaaaacaccgctagatccattgccacaccagattacacctacagtcgagagctcttgagaagactttatcgagatgtggaagaaaattacggatattacgccgaaatgctactggagaaattcaagaagaacaaaatgataataccaactgaagaggtaatcccgttaatcaagtatctctacgaccttggactgttgaagcctgcctataacgtcttcaggtggcattatagattattcccattggacgcattttccatcaagaacaaagatctcattgtcatcttgtatttatgctacagggtgaacaaatttagcatgttcgatgaagtcgcttcaaaatatttgaaacgcattaatgatttgaaccccatacttaatatgcttgtacatgtctatctgtcattggataattatcccctagttaaacagattttttatcaatttgtccaaaacaatttaactaccaattctaacaaaggtattgcgcaatcgctagaatactacatatcacagttgatccattataaaactcccattcattccatcctttttgcatttggcctatggaacacccataacttgccaataactatcaaaacgtattccatgatatattctgccctttgcagagaaggaaatcaagctgaaattctcaactattctcgactcttaaaggagagacaaatttttgaccatgttcagttcagatccaacatatttatcagagagacacggaaatctaacgctacatactttgaaatcaagtccaaattccagaataaagttgcggcatatcttgcagagtttcaaaacttaccccagactgaggacaaagactctctgataatcagttttcagaaaagagtcataaaaaccatggtcgaactgaagtgcaagaaaagagacataattcacatcaataatgagctcttcaaagattatcaagacaaagtgaaatattcaaatgaaatgtacattactaaattatacagtgatcaaggttctacatcgagtatcatgtctcaaatcaagtatcttaagagcaacaacataccctttgacaactattatatctttctgttttggcgggcattcttgcacaagtatccttatcgatacaagagtacgtcatacagagtttctgctttattgaaaagtttgagagaccattacccaacaggtacatcgcaccagcaaatgctccaccttattcgttccaagtgcattgacctcgacgacaaggagtggtttaaagatacagaacaacagctcttcaaagagcttgctaccatcattcgttcaacatttttcacacatcaatctttcatggaaacttacacattggaagacataaagagactagaacaatctggcaacattcagctgctcttatcacatgtcaataaaaactcgattgatctttcaagttcaatgctcatcaagctgctaaattatcagttagaaagactattaaaggcaacaccgaatagcagaatatttgaatccagagccgccaccaaagtagatgaatttgttgacgtatatcgttccaagttaaaagggcaagactacgcctatcttgcatttctgtctgtcaagttccggttattctccatgactgaaccatttgtcaatgaatgcctctcgctagaagaggaatccggcaactcgtttgtgaaattgtacaactacatctccctaatggattgctattttttccaaaatgacctggtcaaaattaatcaaatcatagatacgttacaaaccgaccccattctcttacgtccagtcttcatcaatagacttcattactggacaaagtttctgccatttctaagattcccagacgaggattccaaggccaagttcaaggctaaatgggatcagttcaactcccattgcaaaaaaagactcaacaaagacaaaaagaaatattttatatcgctggatagaggattgcaaatgcttcacgactggtgtttgcaggtctatccatcacaaaaacccaaaactgactctactcaagacaaagacgtaacgaccctgaaagataaacagtagagttcttgtaatatagtatgatagaataaatgcattaatattttctggtttgcacgagctagaacactttggacaaaacaccctccaatttttcacttttcttttgctttctgatttcagccggcgcatctgctcttctggaagcaacgtctctttgatggaagcttcttcgtagctcttcatctttcttgcttggcccgtatttctcccttttcctttctatatttctagatttttccacattgctaataaacactttactaagtttgttctcctgcgttaactcttgtctcaatttagcttctcttctctcgttctccttagcgatctgttccgtgaggtcgtgccatttgaatccactcaaatattttatgtttatgatatcgtcgtaataaaaagtacctttcttcccacctagactatttgcattcagcgtctcggcggccaattttgcatcctttttgttcaaatactctgcccatccctctgtgtacattctcttcttatttcctccgaatctgactcttttattctgggtcagtatgtcttctggcttcaggtacaatctgtcaacttcaccaaatctggacaatatctgtctcatctttgtaggtttcatataaggcggaagtgaagacagataaacgacacctgttttcttcaatttcttctgctgcttggctaattgttctggggtcagcttcttgttacgcttggatttaacaatcttggattcctttgtcaagttatttaaatcctcactcaaaaaactttctttgtcatcgtccccttctttgtgttcagtggcaattttgccatctttgtggtcgtcttgtcctttgtcttcgtcatggtcctcgtcctcatcgtcctcgctaaatgcgtcaaatcctcttttcagtgacttatttttgctctgcagatccaagtcttcttcatccgatataacatgtgattctacgtcttcgtcttcagaggaaagatctaaaaacgaggttgaggccgctttactcatagctattctccgtacaggttaaaagttctagtatcttttttttctctcaagatgagcacgcgaaaaataataaattaaatacttcttcagccatcggacatccaagtgtcaagatactttgtgatagcattactacgtaatcaatacaccctaaatcttaggagccaacttcttcaatactttgtcactcttctcaaagcattcccgcacttctagtgggtccctacgtagcatggcttcaagtgcctcggagtatgccgcctttccgtccctgacttgcggattgttcagattgttaacagtgtcaaagtaggtattgtaaatgtctccagaatgtgatcccaatgcagagttgataaagtagtccgaaaattggaaagagtcagtcaatccaatgacttggtcccgcactgataagcacagttcagacacaacatcagcaacaggttccaacgaatcgatggccttgaattgtaagaaataagatgcaaaattcatttctatctgtgaggttgcaaacaaagctgcaatttgaacaaggtattgtttgtgagcttcctcgtctccaagttgtttaattttcaaaaccaaatgttgcagcatatataaaacagcattcaatttggaaaggactactcgttgagctgctatgtcatcccatgtggactttttgcttccgatggattcggcacaacgtacacctagacggataatggtaccctgataggcattaatcaacttggacaagttggtcatactttgtttgttaggaagcagaatagcttccttgtcgatattgctgattccattcaagtatgacaagtcaccctttatcttcttttccttttcttgcaacttgataatagattgcacaataatcctaccggcattacttgcaaggatgttgttatctccctcccaggtacattgaacaacccaatcattatatgctttaccaaacccggaatacgaggaatatccatgtccaccacatgcctgtctacactcgtcaatcagctgggcaacataccaggtcgcagtagatttcagagaagcagaagcacagaaaaggttcttaagtccggcaatcgcttggcccaacttagaaaaatcttgggactttccggcggcatctagattactcaaaacggagtcataagtttgggacaaatcaaaagaacttattgacagagcataggtcagggccaagtaaggaagaagacgacgctggtgcaatgggtagtcaatcaatttgagttcctctgaggaatttttggcgccaaactgtcgtcttccaacggaatatcttagagcaatggtgatgaaacgctgtgccattctaaaagaatcggtaaccattgtaactcttccacccagcaaagctccgtacgctagctgctccaaaggtggaacctctacatctcctgtctctgagtccactttagtaaacttggacagcatgtagttcatcgggattcggacgttggtaaattgaatccaaccgttgtcaataccatctctgcccatcttagcgccaatgtcaccaatagccacaccggaatgtaagttatgatttctgtctctgatggggacaacaaaagttttcactccgtaatccttaccactgacaattaacctggcatacaccacacagtgatttgcagaatgggcagctcctccaatccaccatttggtggcacccaaatgaggggtgttgatttcaaactctttagtcttttgatcaaatgtagctgtggtttccagacccgccacatttgacccgtgggctaattcagtcataccgaaacagccatacacatccttcaagtaggcggcaccacgttcgaaagcccaatacttgaactgttcctccgtaccgttgcctctaattgcactcagaaacaatccaagatggaccccaactctcgtacctagttgtggatcaacaatagcaatgagattcagtctcttttggaagttctcaaagaatggggcatccttttcaatataagtagccaatctggcgatcttctgagctgtgagctctctgtgctggtctttcgtcaagtcgtaataactggcattagttttcaagatggtgtctctttcgatttgttgcatcagagactttgtgagagcagcttcatccttgccactctccaaaaattcaaacatcttgttgatatcaaacttggtagcttttctctccttgtcaatggccacctgcggcgactgacttttgatcgattcaattttgaacatgttgtgattttcagttgttagactggttaaaaaaggtggactcagctcatggtacttatataagacactggaggcaatgcatgtgatgcactcttactccacatttaggtgaatttcacatggaaatacaccgcgaagacttatgtgtgccgaaaaacggtgatgatccatggaccggagtgcaaatagtagacgcgaaaggagatgatgccctgcctgttctcccctccatgaaaaatcgtaagatcatagggcagtagtcgcctagcagaggatgcttccacttaaacggagaatcgttaattataattctcatctatgtacaatacacctacaagagatacaccatctttccgcttgcatcgtatccgatcttacgatccttcttattatctctgagacatgttccgtatctgtatccgaccgtgccagccttggcctccacaaacttgaaaagagacttctctccttgcaaaaccggggccaaaaacccgttcttcttactggtggatttggcctgcatatggtgagcagcatgctctccctgctcagatagtttggctaaggtttcggcagcaggttctaatccaaacactttggctgcctcaactggtccaaatggttcactctcagcaatggtaagaaatctggagttcttggttttcgttggaataggaatctctgtaagattctctccattcaaatgaggttcaaacagtgggaacatcttgtacattgtctcgctcatcttggccaaatctttgtcaattttattctagaaagttagtaattgtgagttttcacactaaagagatgccagagttcccccgttgctgggattcaatatgtcagtggattttaatttctaaccattgttgtgtcttcaagactaatcgaattttttaaataatctcatcatttaaatccagcacaaaagaaaacttggcaactcaccacctgataatacttacgttttgcttccattcttgttctatgctatacaacttgacgatagcctctatccttggaattttcagcttgtatttggaagcaacttcctgtgtactcaggcccacctccaggatgtcccgagcaatcttctgcttcaaatctttagaaatttgaaaattggtcttgcaaaaggggttgaatgggaatggttgtaatgacctctggcggctcactttgagcttgtattggaagttggaagagtcctttgcttccttgtcatcattggagtcagcggtaacttttacggattgtccgcgttccaaatcgggcttgacatagtttggttgatgattttgtggcacataatagtacttgttcaagtagtactcgcctttgtagttctttgggcccaagaactggtccattgccagcttcaggttagatttgtgaagcttggtgtgcttacgtccaaacacatttgtgcggtaagaggggtatgcaatggtacgtctgtaacgaacctgggtcaggttgataccagacaacaccttgggggacttgttcattggcgttgatacgggagagggaagtgtaaagttttcacttatgggcgatcaggactagtcgagatgttggtcatgtgacgtatcatgtgacggctcctacctcctccacccaatttattcgattaaacaccccctatacaactactaagggatccctgtcctctctactgatatctacattgtactttaatccttgctttagcagttcctcttctagttttgccttcatctccttcaagtatcctctctctgtgtttgagtggttgcatgtaatcacatatgacccactttccactaaagctaacgtttcatgatgtgacatttccccggtaaaatacaggtcagccttgactccgctgaacactgacgagccagagccggcacagattgccactgtctcaactctcgggggcaagttcgaattaagaaccggaggagtcgccagctggatgtatggcaactccagatgctccttgatacgcttcaccaaatccacaatatcggtaggctgacttagcgtaaccactctccccataccagcgccctctgttacctttgatggctcaatgactgatcgagtggggttggattccaaagcctcacaaagccagtcgttgactcccccctgaacagcatccactgcagtgtgtggggaatacactgaaactccattagcaatcaattggatcaaggaatcctgttgagatcctccgctcggagtgatactcttgagtggtctgaatatgaacggatgataggcaacaatcaagtcggtcttgctcttgattgcctcttgagcaactttgctggtaagatcgatcgtcaacagtatagaaagaggcgtagaactggaattaacccctgaggagtccaccagtaatccagtgttgtcccaggatgagtcagcaagctctaaggggtacaatcgttttaacgcactcacagcgagttgaactttctgacgtttgctcatgtcaaatgagaatgggtgaatttgtaagaaagacgaaaaaagaggcagagaaccatcaaaacaaaattttcaggaaaaataaaaactttaattttttcccccttaattagacaacacaaatcataaccattgactatgtcgttgacagtcgggtatttggagcaaataataaaggacaggctggaagctgcgctggttcaagtccaagacatgtccggaggctgtggtcaagcttttgccgtgattattgtgagtgatgtcttcaaaggaaagaacaagctcatgagacatcggatcgtcaacaaggcgttggagcaagaaattgctgccatccatgcctttacgcagaagggattcacagtagaagagtgggagaaacagaaaaacgattatcaatgataggaaaggcccatctccgtttcatcatcaaaaagaattacagcgacctcatttcctctcccctgatgcattaacaaatcttcaactcttcattcgatggcccaataagctcttcaacgaagtaaataataaatttgaaatcccttcaaagcctgccaaatctaaaccgttcaatagctcgattctgaaagcgtcgaagccctcaagtccttgctcttcatattgttgtttccttactattcctgtgtattttgagtcactgctggcttttaccagccttgtgactattcctagaagactcggatggaagaacaggttgaattcctgttctagctcttgctggtaaaattgtatggtcgatagcttctgtttgaattcaggcggaaggaaagcccctctcgccgtttggtcaatagagaaccctctgtgtctccaaagaagattgcaaatgtccattacgtatgcattgtttagttgtttaaatggatctaattcatgtgtattgtagtagtttttggcccgcacaacgagatgacaacactggtccacgagtaggctattggttgaaaatagcagctcgtacatcaataccgggggaataacaatgtttcgggacccttgcgcttggagaatgaattgggagagtttgaagagacggaagtatctctccgcggtgtgttcgttgtactgaaatatgatgtctagcattttttctattaccattgcggagatggtttcatcattccaagaagaataagctaacggctggagccattgataatcaggcgaatgcttttccagaaactcatctttgaactccttggctgatactgcttccatgtatggaaaccacttccagacaggtactacaccaacaacagaaagccctagctggccaaataaaacttttttgacaacaggtagataaaatctttgatcgtatcgcagaattattaataatttggggaacaactctgtcagtatcattttggattgtggatccaattgtccattgttggagatcaaggcatattccagccaaacactcagtttttgaagtaaatcatcagggactttcattaactttgatacaagaaacttcaactcttcagtctctgaagaatcttcctcaacattatgttccttgaagaatgagtatatgatgggtgatacttgtagatcaggagaactcacattcaacgcaaacaaaagctcaattacatctggagctgtttctgcgctgtaaccatgatgtgcgctttggcttttcaaaatccctatagaatgtgtcaattgatctgcaggaacggcttcttccttggttaagttccaaattgactggagaaatgtgagattttgtttcaaactctgagcaactttcttattggatccactctgatacaactttcgaacgttaataacagattcccaatgtttaatggtctttgagtctgtagaaattatagttttcatttggtctcgtgtgatagaaacggaaaagtcactactcatcattatcaacaattgcaagctaaggtcatctggatctttgtccagaagagttagacacaatttcaagcttgaaaaactcacttgggccccaaacactttgtttttgctcaaaagaatgatcaatactaggcttcttctgacaaatttgtatgccaagtagtgtatcaatagattcatcagcttgactgtttgatcgtaggtttcccattgaaaatgattcagaagagcccaattcaacagtgctgcctgaatgtcaatgtgaagtttttcctcttgaacaaaatatgactttacgcctaaacacgagaaaatctggatgatgctactctcttctatcgtttcatacgtgaacaaccattggtttataagcttcaatttcgtgttcttgtcaaaaacacgtccattgaagacgttcagtacgatttcaagcactttttgagtttgataagagtccagcccatacttttctatcacaacaccacctttcaagagctcgttgactttcttctttaaaatggcaattctgggtttgtctatctcctccttcaaagcttcttgattgaattcaaccaatttgtctatcagtcgagatctgacttccaaatacttgctggtcttctcgctatccgggcccattccagtcaatatcaccaggtctaagttggctctagatctccctaggcgcgttctgaagaagttttgatatacataaatatacatacatgcttatctaagcacagtggttactttccaactctaagaatacggacgctggcatcctccagttctggcacgtcatctaccttcagaggcgatataaatactgtttgtctgtgatattcgtttgatatgcggtcaagaatcattttaatggtcaagttcttggaaacatcgtccataaacacttcaaattcatccatggcacgaatcttacagtccatgtgcttccaaattgccaacagaaatgcaatctgggcaaatcccttttcccctcctgaagctgtactgacagatttaggttccccgtcgagtgtctttgaaaaactcaagtgcaactcttgtttattgaaatcaatcttgacttttccgtagtgggatttgatacgcatagcttgcttgaaagacacgttcacatcctgtgctatggtctctttgatctgagataaatgctcaacccgctcggctaaaccagacacaagtgagtccctgaggtttacaatcttttctatattgctcaaagcgtttgagtattcttcttgtgcctctttcaggttacttagaacttcttcatatgtctttccatgaatattctggattcgtaccagttcttcttcatttgcttcaagctcactttcaattgtttctacggtctcatcagcttctagtgtaacttcttccctgggtacgttaaaggaaacagcagtttccatctccgatcttagtttaatttcgtactcttcaatcttagttcgtatgtcctcgatctttctctcacgtttggcaatatactccttttgctgaacgttattctttcgacacagatcttgttgcgtttccatctctactaaatggttctccacatcgcttagctgcttggtcttttcatttttctgctgtaaggcatcgttgtaaatcgatttcttttcttttaagtttctttcggcttcttctagactgctttgaaaatcggccaattcagccagcttgatgtttacctgagtttcatagtgttttaattcttgctgcaatgcctccacttttcccgtagaagaatcatcgttcaagttgtcagtaatatcctcaatttcagcattcaatgactgtattttcaatttcagctttgacgagtttgtttccagttctttcagctgacgttggatggtagcgttttgctctttatactcagagtttaatctgtggattcttgcttccacattagctatatcgcttgctacctgcttgagcccgtcttgagtatcaggtccaccgtttgaaattctacccgagttgaacttgtatcttattggatccgtagccaaagtcccatttctaagctcgcatgcagagcccgattttctattatacaatgaccagatcctagtaacatgggctggtctagaacttatagcatccagagcatcctggggtgattctatcaacagagtctgatgaattctgttcatatccacaaggatatactccacagcttcagaactaatctccaaaaaattttgaacggtttcaaaatttcctattggcttgtgatgtccatactcaaatttttcatgtttcctttttaaaacgttcatattggtgatacgatacttacggagcatactggataataactgctgatcgtgataatcttgaacgataaaagagttcaaactctgatccaacattgtttccagcaatacagcccattgtttgtactcgggtttcaaagtgatgtaaaaccccagaggtccaataggtttattgtggaatcttgtatccttttcgatacttgccaacagggctttcaaatttccgtggtagagatcgtgaacattagcggaagattggctcatacttattctcatttgctccagttgtcttagttcggaccttaacgaactagacttgtcttgataatcgtaaaaagaagattcttttgaatctttcaaattcttatactcctgttcagtagtagttagctgcttacccaaagcagccacttgctgctctttatcagttttccttctactccagtcttcaaatgatcttccattacgaagtgcttgttgttgtgtttcctcgtctatactttccttaattgaaacacacttctcctcatactgacgtttctcttgatttgtggattttatatccgctttcagttcagaaactttcttcgagtattccggcaatgccgatttgtgcttctgaatgctgacgtccagtttatccagatccttctttatttcaagtgctttcttattgaaggtatctttcatctcgtccagtttgagggttttatcgttattctcttcaatcttttgtgctgcttggtctttcgcagctgtattacgttcgattctttctgtgtgtgatttgatggcattttccctagtttgaacgatacaccatgccctctttataatcagtagctgcaaattctgttgaattttctccgagtcttggtacttagagtataaactttgagcatcctgttcctttagcttgagctcttctagatcttctttcaactggactaactgctgagacagcttttttatttccaactcagactccatatgttccgccattgaatcgtgtaattgggtggattgcataaagtatttaaacaactggcttggagacgtacttctgaggaactccttggctgctgattggtttataatagccattggattcgttatatgaattccaaaatacttcagcattgccactaggtcttttttcttcgacgaaacgtctttgcccttcgcattcttaacaatatatttctgtgcgccatctctaatgatgaccctttcaacaatgatcaagtctccaaaaacctcaggtttgtacgctgacgctccctcgttgcatatttctattattattgtggctttgttcctgtcgtccttaatgaaacttttgaaattggaccctctatcagtttcacctgctctagctcctaacccaacagtaagggcagataagatggtgctcttcccttggccattatttcctgtgataaaactgatctgcgggcccagcagtacttcaaaattatcgtacgccataaagttgatcatggtgaccttagtgatggtccctgcagaaaccgatccaaccttagaggaattcagatctgaaaacaagagcatcttacgcttctttttcggtccagaacggttctgagtgaactcatcaagcacgttaaacggctcctcctgggttgagacgtttgccactcgcttcatccgttctttttctggcactttgaagcacggagacgttgtgatgacagaatgtaaatagacacgggaacgggttcgatccgggatatttcaaaatgcgtctcgcgactccgctcctaataaattattcttttcacccgctccactcatcatccttttctagtcctacactcccattaggcccttcttcatgaatgggaaacgcatgctcgatgccaagtggattcctagatggaagacattggccaaaggaggcctgaatcccagaaaagctgtcccgtcaactaagagtaaagtctacaacctgaccatgtttccttacccttctggaatgcttcacttgggacatctaaaggtttatacgatctctgatgtggtgacaagattcaacagaatgaaaggctacgacgtgatacatcctatgggctgggatgcgtttggtttacccgccgaaaacgctgccgtagaaagaaaggtcaatcctgcagtctggaccacctctaacatttcaaaaatgaaagctcagatggagatgttcttagccgattttgattgggagagatgtgtcacaacttgtgatccctcttactacaagtggactcagaagatatttctcctactacacgagcatggtttggcttataggaagaaggccgaaatcaactgggatcccatcgatatgacagtgctggccaacgaacaagttgatgatgagggcagatcttggagatctggtgctcttgtcgaaaagaaactacttgagcagtggttcttgggcataaccaagtatgcctccgctttgaataaggacttggatactttggatgaatggccacacagtgttaaaactatgcagaggaactggattggggaaagtgagggtgcaaacattgattttaaactgattggcagtaggctagttaccgttgactcggatgttttaacatgtttcacgactagaccagataccctgcatagtgttcaattcttggctttggcattggaccaccctatcattaaagagctatcattcgtggatatttcccttcgggattttgtcagcaaacattcagatagtaaatcaaatgtgactactgaacctgactccaaagatggttacatgttggggctgtttgccgaaaacccagtggaccccgatggtgatgctatccccgtgtatgctgccccttacgtgattgggtcctacggctctggttgtgttatgggttgtccttcccatgatgctagagactacgacttttgggtggacaaatttggagattcggctgaattcaagccaacagtggtacctaaaaatagttctcttgaagttgagcttccatatagacccaaacagggcatacttaatgagaatgctgggaagtatgcagggttgacagttcctgaagctcaagaggccgtcgtcaaagacctagaggctaaaggtttaggtttcaaaactaaacagtacagaataagagattggttgattagtcgacaaagatattggggagctccaattccaatcattcattgtaattcttgtggggttgtccctgttcctgatgaagatttgcctgttttgctgccacaagtggagggtttagttggcaaaggtggttcgccattgaatcagcttgaagaatttgtaaactgcaaatgtccaaaatgtgggtctgatgccaaacgagatactgatacgatggacaccttcatggattcctcgtggtacttcttgagatacaccgatccaaagaacgagaaggaaatattttccaaagaacttgctgatagactcatgccggtcgacaaatacattggtggggtggagcatgccattttgcatcttttatattccagatttatttccaagtttcttcacgacatcaaagcttggggtggtgaaaacaccaacggagaaccaattaagcgtcttataactcaaggaatggttcatgggaaaacgttcattgagcctaaaaccggaagattccttcaaaagcatgagttagaaatctctggctccaaagtatttatcaaagggacaagtgttgaacccgaagtaacctatgagaaaatgtccaaatcaaagcataacggagcagatcctgcagaatgtatccagaagtatggagcagatgccacgagagcgcatattctatttcaagccccaatcacggatattctgaactgggatgaaggtaagattgttggtgtgcaaagatggctcaagaaggtcatctctctagcagaaactattggggaaagattgacgaaagagcctgaagaaaccaagccaatcaaggatttcaacgagaaagagactcagttattcaacgacgttcaagattatattggctctgtcacggattcgttcggttatactttatctctaaatactgtgatatccgattatatgaagcttacaaacaacattgccgataatgtcaatgatccacaggtcagcatctcattattaaagtcctcattggagaaacttttaacgataatggcaccagtgaccccggtgacaagtgaggaagccaacgagattcttcttgccaagcaaagcataccatggcaatccattttgaaggcagattggcccgatatggaacctcgcatagagaatactcagatgaactttagtgttatgattaatggaaaagtcagatttgtgttcagtggtgacaaatctctagtggaaaaggaccccaatgcggtattagatattatcctagggactgaaaatgggcaaaaacacatcgggtccaaggaagtcaaaagagttatcataaaaccaaaaatgatgagcttcgtgctcggcaaatagatatctttgagtactatatcttgtacatacatttagaaattcatagtttactcatatcttggcgctctggcagacaatttccagtattctctgctcttcatcgcttatttcctctagcatttccttggctatcacccaatcatcagaactttgaaaacgcacatagtcatcatcttcgtctttgaatttaaacctaaaagattcatattctggcagctcgtatccaacattttgcctaagatttttaattagctccagtttaagttcatgaaatgagatactggaagggacggaaagatgtgtaggctcattatcgtagatgaatttgatgcgaacctctgtttctcgttcgtttttatgtttagagttcgtagttgacgaactgttgtaagtattaatatccgggaacattgaagaaactgagtgattcctactcaaagtagttgcagtactgacaacagaattgggcgatgatacagacctctttaccatatcatcttggtaaagactatgaaggtttgatggtggaacaaagtaagaatttgaagacatcgagttcaatgatgaaggtgtaaacccgctaacgctccccatcttgtgagctgagccattggacattgtggattctgatctttgtctgccaagattcaatttgaatatgtcttgacttgataatcgtttgttagcataatttggttcgtcatttctcaaagagagttttcgaagggtttgttcccattggctcctagtttcatcggagcgaaacttcatcacaaaagttccagaatctttgttccctgaccacgttacagccatacaatgaccttgttgtgtgctgctagttgttgaaatgtttgtgatatatgcgacaaatactctacctttcaaaataagctcgctgggcggcactccacccaaagatgattgggatccattaggtaaagactggtgtgaggaacttgctagggaagcggatgattttttcctcgtagatagcatcgatttctttgtctgtaatgggggcatttcttctttaaaaaataataatatagtttgaaataggtataccttaaagtctctctctgtgtctgaatcaatgacagtaaggttgctgtgaaataagagatctccaaaggtagatatatcgtagcctctccatgtttttacccttgtgatgaggtccttgaccagttcggcattttctgcacgtctttgtgcctcgttgatatcatgggccacaatctttgagtactccaaagctgtacaaagttctctgtaattagggaaagattcatcagttaatttgactaattctttcaaaagtaaagggtacttgcataatcgctgaataggttttatcaagaaactctgcagctcatagtttgcgtcaattaatgtggaggactttctcaaactggcaatctctttttgaatgaacctgatcgaggaatattgtcccacggcccatgtttcatataatctgaacgcattcaatgcgccatgcaagtacacagaacctatccgctggtacctgtctggaacggcagcgttacattctagtcccaccaaaaagcgcctttgaaaatcaacagcttcgtttaaactagggaacatgtttcgtatagcctccagagaaatctcttcttttctctctagctcagtcttgtacttcaacaagatctcaagatcaaggacatactttctctctgtttccactaactctctgaccactttggaacgggcatcggacactttcaactcggcatcaactgggtcggcaactatattggaatacttatccaagagaaaattcaccaccttgataatctttaaaagactgttcgtgtcattggtgaatacgtcagtcaccgtgaaaagctccacgccatccaaacttaagtgggtctggcaagcagagagaaattcgtaaatactcatcttgcatattttcaattcatcacttgggactaccttgacaatccccggttttatgctatcaaataaaagacataatggagctccctgttgaaacagtttccaaattgtggtcaccggatcactgcttgattgggcaggtaagattcctgctacaaaagtttgcagtgaggatgatccgtagctgaaatccaatgttgttgtgtttgtagttgtctttgataattgatagccactgctattcctagtgctggagatgcttccattattggtagacgagctccgcctgctgtcaacaaagtccaagccgttactgttgcgatttccaacgccacttgaagaatacatacccagcttactctcagacagttgttgtgccagcatcatggtttgtctttcagaagtcaattctgtggacgtagctgccaggttcaaatatttgagcattccggaaatctttgcaagtctgctcttcagcttcagggctatgaaatagagcgactcctccgcgtctgcttgtttgttcatgatcagaggagcagctgccataggagcactaggcgtcctcagctgctggatactcaatgaagagcttgcattcgaccttagtgggggtatgtgtagatgtgacatgagttgtgtcgtcggtagcggggctagctatggtacacaacaagagttcacctgtaggtttattgatgtgttaaaaaaaactacaatacacgttaagattcgctggggaagtaaactgtgaagatggtagtgtcacactcatatttctgaggcaggaggcgatgagatgtttgatatacacggatagttaatgttgatgagtttggggtttggataatgacgatagaggaggtcagtccacaggggtttactggcaatgctgcaaaaggggggaggtggttagttgatagagctgataggtagtacgtcaaaaaaaaaataacgacaccagcaggatttgaacttgcgcgggcagagcccaaaagatttcgagtctttcgccttaaccactcggccatagtgccttactagagcaactgaggggttaaagtgtatatgagccaaaaatgtaaggttgaggattcatcattttataatttgatagccctgttcatactagcatacctagggaaaaatttaccgttggaaaagttgtttttctccaccctattcaaaagtcaaggtcgctcagtaattgtagttataatgagaaagccgcagctacattgtcagctatatagcagagtgaaatccaacccctagaacgggaagttgaacaaccacggaagaaccccaaagaagtggggtcgagttctggtgacttatcattcaactttcaaacttttcccgagaaagcttcccacaagtggtcttatctctcctcggcaatttctatatagctggtcctccaatataaacaacacgcactttgaccggcacacgacgatggcctaggaaagcttgaattgaactttccattttcgaaaaagttgccattcgtaactacagacattgaatatgactaaggcattcccctcaggtagggtagaaacactctcttttgaagaggagtacatcctgaaagaaacatgggcatactttctgcacttttgggggtacaactttgccttagcttccaagtacaagttggagaggtctctcacgatgtcctcgacacattcgggcagtagctccaaaacagcgccaggatcgtccggaactagtagcagtggaaggtcgaaaaagagcaagttccgtctgaagctgggtggaaaacgtaaaggaagcattgatcaaaacgaattgaagagatcctcctcgttagcttcggcaaacgatccaaacgtgctcgtgtcaaccgagatgaaaattcatgaaagcttcagagaccaggacccaaaacagctgaaggagaaattctgggactttttgagacacgatactccagataacctgctactacgtttcattagagccagaaaatgggatgtcgataagtcgttgctcatgctggctggcacgttacagtggagagtttgtgagagccatgtagataaacttcttcaggacggtgagttagttccctacaataaagggatgactgggttcatgttgcaattggaactggggaaggcatacatccgtggttatgatcgtaaaggccgtccattggtccatgtacgccctaaattacaccatgcctctgatcagaccgaggaggagatgcagcatttcacattacttttaatcgaatgggctcgtctatttctgaacgacccagtagacacctgttcaatcatttttgacctcaccgatttttccatgtcgaatatggactatgcaccagtgaaattcatgatcaagtgttttgaagctcattatcctgagtctctaggagtgctgtttgtgcacaaggcaccgtggttgttcagtggtatttggaatatcatcaagaactggcttgacccagtggtggcttccaaaatccactttaccaaaaatttcaaggagctggcggaatatatcgaaccaaaacatatccctgcttcccttggaggtgaagatgattatgaatgggaatacttggagcccaatgataaagataatggagtgattggtgatgagacgaccaaacagaaaatgttggcacagagagagcaaatcgtggagaagttcctggaaaccacaattaaatgggttgagtctaccactcaggatgaaagtagacgatacctgcaggagaaaatagctctgggcaagaaactagcccaaaactacatagaaatcgacccatatatccgcagtcgaagtatttacgaccgactaggctggataaatatgaaggttgatagcgtataggtagaatgagcccaaggatagtagagacaacaatgaaatatatgcgataaggtaagtgaccggtactagtttgaagcggacgacagcagctagttgggcccatatgaggcagtactgagcgatgtagacaatggtcaggaaaatttttggaatcttcctgtaaaatcttttgagaacgataagggaaattgaggtggataacgacaggccagcaatgacttgtgtggaaaagagactgttttcggtcctcctaactatgaaaggaagaaggtctagcgtggtatttgaattctctgcaaagattgaagtcacagcgttgagagtataaatatcgcaacagttggggaataagagggaagtcgatagagagctaacatcccaaggggagtctaggaaggcaagatacaagagctcggggtagacatgtaagtacatttggtagtagtccgtgtcggcttgcaaacttgtattggaagggtagtaagtagaaggtaaagaggtcaaaaatcgtttggcctcgtctccagaaagagatatgtttgtggaaaacaaagggtctgtagagaactgaaggaggatggggatgaaaatacccccaaacaccatccaaacaaggtctaatgctaggcatagcagtctaatcatgggtattgtcgtaattgtggggagtaaaggagaaagaacagactgagcggctgccgttcccagttaattcaatgtagacgttaagtgcttagataagcgaacccagtgagggtaggctagggctccagagcccacaaatccaaagagaccaatgagcgtctccggtaaaaagcccgatgtagaccaatggaaggtcagtgggaggaatcccaagttgttgtaaagtctgattgcaattgggttcaatttggcaagatcaagtgaagatctgagagttgcagttgaacctggacgcaaaatcgacctggaaatgtcagccagctccagaatgacgtaaagggcccagaaacggtaagataaccgatacactttggtgttgtactgttgatcttttgggtcattcaggtcaaagtttggaagggacaggaaattgtgactcagtactgcggcataattctccaacgcttgaaatattaccaacgatagggtctgagccaatggcataagtttggagtacgaaatgtttggtttgctgttaagctgtctcaaaagagaggccaacaacgggatcaacgaccaacacctagaaacgatacgatagtcttggaaatagtagaaaatggctctcaatgattggtagactttggctgaataagccgacgagtccttggagtgttggaccttcttgagtatccctgctaccaataaagatccatactggaatgtggccaaagtatcgtcaaatttggaggggttgcttacaatttgggactggatcgattggtaggtgtcctgggaggagatcaatcttagaaggaagccaatggacaccatagggttctaataaataaataaataacaaacgattatgtttaagttgaatgctaggaagcactggccagggccaggtaggaagaggacataaaagtcctgaaagagttctccccgctaagtaggtagtctacatagtctatacccgctccttccaagcagatgacgcctactgcgattagccctgcaagcacaacttgctggcattctctgcacatacgaaatattgagacgtactcactgcctaccaccagattctccatcgtgcataataggatgcaaccaagccgtgcagtctctctacaagaaatcgggctgagcgctcaaattctagtatcaaccaatcgtggcctatgcacatcgaaccgccccgaccttaatcggggccactcgttacaatatgttgtacgttgtaaagtcgtcttgagggaaaatgcgtcccctcccttcgcccagtgcaccaacaaaaaaaacagtcccaaaattggtcttgacacctacctttttattaacgccccagtctcgcataaggaccgtactgttcaatcgtactgcttgcacggtatatagacatgcatatgtacggcaaatccacttttttctcttccttcgcttccaatttgcatttgtttgttcatttgttttcgtttagatgagttcgactaatccatcaggacccccaggagccacgtccggcgcaactcctaattccgtctccaatgctgccggggttgtcccctctggctcgtccaatcagcaggcttctatcaatggttcacccggctctggtgtccagggggattcaggaggccactcacagatcgccaggtctggaaacacctctcagcagactggccagctaggtcaagtcggtcaccagcaggttcagcaatcacagcctcaatctcagcaatcccaccaattgcaacagcacctcccataccctcagtatgcgggcacaggctactccaccacgaatcaacaaagcacgccttctaggtcctactaccaacaacagcaggactaccagtactaccagcctcaacagtattaccagccccaaggttacgcccagcaacaacaacaacaggccgctgctgcttcagctgcatcaggttctactcctagtgggactaatcaacaatacccttactactcctactcccaattgggttaccaacagcctgtataccagcagaacaagcaagcttccatcagtgccacggcaactccacaacagcagcagtctcagcaacaacaaacccaaggtgcagttcagccgcagccctctcagcaggcccaagcagactattcattccgttatggctatggtggctattctggtggttaccctggtgtttacggctcttctggctctgttccattgtaccagcagtctcaggcagcgccatcaggctataacacgtccgttatagttcaaagtggtcaaattccttctgttggacaggttcagcctgtaggggtacgccctaggatcaccactaccatgtgggaggacgaaaagaccttgtgctaccaggtggatgccaacggagtctctgtggttcgtcgtgctgataataatatgattaacggtacgaagcttctaaacgtggctaaaatgacccgtggaagacgagacggaatgttgaaatctgaaaaaatccgtcacgtcgttaaaattggttctatgcatctgaagggtgtgtggattccatttgaccgtgctttggctatggctcagaaggaacacattgtggatatcctttatcctttgtttgtcaaggacattgaccgcgttatccaacagggcactcctaccaataacgttgggcaaacccagatgtcgcctcgtgatgctaaacgcgatgagtataaggaaaaggagaatgcctatgacccaacatcggcttctactggtggtgctggtgctgggtcggtgagttcgtcatacccaattggctactaccagcaagctcaagcgcaggcacaagctcaagcccaagcccaggcacacactcaagctcctcagtctcaggcacacgcccagcctcagggtcaaattcagggttctgattctaccacatctgcaactgcttcgcaaccttacggtcaacaatttttctacggagtgaataactataatcctcagtatggttcctaccagtatcccaccgttccgggtacaacacaggctacccaacctcagaaataatgaaacatgtgttccaaaaaaaaaaatttgaacgaaagaaaaaaaagtctttcaccagatgaaaaccgtggagaaaactctaaagttgtttccattcgggattgcaattgcaataaacgttcacttgctctcttcctcaagttcctacatgtattttcttttgtacttactagttccttctgtatcctattcaatacacttaatgttttttaacagccaaaatatgtacatattttggcccatatgcacatacagcctatgttgccatggtaatttctatttaaacagggtaacccttttcgcagttaaatttaaaattaggtcatgcttattgttaggattgtcgtctcactaaaggaggtacaattactagtgaactcaggcctacatgtttcatgttgtattgtatttaggttcctatttaagtttcatgaataggaagcaaagcattgcgcaggttgaacttcttatctgctggttgctgtacctgtagcccaaggacaaaaataaaaagccctcacgcacctacacggcatctagcatacattgagccttgggctagcaacgttcgctgtatctcaggatcgaatgcctcatcgcttgtaggaaccgagatagtggctaaagtaacaacgtttgcattgcagctgcattcaagtttcaatgcattgctttggaacgaattaatctgaaaactcctcctcactttcatcttcactaccagcaatggaaccttcactatcgtcctcttccgaaaagtcactcccgtcttcagcagcggagtattcttcgctgacatcctcgtcttctggatcttcgtcactaacttggaactcactttcttcttcctcgctttcctcgtcgtcactctctcctccacctaggaaactccagcctccgttctcaaagaactcgtaaggatctgcttggatagtcttcataatggttccccagttcaaattaactgcgccctcactgtaaggtatgtccacgtcagtgagccattgtttgacgaattcaagcatctcaattgggatcgtgtttatgtgtacaacaggtttactgaaatctttgaaaacgaataccaaatcaaagttcttcaatccaaattgaactctttccaaatgtgccacctcaatctcttccagagttaccactaagaatggagtgtcgattaattgaatcaaacaatctctggtaggtagacacagtaccgacgatctaaagggaacacctgtgaatcccaattctctaaaaggtgtctccaggtccaagagaccattcgaagcttcactaatctcctcggcaaatcttctgaattctttgtccagcaaggccttacgtctgcgctcctcttgctcttgctcaagctcatcttcatcaccgtacctgtatcttctctttttattacctgtttcatcaacagtgacatcgctgacttctctgtagaattgcacatcaaaagtctttttcttacctatcattaaaggagtcttcaagtggcaatgaatgattaccatcagttcttctttacaaggttggaagaaaagatgtttgatgttactgaaaagtatatccactcgatggtcgcttctaacgggtgattggtaacggataccgttttggtgaataaataacgtcccagtaactcgtttgctgtctggagctggacgtacaaagacattctccaatttctttggtcttcccttgaattcaaccaattgtgcttgggcaacaacgtcttccattgttttacgttcttgatctcttttaacagcagttttcttcaattctgtgattgctttgaatacctcgctcatgcgctccttattggtagatctaaaggtcagtgaacgaacaaactccttgtcgtccccatcctcataagggagttctgtctttttgacacttgatcccataccaggagagttgaagttcagacgaatatacatgtaatcaccttcctcgttttttgatccattcttgaaggagttgatatgaaatggaacaggtctaccacaaattggcagtataatagtctgagcctttggatcaatggagatacgcagattcttgactttggaaggaatttgtgattctctcacgtatgattcgtaccgtttaaacacagcatggttttcatttccatcttgggcatcactcttgttgaaacgggctagcccttccttttgaatcttttcatgtagctgtttttgaatttccttgcgaagacgttctttttcttcctcggtgttggtagtttcattacgaagtttactctttagaattttggagcccctagcaggagcagagacttcaggtttttctatttttcgactggttggttcatctttcacccgaggctttttgtcttccccttcctcgtctttgaagtaaaacgaaatttcagatctactgattggagaatcagttaataagattggctcaccgcctgtgattctaacggtatcagcaatcaacagggagtaagtgccaagtggctgtgactcatccttcagttgctggaatcccaaaactaagttgattacagatccatcatgaatcaccctgtcatttttcgcattcagtaccatcgttgaatctctgaactcaagaccaatcaaggatccaatgttcttgacaaaatgctttgctagatcgggtctatctttgttaaccatagccagtgccttggcgtacacatctttacaaacggctccatccttgatctgattcatgatataagatctcaactccaacaaaaagtcgtaattcttgttgatctctctggaaggatcaattaatagagttcttgaaacgttggagcagtaagaattgtaacgtagacccaaagaagccaggataactccactggtcagcttatcgtcatttgactcggcactgaacttgagttcgtatttaccaccactttgaacaattggtctgtagcaccaatccagttgaccgatttcaaaatcaccgcccagttttttcatggacttattttgctccagagttttccaaaacttggtatcgtcgattttgttctcaatcttgtccacaacttgattgttggtaaagttcaaatcttcgtcaatgatattgatcacctcatcagtgaatactgtcatcatgttaacagtggcttttgatgcggtacgaatgaatttctgttcttcctcatccttgtattcagttgcttgtgacaatccggtggcaacatcgacgagttcaaagtcagacttggcggcgtcccatttcttcagccaatcctggtagaaactaccagtgaacttgtcttttgtgatgaccctaaccgttttgaatcatcaaccgatgactttagttggtctatgaactggtcaaacaaggcctcattgtgttcagagtccttgttccttgctaaaatcttcaccgtggtgacgttctggagaggagtcagatactttgctttacccacagaggttagaaaggttatcgagttctttgtgatcgcaagggctgtggcggggaactcgtatccaagcagccaattgtgcaaaattgtggactttttgtaagggttagactcatcggatgaacccaccacgaccaaaagggtagtaatcccttggaaaatttcgtttgaagagttcaacttccgctggatggccccaagcctgttcttgaaggccacgggatcaatctttacctctgacattacggctttattttcccacagtgagtattgtcagtggcggggaaacagggtaatggagtgcttgctggtgctggaagctgttagtctgaacaggggacgaacttgtacacgcgttgcgatttcctcgcgagaggacaagtgctttcgccaaaagcgctgagggtgagccagaatgaggttacccgtcgttctaaagaaactccgcctataccccaatgcggaagcagttggcttggtcgattgcagggtattttttccttggagaaacaacacaagcaccttctgtcaatcaaccacaccgacgtgaaccttttagcagcacatccgcatccaaagaacgactctttaccaaaacacacacccctatacccaccttagtccgcaaaattagttggggcttaattatcagaggaaaacataacaccatacaacccaacacagaatgtcaaacagtgctgaagattactcttacgattacgagtatctgttcaagattgtcctagtgggcgaatccagcgtggggaaatcaaacctactgtctcgattcactagagatgagttcaacatagaatccaaaaccacgatcggcgtggaatttgctactcgtactatagaagttgacgggaagaggataaaggcccagatctgggacactgccggccaagaaagatacagagctgtcaccgcggcttactacagaggcgctgtgggagcgttgttggtttacgacatttcaaactcctcctcctacgagggagcttccagatggttgagtgagctgaaggatcatgcagacgcaaacattgtggtggagcttgtcggaaacaagtcagatttgaatcacttgagagctgtgcccacagatgaggccaaatcttttgccacggagaaggggctattatttacagaagcttcggctttgaactctgagaatgttgaactggccttccagcaacttatcaaggccatctacgacatggtttccaaacaccagtttgacatgaatgattacggaaacgacaataaaccaataacaggtggccaaaccatcacgctcactcctactccaaaggatagtaaaatcaagaaggattcatgttgttagactacatagggagcaatttttcgtgtacaatttttttttttggggctaatcattcaagcctctgaagctggcttaggttcagcttctggttcaggctctttgaagtcggcatcatcttcctcgtcttcctcctcctcctcctcgccgtcttctggttgtttggacgcgtcatcatctttgcttgctgccttctcctgcttgagggtctcctcgaccttggagtagtcaatgactttccctctggttcttcttccagtagcaattatgttggaggagtcaatctcactaagatcatcctcctcttcctcttcagctatgagtttgtcgtcgtcttcttccttctccgcgtcttcgtcctcagacgatttgtcttcaggaatatcgtcatcgtagtttcttcttctacgcttcttgcggtcttcgggagcctttgtgcgtttcttggaatcctcctgggtttcgtcgacaactggtgtttcaattggggcttcttcaggcattttttaagacgtgtttcaataacttgggtgaaggggagtggagaactggttaatttgaaggtaccttggcgcgtaccagtatctcgacccaacccctaagattgctgggttcacccgcctggccagggtgagggtgatcaaggatactccgcgcgaaaaaaaccatccatcaaatcttcacaacgaactcacctactgaactcccgtccaaggcaaattaacgtcatgtcgtcgctctccaaacgaacaaaattggcatccctggtaggttaccacatcagagtgtacacggtggattctaggcagcttgttggcgagcttatctcttttgacaaacacatgaacttggttatcagtgagaccgaagagttcagggtcaccaaaaagtcgtatgctcaattgaagaaacaagcacaacagaaggccggccagcccttagacgaatccaacatccaagaaaccaaaaggtcgctgggactgataatactaagaggtgaacacatagtaagcgtatcaatagagggaaaaccaaacacccaccaaggatcccggattaatatcagcaactccggaggcatccccgaggctaaaggcgttatacgaccactaaaagccgagccagctctcaccaaacccataaagaccacccatagaatcaccaaaccacaaggtttcagaaaggtgtaactgattacataattcacgattttattcaagaatctattacataagcatgtcaaatgtgaacgttattgtcacgtgctatattgctttttgtatttctttttttaatttctaattgcatttatccggtttttctgtgttcccacatttttttcttcggtccttacttcggatgcagccataggccccagtcggaataggtcaggagattcgagtggggtggcggggcaattatagttatgtattttttcgccgcaacggaacatctaggtcctaagtttttccggtcatacgaatctcctcactatttctttttttcccaccctttttctgtttctcccctggttatccattttttttcctttcctttcctctacttatacgaaaaatcactcactgagcagctttatttgttcaaattgccactagctcagtcaccaatagatacttcgcaatgactactgctcccccaacgaagcccaatgataggccctaccagtgccccatgtgcgacaaggccttccaccggttggaacatcaaacaagacacattagaacacacacaggggaaaaacctcacccttgcacgttccctggatgcccaaagaagttttccaggtctgatgaattgaccagacacttgaggatacacacaaacccaactgtgagaaagggcagaaagaagaagcggaaggacgaagaacaagctgtggagttgccacctcagaataacgaggtacatctcgttcccatggggaacgatcaaatgggacaaccaatatacacgcaggcggttcctgtttattgggttccatctggtgctgcaaacggcgaacaaggccagtatttgatgcctccgcttttttccttacaaccaagacaggtgatggcagggacttctcaaaccagtttgaatggtgtagatgctcaacaacagcagcagcagcagcagcagcagcaacaacaacaacaacaacaacaacaacaaccacagcaacaaccacagcaacaaccgccactgcaaccacaaccacttcaaccacaaccacaggcccagcaacaatttggatttgctcaagatcaaagaaacctggcacccgctaatcagcaacagcacagacttctccccaccattttctgcatcttcaaggacccattcagccaattcattgttttctctcaactcaaatggatccacgccttcagggtcatatcaacagttgaactctttatctcttttacacagaatcactccaatcaggactccaagcagtaatagcctgttgacaaaatctaataaccagtcgatgacatcaatagtcacgttgagcgaccaacaacaggattttgtttccagaaaaaagtcaagacccaactcaccaacagttccaaactctccaacaatttcaaacttggtctcgcccgctgatacgcctttaactactccgttgcaatcgcctacactgaagcccgcaatgcccagcaacgtacaacttccaccaataagatcactgttaaatttggaagaacttccctcggaaccattgcagcaaccagccaatgtctctactgacaataaagtgaagacaatgttgaacaaatcttcgtccaacgtcactttgagtaaatcgttttcttcacaagacattcgtctggggaccaagagaaagtctgataccaacctctctgcattagattctaccaatgctattcgcaagcctgccctatcaccgttggctcctctgtcagtctcatcagatcgatttaccaagagaaagaacaacttcacgataggcaatatcatgaactcggactcttgattgtgacatataagtttgtttcttcttcacttcctcctttctttttctgttttacataacacttaccaaataatctaagaactgcttaatccaactacgctacaacaatcttgtttgttgtaatgcgatatcagatcacaaatccgtagaaggtccaccgtctctcctccatctctccaccatctttccaccatctttcctactcttcacttgggccatgcttctgttcagcactcttgtcaaggtagccgtgatagtcagtcatgttattacttttttcctcttacagacctcagacaacttttctctcagtcacttgatcagtggaccacgcctatccctttcactaggcggaaatgacgatcaattgagtctcaaagattcaaacctgaaaaacgaaattcgtttgtctgattacgggcaactgctctatgacactcaggataaccaggacgtcttctctcaagccaaaacgtgcagtcgcgtggggtcaatctatgttccagctgctactcctaaggtcctgaatcttgtacccaacgtcacaatacaagagccgattttaccttcaaaatcgtctccaatttggattgcgggtctgatggttttgagtagtgtggggtttgtaatgtcgatttgcgagatgtaccaggaaaacctaaagtttttactagtcaaatggttgccgttgcttgattctaacgtttccaggattcgtaggaaaacagtcaggttaatcccgtcattactaaacctgtttgcactccaagatatctctaaatctccagaaacacccaaaacagttacaaaagcaccgactacgcacctggtttctgttgaaaagcctcctgatcacctttctccgtctccctctcctttcccctctccctctcaccctttatctgcaagttttgaacggcgtctgactgccacacccaagtcaatatccccgcccaaggcacttgttaacctgattaggaaagacatcccagacaatcaatttatgaacaaaatgctgtatcaggcagtagcagaagtctccaaggccctaaatatggtcaagacatttcaggatcacggaccacacaattccaaactgttctctgatatgaacgatcagcttgaatcaaacatcagacgaagctccctggttttcgaccaactacgatttcactacttaaacgcactttccaagaaaaagcgatcaggagtaatgtacctcctgaaacaaaaagaaaggggtttcaaagctaaaaatagcaagcagaccctgagtatacctcccaatggcactgatgaaccactagagtacaagatatccaagatcatccagcgaatcatcaggattcatatccgtttgatgtcacaattctggtacctacaaacgactaaacaaacgaaatatcaacaacgatttgtgtttcaaaccttggataacgagagttatggagcagatgtcgtcaggtttatattaaatagcaggcatttatgccaggagatgattgacctggatttaagcgaatatcgccaatcaagcgcgggccgcggcaagtcagatcattatcaaataaacccggccgagggctcttccatggagtggaaaaagtgaagaaagtatataaaccaaagagttgtaccccagatgctgcttcaaaaccccacaactattcctaaaatgactcaggattcacatcaaccaaaaataagctctttggctttggctccaataaagtttaaactgtactatggtactttcgtatacactccagctctcggtgagctatccgttagtactgatacctgtattggggtggacaaaaagggaaccataaaaatcaagaaacagttcgaagaaggctccgacagtgagtccaacattgacttggtcatcgctgaaaacgggcttgaaaggtctgaacttgaaatacttgattattctgctgatcctaacaagttcttcttcccaggttttattgatactcacattcatgctccacaggtccctaacaatggaatttttggaaacaccacactgcttgaatggttagaaaagtacacgtttccattagaagcatcttttaaagatgtcaagactgccagctacatttataacaaggtgatcgacagaacgttaaccaacggaaccactttggcttcatactatgctacaattcacgaaaatgccactaagctattgaacgatattgcctatttgaaaggtcaaagggcaatgattggtaagacttgcatgaatcaacactccccggataattatattgaaaccctagatgaatgcaaagaggctcagtatggcgtaataaagcacgtagaagagaccaatgagggtcatgaatcatttgatgtcattaccaagcctattatcaccccaagatttgctggctcatgcacagaggagctaatgaaatggttgggagagctcagtcaatctggtgaataccacgttcaaacacatctgagtgagaaccacggcgaaatcaagtggattgccgatatgttcccacattttgacagctatgctgatatctacgccaaatgcaacctcttaaccaacagaacagtgttggctcattgcattcacatatctgaagaagagaaagatttgttagtcaaacataactcaggaatatctcattgtcctacttccaacagttcaattacgtccggtgaagccagaatcagatggcttctagacaatggggtcaaggtttcattaggaactgactgttctggaggcttttccccatctattttaactgtcgctagacatgctctgttggtgtctagacacctggttatgaaatctaaacaagaccagcaaaagctaaccactgctgaagttctttttttggcaaccgtcggaggtgctcaagtcttgaatgttgactcataccttggaaaatttgaaactggattccaatttgatgctcaactgatagatctaaacgttgagaattctccattagatctgtttcccttccaacaggggcgctggcaagagttactggacaaatggctcttcaacggagacgatagaaataccgtcaaagtctttgttaacggaagatgtgttgtttccaaagtttgaaatgtttaacgataccacgatcctattcccaaaagtctatctgtttcaagttttttccatattatctttatttatttattgctctgctttttttcactgttttggtaccggttttaaatttaattattttccatttatatcgcacgattaattgtagcatacactgtacagtaaggggagatttggatgatctttttgccaagctgccaggatatccggaatactgtcctcaaacaaatcgtaatttttctgtatacttgtgctgtccttctggtcaggcttctggttgaattcgttagcttcttccatcttcttttccaactgctgggccaagtccaggataccttgacctccaatcaatgcattatcgtaatcatctctaatttcaacgttaattacgtgaatcaactttctgttaatttgggagctagtgtcgttgtaagatctgttcatgaaatcctctactacagcatcaaaacaccgctcttcgcatgtaaacacaatatcaaagtctagaccttctgttgtttgtggttcttgaccgatatagggccatcgttgaggagcctcttttattttttcatttctatcgatcattttcaaaactccgtttgcctgatgtagacgaacgtcttgtttcatcaattgttctctcattgtgctgtaaggggttccaaattggaacacattgggcttgtcgatagatggaccaggcaacctaacggctgaccctgtcccatacgaacgaaccttgtatccggcgtctttcaacaatttgtgtgcctccatggaacggttttgattggacgcgcataccgtacaaaagctgagaagctctgacattgaaggaatgggaaaagttcacaagaaatagtcgggtaggaaatgcaaagagtgaacctagatacggatactgaaaaaccactttgccgaatctgaagattcgaaatcgcgatgtcggatgtctgctgaattgattttaagattactttcctacctacctacagaaatcccagacatcttatcatctagggcaattactccattatcctccgaaagtgtaggaactacatcttctctggatacaatgactggttgcgaaaaccttcgaatcgggaagtgttggacataatccgagctagtttcgtcatcgacccctgtatgagttctgggttcaagaccagtaacagcaaaatcagcagcaagatcaacaaaatcgtcactatcgcttgcaatcgctgcgctatcgcaatcttcgccactgcaattatcgtaatctgcaatcgaattgctgcgaaggctgttgaattgaaagtttgatgtcgattctgagacttttgtttcagtaatatgaacaattttgtgagagggatctttcttcccaatattttctttccaatcgttgaaatcatcctcactggtgattaaaaacccaatcaacattgagggatccatgtgggataaatgcagctttgtcacttttggtgtgtggactgatttgacatcaagacacgaaagaatttcaacgtacttgctgttgtctaacttgctttcatagcagtcatcatggtttgtttcattatttgaatcagtatttgataccgggtactgtccagcagcattttcgtcagttttcttggtttgcagcctatgaacgggtttctccgtgcttccaaatgttaaagctttttggggaaggtggggatctagataaaaaaggtaatctccttgaaacccgtagaagtaatgcgaggaacaaggtcttcctccggcaattcccactgattgctttaaggagagacattctctcagtgaatcccaatatacagggttcactttttctacccccagccttattcctagcaaaaccaaaattggagtaaatgtatcggagtcgccataggccaattctctaacttcggtgtcatagacatcaccacagtcggaactaaaataaaccctgagcccacaaggaggatactctttgcacaaattctttatcgctcttgaggcggcactagggccaaaccattccccaggttttttatcgcaacatttgatgccctgctgaacaaaattgtggatagagaacggttcatcgggaatatccacaaaccatgagataatcctatcgtgttcgacattagcggggtctttggctttgaaaacccaatctcgccctaaatgtaggaaaagaagagcgttggccaaaaggctctgtgacgtccttatcatgcaaccccaaccggcgtcagaggtgaagcctatttcgttaaaatcaaattgaccacgtagtaaggctcccagcgtaaacgtgggggaatccttgtctctagctatcggagggaatccggctctataagtcagccaaatcttggaataaacatcatcaatgaacgattgcgaataggtagtggattttttgtttccatctttaatgctgtccagtacctgctggaaacggctattcaagtccagatccttcccctctgtttcttgagtctttataggatcatattgtctgcccaaaacatgtattttgttttgatcatcgttggggtgtgtaccaagtcctaaaaacctgtacatctttgaaattccttcaagatttcaaaaccagctaatgaaattagaaggaccagccaggaagacagaactgttgttttagctgataactgtgatcgatcaaatctggctctagcgatggggcgctctgtgggcttatggtgatgatgttgcctctcacaatttcgcagagcgataagaaacaatcagatggtgtaaagatgtactcaaacatgtgtgcctggccttttggggtccttagcttagaggttttaacagacgagtactccctgacataatggccaagagacataaaaatatggccaaaagggctgccgctgcccggctagagaagaaaaagggcaaaggctccagtttcggcaagaagaagagtgacggtcaaaggaaaaagtctcactctttgggaggcgatgactccgatgcagagttcgaagagctctacaacgtcaatagggcttcacaaagacccagcaagaataaaactttggccaatgctgccaaaaggggtaagagaccccgaatgattgatgaagtgggatttaccaatagaaatattgccgatactatgaagaagcagttgaggaataatccaattgaatttgtcaagagtaaggatgtttttgatccttcagcagatttgataaagagattgaacgagagcaagaagaaaaaagaggcactagaggagaggttagaccaagaaaatgatgaaatttatgtggaagatttcgaaacggttaatgagtcagaagttatcagatctgatgaggaggatgaggaggatgaggaggaggaagacgagcaggaaagggaactggtggaaagcaatgaggaggagcagtctgaaacgtttcaagaaagtaacaaagaaactgattctagctcagctctggaagaatcggattctccagcatccgaagaacctctattttatgtggatgacactccgaatataggcgattggccaaaacagaccattgttcctccatcacagctacccaatcctccatctccattatccatcgacgttcaacgttttgatgaggacgattcgtctgacgaccaatatgtcaccgttggaaatgtcatgatgaaggtaaatatggatgatggagaaatgtacgtcaatgccccatccggattactggagcagtctgaaaatgaagtagaagaatctgatccagaagaaaaagtttttatatcacaagctcccaaagcaacgcagaaagaagataaacccaaaacaaagtcttcaccgtcatacccagagtttggatttctcgccgaagactacgatatgtttgatgtttcaaccatcgttgtatccaatattcggcaaagttacaaaagcactcaatatgaagttcaatccgaaagattactaggtataagtcaagctcaatggttagaagaagattttttggttgatatgttgatcgagtatggattgctggatcatcgtgttgatgcctatttagactacatcaagaaaccatttttgaaagaactctctcctgaacctgactatccaattgatgattctgatgacgaagacagtgaggatgattttgaaatggagaacattgaggatttggttgctctgcaaaagaacaaaatgatgaatgacgtcggatttgagaccgacatgtttacacaaactatacagtttagaggaaaaggtaaaaacagaaggccaatccttgatcatattcacgatgaagatttgaaactagaactgctggagaaatttggactccaaaacagcaaaccagcaagacaaaagggtaaaaaggctgagggtttgtgtgaaaagtatccccacttgttgcatatcaatgagatcaaagaagaatttgaacatttttatcatgacagcagcatgacaacattgcgtttccctcctttggatccccatggcataaggacacttctcaaactggcagatcattaccagatgaaaggccgtaaattccttaaaggaaagcggcagcatgtcacagtcataaagacaaaacggacaaattatctaagccccgagtacgacatgatcggcagacttctcaggcaacgaagggtctttaacagaatcgatgtcagcaagaaagatttctcggaggacaaactgataaaaagtggttcaaaatcacacgttaaggaaggagagattgttgggtccagggctcccgaaattggacaagataatattggtagaaggatgctggagaagttaggatggagcaaaggtgaaggtttaggtttggacagtaggggagtcactgagccaatcctggccaaaatcaaaaagtctaggttgggattgagaaaagaatgatcttacattgtgttccaacgactgtatccccccatgcatttagctctctgtctgactgattcaccatgcacatttgcctctctaatgattgcttcttcatccaaggtcaacaactccttgtctttgaccaccagtctaccatcaatgatcacattctcaacatcattaccagtagcaatgtagactatcattgaaactgggtctctcatgggttgggcatataacttgttggccaggttgatggagatgaagtcagcttttttgccaatctccaatgaacctaactggtcttctttaccgattgctctcgctccgacaatcgttgccatttccactatttgttcggccggaagaatggttgggtttttgtgaaccgcttttggtaacagagaagccaacttcatttcttgtaataagtccatagtgttattacagggacatccgtcgcaacctagacctactggaattcctgattctactagttctttaactctagcaattccagaacccaatttggcgttggaggctgggcagtgagccacggaagcccccgtattttttagaatctcgatatcgccgtcgtctaaatggaccatgtgggccaaaacggtacgagattttagaagccccaggtctttgcaataactcatgggagtgtggcccttggaggcaaagaataccctgtctgcttcgatttcggcgcagtgcattgtgattccaatacccttttcctcggacaccttcaccattcgacgataaagatcttcggtgacgccgccgggggttctggcaccgaaccagacctccaccctgccttcagcagagccattgaagcggtcaaacatttggaccgctctttccagagaagtttcgtcttcaatgaggccttcgtgcatgcttataccctcctgggttgcgtatctaggttggtccatgacgactttccccacgcagcctctgataccagattcggcgacagccgtgacggcgccttcgaatccgtatctttcagcaaaaagagcttcaacgaaggtagtggtcccagactttagcatttcggcaatggtcagtttggaagccacataaccatcttcttcggtgaagcatccctgcattttccacactctgtcacagagccaatcgataagaggtaaatcgtctcccgcagtgcggagaagagattgagcaagatgaacgtgcaaagatatcaggcctggcatcacaatctgacccttcaaatcgattgtctcttgaccgttatgcctagagataagatcggcggatttacccatgtcaagaatgaactgtccgtccaccaggatggccccgtcctcaataatatcacggttcgcattgacggtgaccaaagtagcgtgaatgaagagcattttttgaacgattactgaacgtataagacttatttattaggttttagagagaaaaataagacaaaaaatccttatgggagctagtgaaggagaggaagaaaacatgcaaaaggcgtcaatacgcagcattttattgcacctttttgtttgacttgactcgcacaattgcgtacctgaatatcggagctcttggtagattgttcgtcatgctcctcctatcaatgctagtacttgatttgataagataacgataaagaaaaaaaagtgaactttaagtgccgtcctgaaaggagaggtccatgaaggtctataaactcgggtatcaggttatcaggggaaagggacagcgagtgcagcatacccagaaccccatttcggtattccctgtcctagaatgcaccacgctgtttgccaatgctatcaaattgtattgttgaaattgtgcaagcagttatctggtttgcattgcaaataatcatgagatcgaatttgtctattcacctaatctacatacattttttggtttcgggcagatccgaactcaatttcattcgcgtaattccgtgatccaacccaactttatccgagtattagttgactaactctgcactagcgtttctttttagatttattcttcttcttggcttggttgggggaggccacatgattagtatccctgatgtgctggaatagtttgtttctgcttgggaaagccatggagcaagtcgcacaattctctgtagatggattgggtagacgaggatttgcttggtctaaggatggtggggaggtattattggtagcagctgttgcagtattgctggttgactttttcttgccatttttcttttttttctgtgatttacctgaccaatccagatcactgtcatcttcgtctaatccagcccatagagggttggctttatcattcgttagtagagtgacgtcctcatggaggttggcctggttatcctgttctggtttgagttcttgcggagcttcgtaatcagattgggggtcagaatcactactaagaactttctcttcttgagacttctcttgggattgtctttcagagttttcttgggactctttttctctattctcctttagagttgcttcatccagttttctctccagctcctcaagttccatatcgtccatgtcatcgataaagtccagttcactaagtgaatccaaagactcctcagcagtcacaaactcctctggtgatagttcaacggcaacataagactcttcgtcgatgcccagttctatgccttcttccctcatttgcgacttaaggtctttcaatgccttcttatgcttctttgaagactcatgggttaagaattgattttctgtcctaaatatcttgttacagataacacattcaaactcgttgaactcattttcgtcttcctcttcagtgggatcgttatggatcttttccagcaaccgttcaatctctgccagttcttcattattcagcttctcccaatcctgctcaatatactcagagttctcgttgttcctattctggacatactgcttcctcaacgtatcgtttcgcttcttcttttgctcagcttcatatttggcgattcctggtttgacacgaggatcccttcgttttatgaatcttgtgagattgcgaatactttcattatactcctttctagcctggtctctgtactttttgttctctttttctatcgctcttctagtttttctatcgtatgtcgaggagtacttgtactcgtccacccatgaaaatgatttactggtttggaagtttgcccaatgttggtagaacagcctgacgacatgttcataagacgcagaacttccgccaaactgcggagcactgtccaacttctcttcagctgcaagcttagagtacaatccgttgatcattccgtatgccttggaaaaatccgagtataatgcagggttaaaatatttcataatgtcttgagaagtagtaccagcatactcaaattcggcagcctgaggaaacccaacatcggcattgtccatctctgacaaaatctgagtcctatgcgaatcgtaccacgatctttcgtgcggatcactcaacacctcgtaggctgacttgatctcattaaatttctgtgttgcctcgttaacgttatcaggattcttatcgggatgatgtttcagcgccatcttacgatatgaacgcttcagatccgactcagtgcaatcctgactcacctgaaggagttcatagtagcatgtcttcatattaattgcatacgacaatcccctactccaccgttcaacctactctggattcacagaaaaaaaaaaaagattctgataactctggtacacctctacaccaaccgatcagacgatgtcagaggtagtctgacgtacgtttacccacatcgcatgaaaattttgtgattggaggagctcggtctgatccggcagcaaaattatggtgcttttttcttttcttccccccccttcaaaaaggaacgatagatcaagaggggataggcgctaggactgacagcaagagttccaagtcagaatctgatgcaatagatagcatgtttcttttgatcccccatatgcggttgtttccccatctgtcggcgctttttcccacgcttcttcaaaccctacaggcaaagcccatcgcgttactagcaccctctgctagtaaaataccgtcctcagtgtagcaccctctcaaccgtatgctttatcttgcaggttgaataaattgcaaaccgttccaatctgttgccaaaccagcttaaacccttttgcagaggcctactgtctataaatacttcatcaacagcaccagtatcgatcataatcgacaacttcgagttttccacactaaaaatggaaaaagtatcatcaaatttgagaagggtgaagaccaagttcacaaccaaagagggtttgattggggactacaactattcccaattattcatccctaagatcccaatctattcagactggaagcaaagaaaatcgggccagatgatctctacccaacctttctttggtttaaatgacagtatgcctgttctgttaggagcaatcttgggtttacaacacgctctggccatgttagctggtatcatgactcctcccatcattatatctggtgtcgccaattttgacgttgacaccacccagtacttggtttctgcctctttgatcatctcgggtcttctttccatgatccaaattacccgtttccacttctacaagactccttactacctcggtacgggtctgatttccatggtgggtacctcctttgcaactattacgatcgtcaccaaggctatcccaatgatgtatgtgaacggtcaatgtcccactgctgaggacggcacattactaccttgtcccgatggatacggatctctgttgggaactgctgcttgttgctctctgctggaaatcaccctttcattcatgcctccaaaagttctgcaacgggttttcccacctttggtcacaggtcctgtcgttttgcttattggtacccacttagttgagtctggtatgatgaacttggttggtggttgtggtgaaggaaacgtctgtgttgttggtagtcattcggctccatggggttctgctcagtttattggtcttggtttccttgtctacgtcactattgtcatttgtgaaaaatggggttctcctattatgaagtcatgtgccgttattatgggtctgttgatgggttgtatcgttgctgctgccactggttacttcagtcacgctggtattgacgctgcccccgctgtcactttcccatgggtgaaaactttcaaactcactgtttatggccctgcagtgctaccaatgttagctgttttcgtggttttaatgatggaggctattggtgatattactgcaacttgtgaggtctccagaaccaacgtcgaaggtaaggagtacgagtctagaattcaaggtggtgtccttgctgatggtctcaacggttgtctagctgccttgatgactatgactcctgtctctacattttctcagaacaacggtgttatttctatcaccaaatgtgcctcaagaactgttggttactggtgttgttttttcttaattattatgggtatctttgccaagtttgctgcagcattggtcgccattccaagaccagtcttaggtggtatgactacattcctgttcacaagtgtggccgtatctggtatcaagattatcgctactactcccttcaccagacgtgacagatttgtgttaactgcatctttgatgttcggtattgctgctgtattgattccagactggttctcctatgtctttacatatgacggtgacaacggtggtctgcaaggattctttgatgccattgtcttggtcatggaaactggttttgctgtgaccggattcctgggtgtcattcttaacttattcctaccacaagagctggacgacaacatgactgctgacatggacgtttacgagcaacagattgtcaccgacgatgttgctgtgtccagttcatctgaagacaacaagtccgccgatagaggcgacgtcaagcttaacacattcaaagccgaagcataaagataatatgtacccttatagctatagccatttacacttaataatcctgttttgataatacttatacatgcgcaactcttaatgaaagccatcaactgacaaactcgcaataagaggtcgaaaagtgggttaacacagactaacgtaatgccccaaactactgttactatccaaccaatcccgcaatagacacgtgaattggaagtaaagaaataaatcaaaaattatgagacccacactttcccgaaggaaagctggcatccccaagtgacaacgctgtgcaatgtaaatcactggaactggccatcaggacttcttgatctccgatgacgtctcgaggtaagtatgaagtctgaaaaattgcggacattccaggttttatagtacagtcggtcgtgtgatgattaatgcagttagctataaagatatttatagagggatgtcctgaaatttgaccagtctgaaggtaacttccccaacgtttcttagcaagagatggtggtgtttctccttattgagtaattggttcacttcgtgactcatgcagccaatcccggtgtgtttaccggttgccaagtttatggttcccgtagtgatgaagccgaccaaatacttagctcgtacgggtttttggtcgttattctccaaccaactctgccagtcatggctgggtacctgatatagtctggcattggtcgcaatgtgaccagtaccttcaatttccactgaaatcagcgttactggtagtttagggatttcatcacggataacaacgctgactttatcgatctttgtggggtcaaactgatattctcctttatacttaacgggaattggaagtatcttctcttcatctgcattctcaaactccgaatcttgcctttggacgtctctaacgcattcatatacatcctgtagctgtttgagacacctatggccaagagtggtccaattcgaaacatcaaacgatgaaggatccaggtgaacacattccttatgcacttttaatgcatattgaagaacttgtaagtacctccagtcactcacaaatggatcgcctagttccccaagtaactctccaggtaaattatgaattttcagcttactatagttcaaccgcttcccctttggtcgaagttcccatttcttctgaaactcttgtccttgaataaaagacgacaaaaatccgtggtaccagaaaggataatcaaaggggtaggtgggtcggttagtctctaggttcaactggtgcatctgacgaaggcctccgtatctgacttctgggaacctcatgagtttataccaaacaggcaaattccaataccaggggacaatcacttggtagtatccattctctaacttgctcaaatgaataggtaccagtggatcgtcggggtttcttggaagggtcttccctaagttgtccacattatcgttgttcacaatgatgttgcgcctgagatccaggtccttgagcgagggttgattcttgtaagacttgattcttccttgataggtaaataaatcttcaaagctcccagagtcaaatacttttccttctttgatagcaatgattaggtccaactcatcctctctaatattatgatggtatttgtgtggtttattgagatatctggggtcattgatatagaacgaaatggatgaacctgtggggaccattgagttatccctaaaagaacaaagttgtttccaattttcattattatcagccgttttcataactgcgcccaatgctgtcaaagcggcaggaccagtaacttgaaatgaggccaaactgtatctacaatcaaaaactgtgacatcttttggggatagcttgagaagcagtttgaaaaatgactcgtaaagggaaggatggactctcagtatacattgtttgacattaggcaaatcctgccagataatctgtgactggccaatgctgttattttcatgatatatgattccttcccagattttatgatttttgagaaacttgggtttaacagcttcattttttgtcaattgacctactaagtgaatcaaaggtgttagggacgtggagtgatgcaaaatgatggtgccgatgtaggaagtatcccaagcaatgcagtgtgaatgcaggtagtttctatgtgtagctctatagcatttctggcttggttgaagagcaatgttaaatccccacctcttgaccatatgggctcgtttagcatgccatacatgagttggtagccatttgaatttcttttgtctatttgagtatttcagagcatgtggtttgaacacggcaagttcgttaactgccgtgttatccattgatcctagtttgttgtttaaggattgctggtgaagtttgataaactttaaatgcatgttgtcataagtttgcacctcagcatctttggcattttggagctcagcgatatgggatctcactatccttaatttttccttcaagtcaattccagtaggcagatccagtggttttcccttactctttgctacagtagccagtttgagtagacgatgaagcctttttagcttatagagttcccttccccgactgtgtttgggttttttggagagaattgacccattatttgatgtcatctctctaatcattctgggacgcagtcttctgggaacccgtttaatattatgggaggcagttcgacgacgcatacttctaggtagactttggaagcatcttgtggaagagttcttttttgactttaattgtgccatttgaagctgattcacttcgaattccctacttttcaggaactcctcaacattcagtcgttcatctttaaaagaaggatcctgcaactcagttcgtatgatccgtgacttgtaaagtttacggcgcttatgctctgtcttactactcatagaagcgaccgttaatagcgtagaaagggctattagctctgcaataaacgtatgaaatatattgcaaaggaaaaattatctagacgcgaaaaaagtcttccccaaagatcaacctagaaggaggcccactacggtcgagattttgtattcagtaatcgtcatttcattatatcattatcctatcatatcgtatcagtaccaattaatatatcaaacctaaccagaggccccacaagtttaaacaccaaaatgctccattcattcaaagctgcaacacagatcctttttatcgcaatgtgtacatcgctcagagtcttctagtcgtgcgcacttgatcttcttggatcgacaattaagacaagacgatcgtcttgctggcagcagtggcggagttaccgacgagggtgccgtaagagtcgactttggagacaaagaggagctgctgctgtcgaagttagtcgacggaggaggggttgtttgtgctgttttggccctcttagcgacggagcactcttcatcagaggactccgatttgaacttgttgtacttgacaatatcgttcctcgtgaagcctttggagaaacagcatttcaaagttctgttgttacaagcagtacaagatctatacttgatgtacttctcatccctcgaagatttgatgttgaccaaagtcttcaggatggtgaacccgttgctcagctgaaacgtctggttatcctgtgtgttcttatcgaacatgagcttctcatctatactcaagtcctggtaatcagatatgattatctctgcatcacatttgactttcctcacgcgacaagcatcacacgatggtccacttctctgacgcctttttccccgcaaggaactaatcgacccaggggcatgtatagatcctggagaatttggcactgatggggtggattcaacgtcgtctccactgagggaagaagctcgggacgacgtagacgttagtgagttgttgcgaacgtctccaaacgaaaacgttggaagacttggcaaagatcgtcttccgatggactctagaccctgcgacatgggcggtgacaacgacccccgagaaagtgaatacgaatccaggaacgctgaactgttgtgttgcattgataaagagttctcagacatcagcctcgttggaaataatccagcagccaaacttctcaacggaggtaaagcattctgctccgaagaaggctgcaatgagggtagtttcataaattgagaggcggacatattagtgttctggcacaacaatgtccgagttggggaaaacgtttttttatttatatcaagtcaaataaactccaatcggttagagaatgactcctactagtctatttggggcaggaaaaaaaattactggttacaaccatctatataatataacgtgggggtaacggtgtttacattatccggggaaaaaaagcgagggtggagttaactgtattggggtgcggaagcacggatgaggggtgttcgggaaaacttaatccactaaatctgtcaatttcgtggggggaagagttatgcaacgaaagatttttggttcaaagtaacgatctaaccgtcaccaaggaaagtgcaacacttggctctattaggattaacagtgtgtcacttatgtgccactctaattttcgttttctcccagttggcggtaacccattaaaaccgcaccctgctatcactcacacacccctttcttttcgcatatgattaagggcaaattgctatagcctactccgagccgccgtaagcagcgcgcaaagaaaacgttctaggcagatttttcttttttaatcatggggtatacggccacacggcagggacctccggagcagcgcaagcggcctcccgatttgaggatttagccggggtggaccgaactttatttttagtactccaccaggttaacaccaagagtacggctgaacatggagacaaggtcatgtgtgctaatcaaactatttccgagtttttttatttggcagcttgtgccgcttcagcttgtgccgcttctttagccgcagttgcctcttgtgacttcttcttcgcaaagaagcttaaactaaatggtaataatgcattcatcgcgataatccatgcgaagagtaccccaatgttcaatccaatgtgcttcttggtagtcccaaagagtaccgtccttaagagttggaacccattgtagagaggcattgcttttccgtattggtaaaagccgggtgagagctctaacggtgcaaacgttggagccacattcacaatcacgaaccccaacattccaaatcctaccaggggtggataagttgcaaaagcataaagggccatattttcgttatagcctccagcagctgccatcgttaagtatgaaaacatccatgccactgcaattcccccatgagaccatcccctggaaaaatctacctgaaatgctacactaaccaacgtaaatgctaacgacagtactagaaatgatatctgagatgctatcattctgtagaggacaaaatgccatcgccttaaatcctgagatacctttgcatgtataggtccaaggaaattaaactggaagaaagacagaatgctgagataaattaatccaatttgctgtggtgcctgagtaactggcgcagtcactggtcgataatctatctttgtaaatgataatgattgactggctaatgtcgtatttgcagcaacctctaatgtctgatctggactgagactatttatgattggtccgtaaactccatcaccttgcatgctcagtacttcgacttccagtgcattgagcgacggcataacgtatgctccaaaaccagtcaaatctctgcctgattcgtaaatcaaatatattaggccctcattagtgaagctactgttcgccgtttcgaatgcttggcggatgttagctgtgctgtttctggtgacaagtatagcggcccagtatttctgtctgtgtacctcatgtatggcaaattcagttacgttagtgtactgtgaaggaatttcagcagaattcaggtatatccacgttccttttgcttgtagctctggggtttcacttgcttgaagtacagtatcggtcagtaagctttcatcgcctatttcgtcaccaataatgagaaatttgaggtttttcagtctggagtctctctcatatagtgaaccccagtagacggaaaatattcccatgacaaaaggtaccattaccagatataccagcgcaaaatgcacaaccatgtaggaccgagttttgcggaactcatcactgaagaatccaacttttctcgctctcgcagatatagtggacctgattgatgtggttatcctctccagttcagctggaacccaacttggttgcctgtgtattgatttgcaactgcctagggacttctcatcatcgtcgtcagtcagggaggactcaatctctttcaatttgttgctctctagatcacctggacctcttattctggatccaggaccactattctccgtcataacccttgttatttgagatcctcccagaagatcatcagaaaagaagtcctggtgggagtactgttttgtcagcttgccatattccacttcctggctgtcgatacttggattagtgagcacacttggacgtctttcaaataagcctctaatgctatttttccgacttctaggttttaaattggaattacttcttacgtttctctgaaattgacctatctcatcgacagtatcgttattttcatcgttttcgtcatcttgggaattctgtcccatgtaaggtcgcaccatactcgattgagtagtctcagtttctttcacttcattcttttcggtgctctcactcgtctctagcgagtgcaaggaatcatctgacatgtgttctctataaaactggatgaactaagtgaactactccggcttttatggcttttgagggcttatcgaaaagaatctcgccaacagtagtcatctcgcgatcagtataggagtcggtgagccgcggagaattatctgtcggccatccgaccaactcccgtggggaaatgcttcagccgcgggcgaccgtttatctacctactcatttacatctctattttgactatacaacccgacctaatgaccgttgaactcttcatgaagtttcctttgctgatcctgaagcttcgtcagtttcttacgtgcgcttttcgttacctcgttaccctgggcatccttgataggtaaaccattgtcatcccatgcggtgtacaaggaagcgtaatctccctgtttgaacatttcaaggggggacagcttggctttctctcttctctcgttctcctttgcctcttttagtttgatttgttgcaatttcttttgtaatttctcttgagcttggatctccttctcctcctgttgtctgataagttcttgcttttcagcttcagtgataaacttgatcagggcattctgaccattacgatcgtcaagaacgactcccaatttcagcaagtcaacgtctctgattttgtcagtggcatccaaaaagaccttgtaatcatccttactaatggcagattttcttacaaagtctcggaaagaactcaaagcctgaacaaatggcaaaacagtgtcttccctattggagccttggccatcttgttggtcctcattgatccatccaaggttgtctggtctattctgaaatccaagaacactcaatatcctggtaatgtaaaaagcagtttggagtaaaggttgaacacggatttctgtcccaatagcactgatgtaattattggattcttggattaagtctaataaagaccttaccacttgtggagttgataggttatcacagaatgaactataaacctttgcttgaacctcagacaatttggtcaacaaattcttctccgcaggcccaaatttcttggagataatttgaccacttgccagtttggagttgtaatcattgtttagtcctctgacgttgttgaaaaaattattgaaggtggcttctatggatcttacctcgttcagtaagctttccttgaagtccaattggttattccattgaacaagggcaaaacataatctaagctgtctggcactatatttggagagagcttcatcaattgtaataaagttcttcaacgacttactcatcttctggccttcaatgtgcaaatggcctgtgtgcaagaaatagttgacccattgcttgcaatcaaacctggcttcactttgagccaactcgttgtcatggtgtgggaatgccaaatcaattcccccagaatgaatatccattgattcgcccgtaatgtcagaagccataacagagcattcaatatgccatcctggccttccttgcccccatggagatttccaagatggttcaccaggtttggaacttttccacaaagcaaaatcagcagagttccttttaccatcattgctagaaagagagccttcgccctcttttagcaactccaagtctgctttgttccaaggctgaagcttggcataatcgtgtttctcattagtgtcgaattgagtggtgtcaaagtagacagatccatccttggtaacgtaggcataccctctatcaataattccctgaacaaattcaacaatttcaggtacatactcggatactctagtcgtaacagtagctggtaaaatgttcaaacgttccatatcttcatcatatctctgttcccaataggaagaagtctgtttgaagatctctggatctgtcacggtagatccatacaatttatccagctccggcacaacaacatccttgatattttctaaatattcattcaaatcagaacttgttttcagtgccttttttgcagcagtgatatgcataggaattttgggattgtccactgccttttcagcaatgtttaaggattgagcccaactttcaaagtttgaagaatcacccttgaaatctgtcagattcttagcaacatagctgttccagctccctaacgcaaactgcttcagctcattggttatctctgaatactttttcgaaaactctttgaataaatattcctgtctagctttcagtataatcttgtcgtcaatatcagtgacattctgaacaaacttgatattataaccaaaaaagtcctgcaaaatacgacgattgatatcaatcgtgacgtagtttctagcgtgacccatgtgggaggaatcgtagactgtaggaccacaactgtaccacgtcacctcattggcgtttgtgggaataaaaggtacctttgtccttgtcaaagagttgaataatttaaggacgggccgttccaccttttgggtaggctgattccatgctggttgagacatttgtgtgtggaaatttcttattatataaaaagtgtttctcttccagggtctaatgttcatggaaacaaagtgagtgatcagacagtttgttttttttagccggctggtctggcctttgggcggaggctttagatggccaactggaaggacctgcgcggaggaaaagttgttcatctctcccgttctcctaaacatatcgcgcctggatccccgtgtagttaattattcaccctcagggaaccaagtccggttactgaactgacctagccatgtaagttttaacctcaattcctctattcaatgctctttgactctaacagaaaggtcttcaatttataaattggccatacagggagtgcggtcttttgaccctcacactccggagacaattcagttcagcaagcctttaacattaatagttggacagaacgggtctgggaagacaaccatcatcgagtgcttgaagtatgcaaccactggagatttgccgcccaattctaaaggaggtgcctttgttcacgatcccaagatcgccggagataaccaagttaaagcgcaggtcaaattggcatttcagaacataagtggagtgagtatgattctgacgaaaactttacaggtcgtacaaaaacccggcaagtctttgcaatttaaaactttagagaatcaattgtctgtgataaacaacggagaaaggacacgagtgtcgcaaaaagccgcggagattgaatcgttaatccctaattacttgggtgtatctaaagcggtgctgaactatgtcattttttgccatcaggaggaaaatttatggccaatttctgaaccaatggcactgaaaaagaaatttgatgagatttttgattctgtcaagtttatcaaggtgttggaggggtttaaaggcatcacaaaagatatgagtgtcgatatcaaactactcacaaataatgtggaacatttgaaaaatgacaagaaaagggccgacttgaagcgggcggaaatggaggctctgcagaacactgttgaggattacaacgctgaaattattgatctgaatacccaagtcgaggaagtcactagaaagttagatgagttattcaaatcaaatcaagattttgaaaaagtcttatcaaagttagattttctggctacagaaaagcagagtactcaacaacagattgataggcttttcagttctctgacagtgctacctgatagcacagaaatcttggagaataacctgtcgaattacggcaaacttttgaccgaaaaaagagtcaaggttaatgagcaaattcaactcgcaaaagaagcctcagaatctttaaacgctctgagagacgaatacagtgatactattaaaaaggaaggagaacttagaggtttagaaagtacctataaaaattatattcaggaaagaatacaactaatccaagaaaatgcgtctctacttggtatgactatctccgaaaccacgattagttcagatgagattgaagaagcctcctccaaggcatcggtcctcttttccacctgtaaaaagaaacttgatctacaaacagaacactatgacacccgtattcacgatcttaacttggaaataggacaggccgaaagtaaacttggaaaggaagaagaaagatcatcctatttgaaaaatgacatcaacagtctgaagaaacgaaatcaggctcttcaaaaaagcatcaatgatatcaattcgaacgagtctgagtttaacgaaactaaagaagatatcgagaggctgactaaacagcttgaggatcttaggtcagaaaacaaactggcatcaattaataacgatctgaagcaaaatcaagataaaattcttgttctggaaaacgagttggaccagattaataaacaaataataactagtaaccgacaaggtgaagtattggcaaagttacacttactcaaggagaataccaaaaaaggaaactcatcgatttcaaaattggttgaaagctatggtgaacagtttaaagagttcactggtgaagatcttaaccccgaagactgcttacctgtgtttctggaggttctgaaaaaacgccaggaagatactgatttaaagaggaaagaagttgcatcattcaagcagaacgaatacgagagtaatcatgataggtctttattagaaaagaaactggagcaaagtagaagtcagcttcaggaatgtcgtagtcgaattgtatcgattcttgaagatgaaccaatagaggagtacgaatcgatagtcaaagacttggaatcagattacgagattgctttgcaaaattctaaattgaattgggccaccaaaaactttaacgaaacagcactaaagattgccaaagagcatcagtattgtattttgtgtaagagagagctcaatcatgacgaacttggaccagtaatggtaaccatttcagaaaatattgaaaaagccaacgacgacctttattctaaagagaaagatagaatcaagcaagatctggatgacttgaagagtatcagggatgatattagcaattttaggaacttagaaggttcgattgcttcagctaatgacgagttgaatgagttgaagacttttgtttctgatgacttggcaagagtaagttcagaactcgaacagcttgaaagtgatttagtctccctggaatctctacgaaaacacgtagttgaaattagcaaacttcaagaggatttgagtcattattatgttgaaaacaagtccattgaatctgaattgagtgcgtatggtgttccagctaagactttatctgaacttcaggaggatttgaatggtaaaaactttcaattgaaagaattgagaaggcaagctgatgatcttaaagaacaaagagagttttcaaatcgagagttaagcatgcttgaaggcaatgtgaaggataaacgtctattgattagcaattttgagaaatcgttaatgattaaacttaatttggagaagggaattgatgagaataaggctagaatagacgaacttcaacaaacgggagaaactgtacttgaatccatgaaactgaccaaagacagattgaataagcttaaggacaacgtgaaaactcttgaagaggaaagagattctactttaactcaattgcaaagcaacgtggaacagttcaaaacagtacaggatagcttggtgcgattaaactctttcgtcaacaagtacgagcttgaagatgagccaattttgaggcaatgcgaaaagaatagtgaacacctgaaagcctccatcaaagatgcagagggtcagttgaacaaacttcatgaaaaagtcaatgtgctggaaaagcagctaagcgaagcagataccgaagaacgaaacattaaattcaacctggatctaagaagcctaaacaaggagctcgttcagatcgaagagagtattgaatcccttgatcggcagaacgcaactagtaaaaggcaggagtttcaaaaagaaaccgccattcttagagaaagttattcccggttaagttccgctcatagtagtaagatgggggaagtgtcccaattgcagaaacagattcagagcataacagaggaaatcaagagggattatgaacatgtcgaagatgaatactaccaagaatacttgaaactgcaaactaaaatgttcatttcaaatgatatctcggtttattccaagggattggacaatgctgtaatgaagtatcattccattaaaatggaggagattaatagaattattgacgaactttggaagagaacgtacagtgggacagatgttgacacaatcatgatcaaaagtgacatgaatactcaagttaaaggcaatagatcttacaattacagggtagtcatgatgaaagaagatgtggaattggatatgagaggaagatgttcggcaggccagaaagtactcgcaagcattatcatcagactagcattggctgaatgttttggagttgggtgtggcatgatagcacttgatgaaccaacgacaaaccttgatgaagagaatattgaaagtcttgccaaggcactcaattcaatcattcatctaagaatgtctcaaaagaactttcaactaattgtcattactcacgatgaacacttcttaagacacatgaatgctacagagttttgtgatcatttttttagaatcagcagaaacgagaggcaaaaatctcagatatcaatggtaaagaactttgattaaagttgatcaagatttgctaaggaggatagagacggaatgtttcccattattcgacattcaagattcaacatttcaaatctcaaacttcctaatgggaaaataatttttctcagagacgatcatttaggtctaggaccagaaatggcaacgaacataacttggcaattaacattaattcgccgtggcaaatgtctcttgtactttttgattaaagagaagaagaaatattttgcgggaggaaaaatatatatatactactattcgcgattacaggagggtaatgccctataatctaatgttactcctcatgcccttaccatgatagatcaattgaagcttgaaagattgtaaaccaaactcgacaacggcctgcgcgtcgaccttgagttcaccgttcacagctttccttaaaatatcagctcctattccggaagttgcatatcggataggaattcgaggagttgtgcttactcccggtgggatgataagactctgttctctcccaatatatcctaatacagtgccttcataagaggctttggcgttctgtatcaagacaaatgcttcagagttagatattggattgtagactgtaaattctatctcggatgacatgagatgcatcgttgaatctaggataaaaccagattggtaatctgggtttgatgataggattttgtgttcttcgtagacaatttgtggaattggtaatgtcactgataaatttttcaaaacttgagatagtaaaggtgaagtcggtatacttctatcgtggccttcaatggttactaatgtttcctcgccagataggtatccgctgaccaattgttcgagtttctctattggggatacatctgatgatgggatattgtcaattgtgtatcgattcggatcaatgtcaaaaagcgcagaagctgagaaccaggagcttcctgaactttcaatgttctcaaataaggagaggtggcctagtgtcgattcattgtatgcaagttgtaaatccagatcaatattcacgaggttgaatccactggcgaaagggtttagtatgtctgcatctaccagcaataaaatggaatccttggtagttgagatgacgtcaatgttgagaaccgtgacattcaaatgatccagcacactgtcaatatccttcgaaggtccggccaattcgatcggaagttgtacttcaaggtctgaaagctcgagacgctgttcggatactggaatatgtgcttgaatccctaaagttgcatcaacatcaacagtctgcgagtgattgttcaaatatttttggatcatatgagaaattgtttctggggaaagtatgtcaatcagactatccttgattatcccttggaaataaaggacgtcttcactaacagtggtagaactatcctgccattcttcgatgtacaccttcgcaatgcttttgtgggcttgtgaaacatcaaatgaggatgtaaatccggatatattcaggctggataaatttgtgtaagctggtaaagtcacgtcaccataaaactttgcatttatatgtggttgggaatctgaatctattgaatggattccaatctctttgagttgcagagtagtgtttaaagagtccaagtctggagtaaacttttttaataggggggaaataatgcgggagtcgaatggtaaaacgagtccttcaagtactgactgaagccattctggaatatcctcgttttctgtgttagttgaaccgcagaagtagattaacgattttgcaccgcgtaaatagtcgacgactaactcatttaatggcgaaatattggtagacgggcaatttgaggttaacctagaatccagctcactgatcgttaaagtggaaccaaccatcaattcctcgtaaggtttcaggaacacctgatccatcgacaaattagcaagaggtacaagttcttcttcttcacaatcccaaatcctgatttgaaaggaagcatgaggaatcgatgcttttaatgggtattttaatggactaaaagttgccaatgtttcaacctgataggaccccaattggtcggagattgatatctggtcaatcttcatatactcctccaaatcaccatcggaagtgtcaaaggacaacgttaaatcacgagtaacactgaaatttcccacatgaagtgacagtgtagccatgttaaggtttccacttgttcgtgcggtaaaaaaaatctcatcaggatgactgtgattactccataaactgagtatatcttttcccaattggttgatcggatgctcaaaaatatcaacggattgttcgatggcaatgtcatttatctttttatctgtcaagtcaatcacagtctcgggtaattgcaagtttgaaatacgatgaaattggtatttatcagacttcgtatccccaagcttcaaaaaaacgtcaaagacactgggattacagacctttactgtgccaactaatgtgctcatcaaaatggtatatagacgataatacgaattattgatcatgttgtaatcaaagaacagcgaccctttgaaggatatcttaatacccttatcagtgaattcctcaagtgtaacatgctgaaagtttacgaccatagcttcctgataaaaactgcttcccttagtagcaaacaaccacagatgaaacccaaaaaatgccagaaaagcaaaacctaccgcaaagctgtaaggatttctagctatacagtgtttcaccgaattgaaccatctgatcaggagtgggggacttttcgtcgtgtcttcctctgcacttcgttcatgttggcgcagcaatggagtgttctcatcttggtaattctgcgactctaactgaggcccattcattactctttttcttagtgtgagaccagtgatgtggtcaagcagcagcagggctcttacgagataagcaaaccacaaatataccaattccatttgcgattacctaatacatccttacatcggcatcgcttcgcgtcaaagcttttatctatggtgaatagaatgcggttaaattataagtagtattattatggataataaataaaatctgggtacaacattgccacaatcatagtttcgactgggcaacaattgtgttttcgtcgtgaaaagtctcgagtggaacgacaggttgaacggcttgggtaagagccatcgatcccttccacgatccaatatgagtaatcaaagaccctgtaggataaccctttggaacaggttcaaccaacatctcatagacatagtcaataaatggctgcaattcagtttctttgggtagcaattctctgaaatcatcattggtgagcaacttctcgatatcttttctatccttgaattcttcatctttatgagtcgtcaaaatagcttccacgtcttcaacagaaactttgatctcgttctgagatagatagttgagaacagacgagttcacaagtttgaatggtgtttgaggcgaaggcgattgagccttcaagttcactatcagttttggtgccttttcatttatgatgtgttgacggtagaaatcaatgacatcctgcttagaaaactgcttcagatacttcacgctagtttcatgggctaaaaagtcgtaagtgccaatggttatttcattccagaatctgctatactcttcacccaaattctttagtttttgtaaattctttgaaatcaaggcatcgacgtgctctttaaactcctcttctgagatagcaagcaagtagctgtcaactttcttgagaaactcgtaaattctgtattccaagtaatcggtagttctctcactttgtaccaagatacggaatccacaagtagttctggtttttctgactccgctgaaaacaacatagcccaactgttcattcgtacgtaatctgttgaagcagggctcatgaactatttgggaaaacagtgccaacaagttgtataatcttacatcttgtgcatgttcaccaacctgaataaaataatcggtgcaagagttggtgttgttcttatcgggaagctcatggtcgaatctgtatgtttggtttgttggtaacaaaacagatctgtttgttttaacatctgattcagccaagacatcgatagctttgttcaacctgtgaattttttctttaaaatgagttccaatctcaaaagcttgtgatctctcaaagttcccgtgaaccagaatctcagaataaagctcattgtacatggtaggaataaagtttacgagcttaccgtaagtaatttccgtttctaggcatttcatggtctcctcgttcaggtaggtcttgtcattcaataaagttgaaccatactggcttataatttggaatggggggtaatagtggaaatttttgagttgtctgatggttttctcccggatcacattgtatctttcttgagtgggagtaaagtctataattttatcaataatggtatccaaaaacttgaccagtttgtcgttataaccttctactttaagtcgtagccctgtggtcgtagaatctaacgtaaatctaaggccaacgatggctgcatcgtaggcaatgtcgttcaaaaagtcttcaaccaaagcagtgtatagggtggtcagcgaatagttcaaaacggacacttgagtgattggtaattgcagttttattgtcactgatcctttgggaacccaaaattggtcatccttcttgaaccagatacgagaatttggagaatctttgatcaattttggtgtctttaaaggctcatcgacatcaaactttctaacctcaaaattttttggtatgaactcatttgcaatgggtaagtgtaattcaggatgcaactccactattttcaaagaatctaaaaaatttggatcaaatggaatcacgctgtacgcagtcccataccatttctcacgaagaggtaaatcggactcctcaaattctggcgctactaccattattctaaagttgtcaggtgttaaatatgtaagaaaatcagagattaacttgtcatcccattctctcaaaacagaattatccaaaatgttttccattggaatgtaatcatctttctgtaactgtctggaaagggatgagacggtggaggctgctctagctttttgtctgaatttgaagttcatgtaactgacgtctttcagttcttcgaatatccacctttgagggcctgtttggcgtagaagttcgatatactggaaaattaaataaatgatctcctcgtagcgtgatagcccttgaggtgtaagatcaatttcaatgagaaaagtgctgtagtctttggatatgttaaccgctccactggaaaggtcggtagcccagccttttgtctttaatagttcgaataaagaacctttactttcatgcccgattagatgggagaaatatctttgaggtttgaacccccagtgttcagcttgatctggtattggaaacgcaatttccagaactcttttatccataacaggtttagccttgatcacaattcccaactctttcgaagtgtagggaggatcagggaaataaggcctggaagcttcggaattggcaatcgcagagaacttggagacggtccaactggtcaaagtatccagatcttctttccccagtacaaccaatctcatgatgttggcagagtagtacgcatcatgaaatttcagtagctcgtctctaacatccatattctgagattgagggatatcctgcagagtctgtatgttaccggtgctgaagttattgtaaggatgttttagagaggtgatagatttatcaagttgatgcaatctccaatcgtcattctgtaagtttttcttattttcactatccacggcttggatttctctgtctttgcaactcttggaaaataggggagaaatgaaaaactgagcaaatctgtccagagcgccctctaggaagttggcatcgatctcaaaatgatagtttgtatcctgcgaagaggtgtatgcatttgaacggcctgaatgtgaagataaataggaagagtactcattctcttgagggtatttttctgtacccatgaagagcagatgctcacaaaaatgggcgagtccgggcagatcttttggatcataaaagttcccaacgttcacatccagagaggcagcggctttatccgtagttggatcatgaatcagcaatgctctaagtttattggggagttcgatgactctgtatgaacgatcatccagatcaggtttgacgacgttttctgttaagatctgatacgtcatacttgaagataatgaatgcttgggtctggctatgggacctgtgttagtaatgaaggacgggtttgaaagggaggcgaaacaaatgtccaacctacaaggtgagaactcatggcccaaccgaactttgcaccccccggggcggaacgattactcatagggtgagctgacaatacttacttcggttgaatatgaagctgaaattcggacggaagttttgcaagaggaaccgtgcttttctagatacatccatgagaatggatctgaaggtggagtaagttagtggggaacacaggcgttgcagagctgatggagtaaaaaggttggcaggtgcaatattacgcgggagaaaaaagctggcaaagaccgggcggacaccagaaagtaccagcggctaggctgtgaattcaaaaggtgaagtgattgacttcaatggtaatgaatggtaataaatcaggctaattacgttttacgatgaatcagcggagaccgaacagggacatgaggagtttaggaggccgacttcacctgctaataagtattgtccggctatttatgcggcggtcagttatactgagcgggacgaaatgtggatgcggggccgtggatgttggatgagacgaaaggacgcgaaaggggaaaagaaaggtgtgtttcctttgagggacggcctgtgaaaatatgatgattatatatatgatgaaatagaattggaactggtaaagagagtgcttatctgatatttgggattttaaagtagccataagagacggttgtaaataaatttgactttttgaattattactttaacccctattggagttgagagaatttaaaagatgaaccccatttaaaattgttgccattttatttgaatgtctgaactattttcttcctaaagcaactggcacatattatatataactacatactaacatattcttttttcaaaaccaaatcaatcctctctcataagtaatgtggacagtaacctgtttcagtgttcccgagattagtttaatttcttttccattttgaactttaacaaaacattgttctactgtgtatttgtatcaacctttgaacgaataaaactcgctctcaagtcttgatttaccaagtagaatacatctccgcctagctctgactctccgcaagttgaccctccatgttcagggcctggtcgcgggtgtcttgacagatttttgcgccgtctgttaggattgctgccatcgcgattctcaagatctagatccccattcagtgagcaacttaaccgaaagatagaatcttaggaaaggcaggcctagtcccttgccaacattgtcacactctactaaggtcacattctactaacttttgttcccatcttttgctcctgcctatgctcccctcgtctttctacccatcactatttcctccctcacctgcagaagtctcatcggcttgatgcaatcaatagtttatgcacgacctttccacctgcaatggccatatctggaccagtctgacctataaatagtcaaacccgcgaaaactgaaaaataacaacagccaatttctctaacaaggttctctcttcctcacatctactcataccagctaggtttaatactgaaagaatgcagtttactttcgcttctacctctgttgttgtctcactgattgctgctctcgctaagcctgctgttgccactccaccggcttgcctgttggcctgtgctgccgaggttgttaaggaatcatccgactgtgatgccttgaacaacattcaatgtatctgtgagaatgaaggatcagccattcatgcctgcttggagtcaacctgtcccgatggattgtcgtccactgctttgcagtcttttgaagatgtttgcgagagtgtcggcactgaagctaaccttgatgagagctcttcatctcagtcctcatcatcgtcttcttcttcggagtcatcatcgtcttccgtgtcatcatcatcctcttccgcatcttcttcttccgagacttcctcttccgtgacttcctcttccgtgacttcctcttccactgcagtctcttccagcaccgaatcctcttcatccgttgagccatcgacttcccactcttcttcccactcttcgtctgaagtctcctcaactgtcgcaccaaccaccagtgttgcaccaactaccagttccatcactacttccagtacttctttgacatcagctactacttccagtgtgactatttctatcgagccaactagcgacgctgctgacaaggttatcatcccaggtttggctggtctagtcggtgctttggctgttggtctgatctagacattatgtacgaaaaatagtttgaacttttataccaagaaatcaaatgtgatttgcagttttatgagcagtgatcgtagaaattagtgtttacatattgtttatttgcgaagtcagcagatgaaccctgaaagtgaaacatatcatgattatcaaaaatatctagctcgtagtgttatttgggtcaaatatttcatcaaccgacaaaacatactttgtaacacacatccggccttccaatctatctattcccatagcttaccattgaatcagtgtgctaacttttcacctgttgctccatcgattacataatataatttaaaacgtataacttctcgccctcaaactgcatacaaatcaaccttacataaacacctccgtccccaccaacaacaatggataaaaacatccaaaggggcctgaatgacaggctttacgaaaagagaaaagccgccgctttggaattggagaaattgatcaaagacctgataaaagccggcgattctaacaagatcaatgaaattatctcgaagttatctagagactttgcctacgctgttcaccagccaaactcaagaaatggaggtctcattggattggctgctaccgcaattgccttgggacagcatgaagtaccaaaatatttagagaagatcattcaccccgttttggcgtgttttggtgatcaggatgcaagggttcgttattatgcctgtgaatctctatacaacatatccaaagtcgccaagggtgaaatcttgctgtatttcaacgaaatttttgataatctgtgcaaattgactgctgattcagaagtcagtgtcaagaaaggtgctgatttactggaccgcctcatcaaagacatcgtggctgaaaaggcaaccacctacgtgtctgtcttgaacgtcaaaaaaccggaggattacaaggagttaaagtccactgtggaaaaacctaatggaaagacaatccaagttaatgagccccaatctccattggctttttcgcttcccaagttcatcattttactaaaggaaagaatttacgtaatgaacccctacgttcgtatgtttctggtttcttggatcagacttttagattctatatcagatttagatttgatttactatcttccgacttttttgagtggcttgatccagtttttaagtgatggacatgatgatgtcaaagttgctacccacagtttgcttgatctactgctccaagagatcgaaaacatcaatgagataaaaaaaatactgcaagaatcaaagaaagaaaataccactaataagctaactttagacaatgaaagtggctcctcagttaaagttgaccatccgatccagcgtattgtcgaaggaaactatatacatggtcaagatattaatctggattttccagagatcattcacattctaatatcccacttagattcatccaaggaggaaatacaaattgttgttctgtcttggttagccacgctactaaaaatatcacccttgagttttatacccctgatacctgatattctgagcattttactgtcaattgttgcccatgagggaacgtcaagagagagtgcaatacaactgaacttggagcttatgaaattaatcgaagggcatgagattgagggtgatgataaaagtttgaatatttcccaaattgttaaagtcttgactttgaattccttgaacgacaaagaacagactcgactagcagccttggactggttaataatgttgaatgacaaatgcttcgaagaagttctttccaacaataatgaaaccatatccgtgcatttgcttcgagctatgagtgatcccagtgaaaaggttattgataaagttttacaactgctggcgaacattgccaacagaggaaacgataaatattttgaatcatttatgatagacctactgcagcttttcaaaagtgatagacttctcttagaaagtagaggtaactttatattaagaaccctttgtatctctcttaacccagagatgatatacagttcattggcaaaagttttagagaatgagccggatcttgggttcatatcgattatggtgcaaatgttgaacaataatttaatcactgctcctgaattgaccaagttgaggcacaatctgaacctaaaaagtaatatgaacgaaagcgaagaagattggaacctttttaaaaggttgttcaagagctggtctcacaatccaccagcgttactttcattatgtatgctatgtcaatcttatcagctggctttcggcattttggaaacatttacagaaaacgaactaaccgttagtttgatggtccagattgacatactagttcagttactagaaagtccagtgtttgcaaaactgagaatgcagctattgtcaccggagtcaaatccttatctctacagatgcctctatgggatattgatgttgctaccccaatctaccgcatttcacacgctgaaaactcgtctggatagcgtttcaaatatcaacaaccttcctataccttccaatagaagaaacagtgaagcaaaaatcgagagccgaatagaagagaaacttgaactattagaaattttcaagtccattcaacaaaaacacgaagaatatcggctatctgaactaaacaaaaaggcacccagagattatgaccttggccaactatcaaaactttctttgaaccctgctagtcctaagacggaagaatttagtgataagtcaggaattggatcaaataaatctgacaaaacatccaaaaaacagagtaccttggtaagaaaaatttcaagtcggccatttggaattggattcaataataacgataaagattgaagtatagtgtttatgctgtccgaaactaccttaatttttcgggctcataatactttttatgattactgatggacttggttttcttggctagtgctttactgttaaagtattgctctttgaggtatgctgtcttttcaaggttttgaatttgtttttgggtaaggttacccatcgttctgggatcagcaacggcaactgttcttacgtcatcattcaaatagctcaaatgtccaagattttgtctgtagtaccgctgtaaggatctatggccaagtctgattcctgtaggcaacaccagttcataaccagatgattctatggtagctacagtatattgttcatcttggatatcctggtcaagctctctatcggaattatcttccgatctctcaggttcagcaaaagagacggatcttgttgcaccttttttctcaacagaatcttgttcgaaagtatagaatttaccaaagaatcttctatcctcctttgattcatatggtagtgaacaatgacctttcaccttcacatgttgtctgataccttgcaagtttcttccggtaaagtcgcaatgcaaacacttattctccaccgatatcttgaagctcaggtaatctaacaatccctccaaatcacttaaatatgatcgctcaggtatgtacagtccatggcttttaaacatatggaccaaattcttttcaacgttgacattatcaataccacaataaagacaggcagaatgaggtatcatttcttccaaaatctctttatcagacagtagctcctcttcaaaatctctttcggcaggcgaactgtcactatagccttcctcgtcgcttgtatagtatgagttataatcttgctctgacagtagggccgattctgaatcagcgatgtggatggactctccaagcgtgaaatctgaaacttgagagacgactgttccaattgggctagcttccctcacagaaagggagacaggcgttctatcattcctgcccctcagtctctccaaggcagctcttttcttcatttcctttttcgtcatttgaggttgactattagggttcttgaatcttctatgaattgcaaacccgtcctcatcttcattttgccgctcagattcttcattgcggtttataatgaacttttcagcaaaaacatctgaaggaatgggaggcaataaggcgactcttctcttcaggttataccgatgccaatctgtcttcatatgtagcctttgcaggtcagccgtggggaatttgatactacatgaaatgcaagtaaagaaagaagtttggggattctgtgcatgggataactcactcataacgagacaatattccaacaataactggattaagtcggagattgagtcagatagtgggattgcagacgtatcgagaagatatctataattcgttctgttacgtaatcaatgatgtctatgctatatagatgccagtgttgacctcttaggccacattcttttgtacaatgccatggcgatggtgtcctgtgcgttaagcttaccgtcaaaggttgccttaaaatagccatgcgttccgagactttccttgattataccagcacgacccatctttgtaaatagtgggatagctttgaaccagttaatatcctcagggttgaaaaacatgtaacggacagtaaccaatctcttgtgcatcttaaacggctcacctgtaagaacaattcttttggcaagaacacggctgtgatcacaattgaggaaagtaccttgtcccagcagttcaatttggccttcagggccttccttgaaaaagattgcaggtgtcgatggaaacatcacgggtgcaatggcagtagccactgctaccgattctttatgcaaaaatctttcatacttgtggacattgttactgttgttcgaagccgcactgaatactggttctataacttgtcttctgaaaccatactgaacaatcatggtgtcctttgatgggatgggcttatcatattcttcccaagcttgaatgctaaagttggatacggctaatttgtgttcatgttctaaaagtgcatagatagtaaaggtattcgtttcgacatttggaatcttagaaacaacgtcttccggtgcgttgatatacaatcgtaccaacgtgccagccctcacttccgcttcattgatggcctctttgagaattctgttctttgtagctgtgaaatttgagatccttagtaatctgtgccagtcttcaggcttcaaatcatctttttcatcgtaatcccaatcacaatttgccaatgatttgacacctctgtatctttctagagttttctttgcgcttacattcggaagtagttcaaattcgtcagggaactctagatcttgtctttctctttccttatatgtctgcagctgtcttgcttcctcttcagcatctagctcttcaaattgctcttggtccacttcatcaatgtcaatatctacctccatttgttgctccccctctacctcgtcagaagagagctgttcatcaacttcagtaatttcatcaagttgatcattcaaataccatctcgattgaaactcggataaactttttggcatattgacaggcacactgtctttatctctggcatcttcgaagtactcatacccatccaagcgaacaccaagttcgggacctttttcttcttccgataccacatcctgcatatcttcatcctccaggttggggtcttcaggagagatctcttctaaattttcttgagattcgggagatggatagaaattttgttgttctgacatttcctgatcttctgtctgtttcctacctggttttggtaaaacttcaatatggtctagttgaaaatcccctaacccaggaagatgcactaatctattactgttgaaaccaacacctctgacagttccttccaccaccaacgacccgttgtgataatctagtctgttggccaacaaataacctctagaatctctccaagtaattgacttggggaatttttgacacaaagttctcatggcattcaaagattcggtaacagcctccagattgaaaaccttatcttgtgtcggaaagaagtgcttgatataggaattcaatgatctcaagacatcttgttgaaaatttttcttaggataagctgtgaccaagtttgacacgactggaagcaccgaagcaataccttgcaattcaattgccctgattatttgttctccaaactcagggctaacttcttcagtagcagaaaggcccagtacaatgaaatctgaaactttacaagcatccagcactgaaaggaagttggacatgtctggcaaaacaaatttaatattcgatttaaaacgttcaattctgaaggagttgatgctgggctggtctgtgattttcaaatcctgagagtttgctgtggagtcattaagagatactaacagcaaattggcaatatcgacgccatcaatatcatctgccaatgccaagatggtgacaactttctctgcaccattggagccagcaaacaattgtctttccaaagacgtctgaaggattttattttgtcgtaactgttgagcaatattctttctctcctgtttggttgttatcttgagtttcttattagttcctgtctccgatttctcaactttacccttgtaacttgccttcaaggagccctttgaggcatgtctcgacttgaagggcttatggttattcttaagagtggacctatgggaatgaccagccattgcttaggagaaattgtataattaaagtacactgtaggtctaaaattttcagatcctttaatacataattttttttttctcatctccctaagctcatcacgtgtaatataccgaaagtaagccgtatgtcatgtgcacaattccacggaaaggatgccaaatacatcccatcatcactaggtttgagccctagaatgacacgtgagatacagagtttttttttcccactgttcgcgcaaactggactgggttcctggagtcaatttgttcgttcctattcacttcgtacaccaaaaacatcaaagagatcaattattgtaagtttgaaccaccatgatattttaactggagtggagaggctgatgtattggatgtttatgtgaagccaaacaacaggtcacaccaaagaaattcaaaattcatgttgaaagggaaactatcaagaccatcagagagtaccagttgaaaaaaaaaaaatcctgcaaactcaagccagctcattcacttcagtaaaatcctaaaggacgcctactaacattactagcatcatggctcacgaatcagtttggttttcacacccaagaaactacggaaagggttctagacagtgccgtgtctgtgcctctcaccaaggtttaatccgtaagtacggcctgaacatctgccgtcaatgctttagagagagagccaacgacattggattccacaagtaccgttaaacaaattttaggtccttttcaaaaattcacatgtataatttaatctgaaattatctatcttttatttcctcaaatcgagagtcgatttgtgcctgttggcgaatgtattccagagtccgttggaagtgtttcgttggagtatcgatgcttgtattctcctcaccgattgtcaggatactgttttggatgagttcaatcaagccattgagatacttgatggtgatgagttcgttgccatgtatgaaaaagtaaagagatctacttagaatctccacaaacagttccagtgagacatttgtctccaagcaggagtctgctatccgaagggacttttgcaggcattctagaactttcttgttatcagttttaatcacaacctgcagttcatcctcactagttttggctgtctctgactctatctcgtcttcctcatccagctcttcgataatccaccacaaatgactagccagataaactgcacggcattgatctgtctttttcagtagcttggaaccatagagcgcagtcttgctgatcaaagcatcaaaattgtcttcattaccattaacaatgtttctgcacttatggagggtgccgatgatacttagtagacactggaactgcaatctagaatccacaatagactcttcgtaaatgacaaaactgtttataaaaaattcataagatagatcgatatgtgacgattgatccaatatcaaagccatcgaaaggttcaagttcatacaagtttgagccaacactcctccctcagattgtaaagttccattagagactaacgtcaataactctgtgttcgttgccgagaagaattggcagaattgtttcaatttcaaagcattcaacttctgtacgatggttagtttgcgaatcaacttaataacagcaaacagcaacgttgggtaggtgtacctgactcttgatccagactttgacataaacgactttgcaatttctagtaattcaaaatgcttgtagggattggtgtgatgaatcagatgtatcgatttggctagcgcctcatattgtgatacaacttcaggagattcatcgggttcattcttgctgctatctgttccaaaaagaagagagttagtgttagaatcagatgagtcctcggaagtgaaccacacagccaaaagctcgtaaagcgtctttacttcttctaccgttgatagtctcacatcctgttccaaaaacttctccaggatgtacaatgcattggcgctttgtattgctgttggaagggcactagcaaactgtttataattgtcatccagcgacagtaccaacttggggtcaaagttgtaacatattggggtcttcaataaaggttcccaaatctctaaatgctgggtcgtctggtggatcaatgcaagggcaaaaccaaaaactttgttgatgttttcataatcttggggatagtaactaagagacagtttacaaattgcctccaatattaaactcagatctttgaagtttagctcaggtttgttttctactaacaggtgagaataatcgtaaaacttctcaaaaagattagagctagtttgtggttttgtcgtctcggaatcactctcctcagtatggttctcttcgtgctcatccttttggagggttagtgttgataactcacttatgataactttgacattagctggttctcgtttctgaaagtcaattagacgatttatcagagtaaccaagatcttgttcatactaaaaccttcactgaggtgcaaggttgattgtaagaagtcgtctaaggtgagaagatggaactcatcaggaaatacttggataatcacatccagaagatactcttgagccaaggaatctttacattgaacaatttgctccaagacttttggtaaaatcgattctttgtaatagaacttgtcgatttggtccaactgcgaaatacgaaccagattggatcctaccaaaatctgcaattcttttctctctttcaaccttctttcacgttcactggaatggccttggtgcttgagacgaacccatagcttgttcatttcgataaagttggtaattgtaaactgaattgtctccttcagttcactttctgtttctgttggcaacagctccttagtcttctgagacagataatatctcaaaaacaatcctctaattggatcctgaacaccggcagacatctccagcatgtctttcatgatttctagcttcggagcattttcaattgacatgtacaccgacccaatcgtgatcattaagtatagacgtggaacaatattccctgcgtattgtactagctcatacaaatcggccaaatggttggtttgatgagattctttgaggaagtcagacaaataagctagaccgtcaaacaccaacacatacaattcgtagtagagtttggggctcaacttgttagtacgtaattccgataggaacgtggaggcatgtttcaaagcgtccataaattgtgggtttttgctctcaagacattttctcatcaaggtaatctgctgcttgacgattagcaaagaatcctccaatgttttggaatcaagagcttgattcatcagggatttttggttggagatacagtggatggtggaatacagggtggtatttattcgaggatgatatggggagacagagttcgggaggaaaagttcgggcggagctgctcgctcaagtaggagggtgacgtagaagggcactaacgagcgactctttttccttctgtatgccctcaatctatgaatagaaaccctttattcactgcttacagagacactgatgaactggtacagctgaaggaatggtttttcaaccagaaagaggtagataataggaaaagagccattgctaaagtgaagagcttgaaaacaagaaggcatgttgctcactcacttgatatgacatctctcttaacaggtataatcctaaacgatgaatcaggattagtggacagtgacactcttattctcagttacactatggctgtaataaaatttgttaacgggaccttagattctttgcaacaagctagccatgccattccactacatgcactagcgagggagttggatattccttcttactttgtggagactagacatgctggttcccatgagcatttgccgtcactacaaatgctgcggatggtgggtaagaacattatggactggctttggaatcattactggtgtgaaattaggcctgtatcggaacagctaactctgaaagaccttgaagattttaggccagcgagagattttgattatatcaattgggcccctgaagactttgaggagttaatcagaaatgaactaaagacattcaagagaattagaaaggtggatatcagtaatagaagagccgataagccagatacaactgaatataagaaaactgtatcgtctcttataaacttgcaaacacaggagccccaattgttcttggatgtatttcaagatgaaatattgtcactgcataaaactttaactgattcaatgctcaaaggtcttttaattcttagtaaacctttaatcgaagaactaggtttggaattttttcacaatctgattttaagattgtcagaattactcaattcctcacattcagatttcgttaaacagtggatacagaatttactgacttgcgatttcaaatctccaggtattttcaccaccacatccattgatcagataatcagcattctcaaacgagaaaatttaccacataacatagacttactcaaggcattaaaaagttccaaaaacctagaaaataatcaattgtctacaaacaagctggaaaaattaatcaatgtcatggcgagattccaactaccttctgcctcagctccagcaaaaagatcgatagttgacatttctaaagacattcaatatcggaggaaaaagaaacggaaacctttcaaaatacctgatgataccatcaagacaccgatatggtccccgatcaaagactggtacccaactccctttggcgtcgccccgtaacacctggtatcaccaattgatcttcagaaacctctagaaaaccctatggcacaggatgagctgagttacccgcacttaattttttttttctcttttgctcactaatataaatagggcgaggaattctcaatgaaaaaaaactattccgttttgcaagtgaaaggagaacgagtctttttgtcacttaatgttttaaagttaaggctttaaatggtaagtttttttccatactcttcagtttcatggacacaaatggattacaatgatgagacaaagtatctttcccagtccgatcgaccttgacgacatggtggaaaaccgtcgagttttgacgaattgggtagcacctttacgttgaaacgctaagacttttatacttgccagtatcataacacttctgattcaataatccatttgcagaaaattctatctttagaatgttgttctaacagtttctagacaaaattcaatggttctacctgatctatcaatggtactcaaaagcttacatgatgaaatctatttctatacattcgcagtttcctcggtagcatacgcacaagaacccatctttgtatgccggtgaccgccacatagaccttccatggatgtctgatttgtcttttgagttaaattgatgccataaataggtatgtaggaatgattcatgattactagctatgtttgtttgtattacacaccgcctgcctctctataccatctaacagactggtccaatcctaccaacaccaatccttcattgcggtcatctccgtctatttgacgtattcccttgccaaagtatttcaaggacaaacagccaatgttagaattgctgttaagatcatctgtcaacttatcatcaggcaaatcagttaaagccatagtaattgttgcctccacttctctggtcgtgacgtcccatattctaactttctggtccatccctccactagcaagaaatgatccatcttggttgaaatccagggaaaaacaccatctttcatgggcaaatccggctccaattgcgtggttactattggttggtgcaatcaaagaccccgccatctctccaaatttcacgtcataaagggatatggttccatatgattcactgtctgatgcaacggctagcaacgtcccaccaggtgagaatttaacacaacgaacagctgacgattcactcttgatggcagttgatgtaaaagtatacgacgacctcagggttcggaaatcgtataatgaaacagttccattcatgtatccaatggcaatttttgaatcctcagtagaactaacgtctatggaaagtgcaaaagttcgattcaaatcctcaagagtcttttcatgttgcaaggaaaattttccctcttcaaccgtgagttcatatacttcagcgctaccgttatgttgagtggtcaacaatctatgtttctgatcttctacaccgacgtggaatttcagtgcccagttgttttttttcaattcacaatttaaaggaaccagttcattgtctatatactggaacaagtacaggataccagagaatgcaacggttcctatgatcaaaatgccgtcattttcccagaaatctacatggtgtaaccctaaactgtcaactaatatatcgttgactggttcctcctctcctttatgagaccatgtttttatgtgaccgtctccagaaacggacacggtaaatttgctgcaaacggcaacgtcatagacatcagatttgtgccctctgatgatttgagtggaaatgaattgttttcccattagatctatgggccttgtgtctgtaaaggggaacaagcttcgcacaatattttctcttctagatatcttgcccccttcgcgaactctcccgcccgtagctggagcttttgcattatcttattgtcctgtgatgacttgacctgtccccccatctaatactacaatggtttccattgagattccgcgtactattgagtccgaaggaaccaccttatatgtcattgaatgcacactggaaaataaccgtattacacagacacgacgaaggttctccgagtttttggccttaaagacgaacctacttcgattatacaatacaagttctttcccgttccaattgccatccaaaaccttgtttaaggttaccgatgagacaaaagaaaagagaagagtccaactgagcaactttttaaacgatctagtgcagaaagaggaatggagagataatatctatgtcagagagtttctaagccttccaaacagctacttcaagaggttgcgtaataatcaaaatgttaacttctctctggggaaaaaacgaagtatcgcaaactcttctgaatggctgcaattggcaaatgaggtcagaacattaatccaaactggccgcactcagctgtttgccaaacaaactcttgaggctagaatgatcctcgtaggcttacaaagtaaacttcaaagtttagatccaattccacaggatagtttaggcgctggcgagttgagcaagagaaagaacatgcttgttggattcaaaagagattattcggaactaaactcgcttctaaatgaactaagtcgttcaagccctcaagaagaatccaaacctcgattgtttaacactcgccgtgttttaggaggtccagaaccagaaactgatagcacgagacctttggaaaacaacgaactactacagagtcagcaaatgataatgcaaacacaagatcaaaaaatcgaagaattgagaagtgcaatccagcgtcaaagagagctgggcactataatcaaccaggaaataggtgagcagaatgaactcatagacgaattggatgatcagctcgacgtaagcaccgacaagatgaacattgcaagacaaaaggtgtcaaaggttctacggtgaaaacgaagattgaatctgtccataataataactccataataaatatcccaaatcgtaataatatttcataaatatcttagcattgatatggtggaggagctacccttattggtaagttgccgttgttgatgtgattgctgtcatgaaaaatgtttgtgttgaaaaacttggtaggggagccaggcattggaggcatactaaagtccacaacgtcatacttgagaagctctcttaatctttcctttcttctccctattaaaccaatgtcatcaataggttttactttcctgtgtttttcttggctgctgttttgaatgattgtctccactgacatgtcaggttttagatcaactgcttgaagtttggggaattctgtatttggtgcctcttgctcaacctccgtactctcagttagcgtagaaacgtcagaagccccatcgttgaagatagagccttgagagtaaacagatctcctatacaaagactctgattcaacttgtttgcatttttctttgctcttatccttatcaccaagacatacaactcttctgtggggtttgtcattgttcttcgaattcttccaaaatattctagactggagattcttaattgagtgaatgttttgggcaatatcggcaactttgtcagccttgagctgaaacttgttgtatgtctttggaatcaactcgttaaaataattcttcgtaataatgtctggattcagtttgtctgcactgatcttgcctcccaaagttaaagtctgtcttgaagaactaagtgttgtcaaacgcataagtgaacctggggagatgataagtggagcttctggatctatgtcctgtaaagtaactctgttctctgtatttctttctggatgctgggtatgcaataactctctatggaaatcggcaaaattttctgtggtgtatttctgagagaatttgtacaaaactgagggaaggaattccttgaaaagctcggatatttgggtttctattttgttctgtaggaacctggctaacggtttaattctatcgaaagtggaactcacagaaattgattccaatggatcatttttgaacaccaaagttaaacctttacttcttgagaacacaataatgataatcgaggacagcttgatctgagacagtttcaagttcaaaggaatctctaaaatgtctgtagccattacaaaacgtggtttgatgaattcacctagctcacgttgatcatcttcaaactggtccaacagattatcttcatagatttttagcggattagcttgaacttttgtacgcaacgttatggaagcgtctccgtcgtaattgaacttgaagatgcctctgaaactatcactcgacagatcaccaatttccagtatttcgaaatcaggggggatcgtgccaaaactcaggtcttctatttggatgtcagtacaaagaacgtttggacgtttaccggaattcaaggcatcgtttaataactctgcagtccaagcgctcaacgactctttttgaatagaatcccaattaatattgaacgacattcggatctaaattcagggacgtgcaagttggggtaaatctggggaaggggtcgtttgtttgtcttttatatatttttttttgctctccctttttccttgttcagatccgggtggtcagacgacggcttaatgggacgcaggcgatacgcgaatcacctatttttgccttagtaggaaaatcgttcgcgacccatttcttatcgaaaccgcccgcaataatgattacatgtacatccgccatccatggctgactgcgtgtattcactaggaattctgggttccattttccatcccaaagctatcgagtctactttccacatttgtactggcctgctgtgttccttccaagataagctaaccactgcgtcccaccggaaaatgagtggagaaaagaaagatgtgctaatgacagacgtgaacgaactcactcagtctgcgtctgtaatgaatatcgacgatgacggcaccactgcctcgccatcttcttatggggacacttcgaaacccgaaagaagaaaatcaacgttgatatttacagacgatgttgagtctccagtcaagatggatagtggagataacgagaatgaatatggcttgacaaatgctacgaacgagaacgtttttactgattcttctgtcagtccccaggattctgaagatgcaaaccgccagcagcagcagttacagccacaagaagggaaaacctccagtcagcatcatcatcaccaccatcaccaccaccatcatagtaatcaagatacttccagctcaatttctccagaagacccccaacttgttgctatagaattgaggtggtctcaaggtgggcagaaagtatttgtcactggttccttcacaggctggagaaagatgatcgctttacacggaccggccaaagatggctctttttctttaaaactcaagctgccatttggtactcatagattcagatttatcgtagacaatgagttgcggttcagtgacttcctcccaactgctaccgaccaagctggtaactttgtcaactacttagaaattacacccgaccaattctctgaaaagaatcggtctcaaaaatcactccgtactctagactccaaactaggtttaacccaggatgatgacgacatgggaaacggttataccagatatcacgacgagcaagaacagccacaaactgccaagaaagaatacatcacaggtatacctgctatttttacagatcctaaggtaatggaacaatactatttaactctagacaatcaacagggtaaccacaaccaacaacaatggttgattcctccacaactacccccacatttagagaatgtcatactgaataacttctccaacgataaggagaacaactctggatcccttcccattcccaaccacgtggttttgaaccatcttgcgaccacgagtatcaaacataatactttggcggtggcttcagtggttaggtatcagaggaagtatgccacccagattctctacgctcctcttcagtaggataaatagggttcaagagaatcttccatagagcgagcccctagcgaatgtttaccggcctagcccagatttaggtttccacgcgcttgctgcgagatctctcccgtacgcgcctctggctctgctccccttacaaaaacgtaaatacatctagcattgtacatacaaacaaaaatacccgtgatactcagcgtattaattcttcagtttacccttcacagtgtttgactgcagttgaatactgccattctaactatgaagccgcacaccagagattcatctatcacggttgcagtccgtgttcgtccattcacagaagctgaacggcctttcttggttcaaaatcaagatgagaatgatctctttttgggaggaggttcattggcccaggcatcttctagaaagtcagatgtctacgagagagaatcgatggctaaatttttccccaaaggaatcagaaaagtcgttgatgtggtcgacgatcgaatgttgatatttgatccaaatgagtccaatccactgaaccaaatacccttaaataacctatcgtcaaggagagccagaatacgggaacacagatttatatttgataggttgtttgacgaggacaccacccagaagacagtttacgaaaacaccaccaggcctctgctagatagcatcttggatggattcaacgcaaccgtttttgcatatggagccaccggctgtggtaaaacacacacaattactggaactttggaagatccgggtgtgattttcctcactatgcaagagttatttcaaagaattgaagatctatccaacgataaaatcatcgaactcaatctcagttatctggaaatttacaatgaaaccatcagagacttgttgaacccctctatggatcaaagaaaactaatactacgagaagatgaacagaagcgaattatcgtatccaatttgtcaacgcatcatcccgtctctgttgacgaagtaatggatatgatagtgaaaggaaacgcaaatagaacaatctctccaacagaggctaatttgacatcgtctcgttcacacgcagtacttcaaatcaatctaatgatcaaaaacaaaacccctgacataaatgagaatcacatgtattcaactttatcattgattgatctagcaggaagtgaaagagctgctgctaccaaaaatagaggtataagactgcacgaaggagcaaatatcaataaatcattgctttcattggggaactgtattaatgcattatgtgatcctagaagacgaaatcacgttccatacagagattcaaagctaacaagattgctaaagttctcccttggtggaaactgcaaaactgtcatgattgtctgtatatcaccgtcttcgggtcactatgatgagacgttaaacacattaaaatatgccaatagagctaaagaaatcaagactaaactaattcgaaatcagcataatttaaccaggcacgttggatcctatttgaagatgatcacagagcaaaagcaggagataatggatttaaaatctagagagtctagggttgtggagaatgcacttttgaaacgagaaaacgtagtaagttcttgtcaagaagagttttccaaaattttgcaaggactgaagcactctttggcatcaaaatccaatattctattgaatagggcatacttattaggatcgcgtcaactatggcagctttattccaaagcgatagaatcatttttggagaacttggagtccatcggcactgattgggaccatttggtttctgggttttcagaaatggttcggcttgtgcaatcgttgtcagcaaaggtgaacaaattaattgaagataattacaaagcattgcacagcgaaacagagatcgaacacattacaactgccagttgtcaactggaactaaaaaggcttgccgaattagacggatggactgactttcatacgacacaattcaataatcaagttgccttacttaaagaatctttcgaaagggaggaaaacattctatcccagacagtttttgagttgtgtttaccacaattaaaaaggcttccgctgatggaatccgacatatttccgtcccttcattttcttttaaaacttgtacaagagatagagagtgaagaggtgcaaaagaagttggactcattggtaagaagattttcggatacaatttcagaagctttgcagtatgagttgagtttcactgttgataaatccaaccttcccctgccagcaagttgggtatttgagggcgagagcatttcgtatggttcaacgcagtctactcaaccattaagagcaacacctcctcgtatgaaattgagcaaagaaaaacaatacagcttctctcccaagacaccgctttggaaaaggtggttcaattcaccaattaagaaacctcaaagactaaagggaaagaaagtccgatggagcatgccctacactaacgaaaatatacatgaagacggggagaaggattttaacgaagatgatgaagagcaacagcatatggaaaccagtcttgaagattcagacgtagacatggataaatttgttgacgctatggatatttcaccgttgccagatgccgcagattcgtcattttctacggttaaagcttccagacagagttcactaaccacaagaaaactaattccgtccaaacaaagtaagagccttctaagctctttgaagaacgctgaagctcaaccagatgaaacagaaatagttccacccttaggtgcaccctcacgaatgaatttggtagaacctaatatggtgcttgaagataataataaatagatcaatcaactcaccgaacaaatgattatataattgggctctcctttcctgctagcccttgcacttcccttccctagtaaatacatccgagagcatccttcgcgaataccttccaacacataaacagtacactactccgccgaaaaagacacgttggagcgactagcttaaaatactctccaccgccaaatcctccctcaacggatctccaacaatggttactattaacgatcaggggtatatcaccgttaacgatagggtgctaaagctcataaagagccttttgatcgtgcttattttcataagcataacaattgcagcagtttcatcacgattgttctcagtgattcggtttgagtcaattatccatgaattcgacccatggttcaactttagagccacaaagtatttggttcacaatggattttacaagttcttgaactggtttgatgacaagacttggtatcctctaggacgagtcactggtgggactctttatccaggtttgatggtcactagtgccgtcattcacaacctgttggccaagatcggacttccaattgatattagaaacatctgtgtcatgttagctcctgctttcagttcattgactgccattgctatgtactttttgaccttggaactgaccaatgactctgaatccatcgccaatgggactgcaaaggcaactgccgctttgttcagtgcaattttcatgggaattactccaggttatatttctcgttcggtggcaggctcttatgataatgaagctatcgctatcactttgttgatggtgactttttacttctggattaaagctgttaaattaggatccattttttacagttccgtcactgctttgttttacttttacatggtcagtgcttggggtggatatgttttcatcacaaacctgattcctcttcacgtgtttgttctacttttgatgggaaggttcactcacaagatttacgtcagttatactacttggtacgtccttggaactcttatgagtatgcagatccccttcgtcggctttttgcccattcgttccaatgatcatatggctccattaggtgttttcggcctcatccaacttgttttgattggagatttcttcaaatctcaactgtcccgtaaagtttttatcaagctggcgattgcttctggtgtcgttattggtatcctaggtgttgttggcttggttcttgctactaaaattggtcttatcgctccatggaccggaagattctactcattatgggataccaattacgcaaagattcatattccaatcatcgcatcggtctctgaacatcaacctaccccatgggcttcatttttctttgatttaaacttcttgatttggttgtttccagtaggtgtgtggttctgtttccaagaattgactgatggagcagtgtttgtgatcatctactctgttcttgccagttactttgctggagtcatggttagactaatattgaccttagctccaattgtttgtgtatgtggtgctattgccattactaaacttttcgaagtgtattctgatttcacggacgttgtcaaaggcaaatcaggaaacttctttaccttattctccaagctggctgttttgggctcttttggattttatcttttcttttacgtcaagcactgcacatgggtcactgagaacgcgtactcatccccttcggttgttcttgcctctcacgcagcagatggttctcaaattttaatcgatgactatcgtgaagcatattactggcttcgtatgaatactccggaagatgccaaggtaatggcctggtgggattacggttatcaaatcggaggaatggctgatagaactacgtttgttgataacaatacctggaacaacacacacatagcaactgttggtaaggcaatggctgtatctgaagaaaaatcagaagtcatcatgagacaactcggagttgattacattttggtcattttcgggggtgttcttggatattctggcgatgacataaacaaattcttatggatggtcagaatttccgaaggtatctggcccgaggaagtcagcgaaagaggatactttacccccagaggagaatataaaattgatgacaatgcagctcaagccatgaaagactcaatgctgtacaagatgtcattttacagattcggtgaacttttcccctctggagatgccatagaccgtgtcagaggtcaaagattgagtcgctcttacgctgagtctatagatcttaacattgttgaagaagtattcacaagtgagaactggctggttcgtctttacaagctcaaagagccagacaacttgggaagaagcctactgaccctgaaggataacgagaaaaagttggccactaaaaaaggtcgcagattgagggtcaacaagaaaccctcattggatctacgggtgtagtgtagttgtgtattttagatagacagagctctggggttagaatgataacatattgcgtgcttatgtaatgatgttcacctttcgtaggtctcaaaagttagcctagtcttagcccgtaacttgctaatgactgcaccaaaacctcttcctacgctaaatgaagaccgccaatctgaattggtcaataatctgagccattgggcgctaggaaatggtttagcgatgtaccccaccaattttgagcttcataacactggctatgcaccagttaccctttttccaacaccatttccaagaggacaatttgagaaggcattggccgttcaggaagactttaatgagctctatgctcaggtagtcaaaaatcaggaatggctgggctcaattctggaggacttatctcaatttgatagggattttactggtaagttatgggaaatttacaaggaggccaagaagattggaattgttcaaccagtctcattgggcttgtttcgatccgattacatggtggatacgttatctgctccctcatttgatggtataaatggaaaaatcaaacaaattgaattcaacactgttagtgtatcctttggggggttatcacccaaggttgcccagcttcacaggtacttaaatgagaatggtaattaccacaatgagggtaagcttcattttgaagatgatgagcttccaaattctgaatcgacagtttctttggccgatggtttggcaaaagctgccgcgtattataatactagtgagtctgttgagtcctctgttgtgctagtggtagtgcaaaataatgaacgaaacgtttttgaccaaagggcccttgaattcgaactgttaaaacgtcataaagttagatctattcgattgcgcatggaagatatatctgcaagtattgatattgatgagcaaacgagaagaattcgactgaaaacgacgggggaagaagtttcagttatctattatcgttcagcttatgcaccaagtgattttagtaacttgcaaaactggcagacaaggctggaattggaggtgaccaaagctatcaaatgtccaagtgttctgacccagcttagcggttgtaaaaaagttcaacaaattctatctacaaaagaggcaatacagcagtttctacctacaaaaaatgaccaggacctgagtaccttatgcgatacattcgtcaaattgtacccactggacaactctgagcttggacaaaaggccaagaaacttgcttttgaaaaaccggagcagtttgttttgaaacctcagagagaaggtggaggtaataacatttacaaagaaaatattgttccctttctacagagtttaaatgagaaagattggcaaggctatatactcatggaactgattcgcccaccagcctcaaagaataagataatacgtgaggggaaaatatatgaggaagacattattagtgaattgggtgtgtttggaacattattgttcaatgaaaactcggggcaaatccttagcaatgaagtttcgggttggctattacgttccaagttcagctcctctaatgagggaggtgttgctgctgggtttggatgtgttgacagtgtttatctcttctaatcgattgcattgattaaagctctccctctagccttccccagtgctcttgtattcccaatatattgttccttggctatacgattttccaagctaactgcccataatgatgctcctgtcatattagaaaagatgaaaaacatactcagaaatggtatcgtttccagtaaccctgctactaatccgaaccctagatactcaccttttttgcttctgataactgcattgatctgtctcgtgtctaatcccttcaagtcaaaatatctttggtgagatttataacccttggagggcgcctggataattacgaccaatatgggacctatgactggtataaaattcagtccgactatcaacaaagacctgtatagccatatgggaaacaatatttgaatgggcactgtccagatggctttacggactctgacagggaaacttggtctcactatccgacgaagtttgcccctcagtactatttcatccaatccttcatttgtgagtattgcatcaaacatcatgttcaaaggcactggtaaaataagccacgtaaccatccagttggatatcaatgctcctatttgtagaacagcaaatatggccgttatcaaaccaattggcccattgaagaaaaatgaaaagacggcttgcaatggataaatggctatgaaaactatgacataaacgataaatgtcataatcaactgagggagtatcaacgagaatagatatgaccatagaacaggatggctgataaagtaagtgactcctaaaagaggatacataaaagtgccagaaaataccaatcgtagaggtatgacaataggacggaatgacaactcaagtagccttccattaaaggtgtcgagaatcatcctaaccttcgtattggcaactgatccttgtttgggctgcctcaactctttggggacattcaaatcctgaaagagttcagttttgctattcgacattgaaaagaaaatgatcaagacagaagcaaataacgtaatatcaattagtatagagatgcctattttctaaagacacaaatcgaaacgcaaaatcaacaatagagcggctggagctaaccgagccgcacgctaattttaacagcataccacctacgctttccttcctcctcttaagccaaagcacccattgggtcatagaacggtaggatctggtagtcaccactcttccatgttgaaactagttctgctggagcatacttagagcttgttacgatttggaacacgtattggtcgaaccattcgtcagtcatgatgaagtacccgtcgtggccaacatctgtaccccaagaattttcaactttccatctaacaggcttgccatcaataagatgaacgccagtgatgaccatggcatgagtcatttgcgaagagcctgttagaagacgtgctttcttgtcgatattcaaattggttccaaatccaagctcgtaatcccaggaatttacatccataagtcctagctttgtatcctcaaactttccaacgtctgacccgaagaagactggctcattctttttaatcatcttgatcagaatttccttgatagttggtagttcggcgttgacgtactcaataggctttcctccaagaacgttgttgagcttgtccacagtgtataacttgttgtagtcatttcttgggtcattgattactgagaaatactcagttgcgtccacacccaagatcttcttataaaatttctttggggtggtggtgatgctaagatagttgccgaacttgtctttgtagtcccaaacaatttcatcatcggcctttggtggaacaccaagagtcaatgctaaaatgctatagatctccttgatcatcgtctctttcacggaaagaatgttctctttagcgttcagggagttcataccttcggtgttgaccagttttctcaagatcaaagcaaactctctcagtttgttggtgatgatataattcaagcgagaagaggatgttgcactaaatgagtctgggtagatatcatggggaaccagcccatatttctccaccaaattaacaatcatatcccactgccctccgtcattgatgggaacgtccagtagaaattggttgagacgggagtcaagattttcacctgcactttcgataatgttgtgcaaaaagtaattcgatttttccagcttatcgtagaagaataagtaattctgactcaattcaaaagaatccaacgaaaacttggattttatttgactcttgaacacattggtgcttgcaaaaatccaacatcttccactggacttttggttggtaatgggccctcccgagaatttcacctcgtagttgaacaggttccgattggccttactgactgcttggttgttctcgataatatcagtaatattattacctgtgaagcagttaagcgccaattgattcttggggtcactgagcagttttgtttcccaaacatctaaattctcagcattaatcggattgttttgagcctcttgactaaccactggggtcttttcaacgagatcatactctcctttctcattgaacacttcgctagtggttgtgttcttactcagaaggcattggagtctttcaatcaattcttgattggatagctgctctggttcgttaaccacaggtttgaaggttctctttggtaaggttgaggtatttgcacccatgatcagggattattggttgtatgagggagataagaaagaaagaggtcttttaaggagacagataatggataagaccctgctggtcgcgggagaaggaggacatccaagtgagcgatcgcacaatacaatgtgagcagccgttagttggttcaaaattgtcttactatgctatttaatgatttcatctctacttggtcttttctttgagttcctgttccaacttcttcttgtgctcttctgatcgtctagcagcccttccttctttcgaacgtggtttcttcacccctgtagctttaccctttccagacatacctcttaccttgacacctttctcagcacgttgcccttcaatgactaaggatccaactaaagctctgtctttcttactgagcaccttttttgctcttcccatgatggttttatccttttcggataaattggtatgctctttgcctccaaaccacttgtcagctggcttggggatatttctgcaacgagagatacgcatggtacgtttctttggtttaacactggtggataattcttctccattcaacattagacacttgtctacctccagaaaatccttgaattgaaccatggcaaatcctttaccaaagttcgtcttggtgtctctaatgatacggacgttctctactttatcttggccaactttttctgtgaaatacttccataagctttcctcctcctcttcaaaatcaaggtttccaatgaaaatactcttcttgttgtcttgtggggacggatgagctacatggtccactctcaaatgatgatctttgaacactttgccgttgagttcttttgcttttttagaatcgttcttattctcgtaaacgacgtaggcattaagtgcagatctagtctcatcgaacgccttactcaaaaacgcatcccttcttggcattggaagcttaaaggcgatagatctgaatctaatcgactctactggtccaatcttggccatgtattctttaaattcctctttttcctctctctctatggctactatcactggtaagtttcccacaaacacagtacgttctgattgttcaaaagcagattctttcactgcattgggatccactcgttttatagctttcttccccttctttttgtcttcagatttttcagaagaatctttctcttttccattcaacttagctagatatctagtttccaggtcttcgtcctcatcttctttagatcctcgtttctgtttctttaatgctggttcagacttttcttcattgtcctcttccacatccgcagattcactctgcttggactccgtattgtttttgtcggctgtatccttcttgattttacgtttcggattgataatagctctctttcttactagaagagcattttgatctactgcactcggctgactgaacaacgagctaacgctggaatcaactgccgatggtgctccaaaaatatcctctagaacattggaggtctcattagccttctctttctctttcgtatccttagccatggcgtcaaagctggttatggagtatgcagacttggagctctgaaaaaattattacagagagggaaaaaaaaataattacgaagtgcgcgaatcaactagttcagatgtctgtcaagatgttactttatcaacccaattcctttttttgtcccttcctcatcacaaggttaccctcccaacaagatcacactgaggagttctgtttgcatatcaagttggttaccttactgcttcccaaacaccactctccctgtagtcgagattgaaacgatagtgtccttgagaaaggttattgatttggataggcttcgtttactggcagatcccctgagaaacttgcaattgacactgcccttcaatcactgatacgggttagtattatgaccacagttgttcaagacaagaacacagacaaatcaacagaggcggatattagtttgcctttgaccccagtgaagacacaaagagaagcgggcagcgtaagtgctattagtgattttagctccgctttaagtgacgttgatagttctgaagcagagactgatagaatggatatgtacgacgtggaacgcagtgaactgcgggagttggctgaggagaataaaaagcggaaggccaccgaagaagcggatgatatctccaaggagcaagaaagggcagagaaaagaccccgagttgacgaggagaagataattgacgaacctcccttgaaggaggagaaggaagagaaggaggagggaaagcagagggaagatcacacggagaagttaacagaaacgaaagatgaaaacacggtcgaagttaagtctgattatcaacagcaaaaccaacccagtgagcctgaagaagaaaactctcaagaacagagagaggttccaagtagtcgtgacaacaacaataacactctcacaaccatagaaactgtgggaactgttgatactgatggtacacttattacacataatggcaaagagccaaccacagcttccactgatattttggacgcgaatcatgttaaaggggatgacgataaggttgagaaacaggaacagcagcaacaacagcaggagtcacagcaagagcaaaatgatgagcataaacttgaatctgaaaataatgatgagccaaaaaacgaatatgagtcccacgatgatgaagatctaggtgaagaagaagacttggaagaggaggaagaagaggatgatggaaatgataagcccaattcgaatgatgatgctcaatctaatgaacaagaggagcaagaagagtcaaaaacagtagatgcagaagctatacagcaagaggctcttcgggatcaagctctctccagtctcaatgaattggaagtggattttgccaagttgaaggacatgatttatggtaaccagatgacaaagcttcagtatgagcttgaattatgtttgaaaggttcacatcctgaatttgttaatattgtggacaagatcaatcgaaactttgatgctaaacttaaccgattgatcatgacccaaaagtatcaattgcaatgtatcgataaccagaccaaagccacgcgactccagcttcaccaacagtacatgaaagatgctcaagatctcaaactgcgttccataagtaagacaacatccaagtggtacgagatcaacaaagaaagacgtcacttagataacgtcattttaggagtccctgattactaccagttcaaccctgacctggcctccgcagcaaagaagaatcagacagctttagtgcaagagttggcaaatcaaagacgtaatttccagcaagaactgggagtactgacagccttacaacaaaattatcgattcccaagctcgctaaatcatttaactgctgcacgagaagacgagatcgagagcgatctactacgaatgaaaaaatagatagtgggagtactttgtaaaattatacgtttgttgcatcgtttatttatttcagagcggcaaatctggcagcgttaccaacaccggccttaccgtgtctaactggagtgtaagtcatggagaactcacccaagtagtggcccaacatctctggcttgatctcaacggtgttgaaaatcttaccgttgtaaacaccgacaacagaaccaatcatctctgggacaacgatcatctttctcaaatgggtcttgacaacggctggcttctcgtttggtggagtggccaactttacaactctgagtttcttgaggaaacgttcttctctgtcacctagacctctggagaatcttcttctgacactggaagtgcacaactttccgaactcctcgttggacaacttgagaagggcctcaaggtcaatacctctgtatgagtaggacttgagaattctcttctttctctctgcgttaactggaagattcatgttagtataccggatacttgttgttcacgtagctaccacataagcaattggtgctttgtaattttgaacttaccttcagacatgttgtgtgtgtatgtgtgataacttcaacggcagtgacaaatttttgctactgaagttctgagacgagtgtggtgtatggatcagctcgatagattgaaaggtcgtgcacttgtatttcccccaatacttattgtgagtggtaaacatctttacaccgtgtgaaaaagtacggtttgccgtgctgaattttacgatttctctgtgacgttttgttaggattatgtaatcgagattcgatcgatggctccctccagcgggttggaggttcagcattgaaaaatcctcaaccatctgagtatacacacaataatacacaaaaagtaagtaataacagcatgaattcaagctgaatttaataggcttagcctcaagtcaagaggcgtgaacagatttttctaacagtttacagtgaagtacattgcagcatacttgcttttggtccaggccggtaacgaggctccatccgcctctgatgtcaccaaggttttagaatccgttggaattgatgttgaagaagacaaattatccaagttgatctccgaacttgagggaaagaatattgaagagctcattgctgaaggtaacgagaagctgtcctctgtcccaactggtggtgctgccgctgcttcttctggaccagctgacgctgcttctggtgaagccgctgctgaggaagaggaagctggtgaggagtctgaggaagacgacgacatgggattcggattgttcgattaaacaaataggcgaatagagatgattgcgtagttacttatggctttgctagtaggagcgactaacaccactttgggtgatggtcgctgggagggctttctggaaggagcattctagtggggcccgtctggtttgaaaagacaccaaattcaccgaatcgagaaacccttgaaaaaatccaacggtggaaaaaaaaaatctctttcgatgaaaagtatcaactctactacaccgcacattgaatcgtactgtcggcccactccacagcgccaatgtcgccaataattaagtctcctgcatccgctctgcaaatgccatagttttgtgccgtccataaccgttatttcgggagctaccgcaagatctcggtatatgtacaactgtggcgtcaggtcacgtgcgacgcatcttcagagatgagtagcagaaaaaggaacggcatcaactcctttgtcagctaatatgattagtacttaaacgccacttaatcttccctcttctgctctatttcctttctatcccttcatcaagatgtctgaaaactacggttttggtactagagctgtccacgcgggagctgaacacgatccaaccactggagctgtcatcgcaccaatttcgttatccaccacttttgcccaatcttctcctgctaaccctataggaatctacgaatattcccgttctgataacccaaacagaagtgcttttgaacgtgctgttgcttctttggagaaggctaagtatggtctcgcttttgcatccggttctgctgctgaatctgtgattgttcacactttgaatgttggagatgaaattatttcagtttctgacgtctacggtgggactcaccgttatttcaccaaagtggccaccaaaactggtattagtatcaaattcactggacgtttacaggcagacttggccaacttgctgaatgagaagaccagacttgtctggattgaatctccatctaaccctactctgtccctgactgacattgctgaaattagaaagatcattgacgactataaaaagaacggacaccaaaaccagaaactgtacttggtagttgacaacaccttcctgtcctcttatgttcaaaccccattgattcacggtgcagatttggtcattcattccgtaacaaagtacctgaacggtcactctgatgttgttatgggtgtagctgccaccagcgacgaggagttgtacaaagaattgcagttcttccagaacgctacaggagctgtcccatctccattcgactcttggttggctcacagaggtttgaagacgttgcatttgcgtgttcgtcaagcttccaacagcgctttagagattgccaaattcctgcaaaaatctagcaaagtacaactagtcaattacccaggtcttcctgaacacccacaacatgagattttcaagaagcaacacaactatggacttggaggaggtatgatctcattccgtgttgtcggaggagctgctggtgcttccacattctgctcatctaccaagatcttcactttggctgaatctctgggtggaattgaatcgttgttggaagttcctgctgttatgacccacgctggtttctctccagaggaaagagaggccaacggtgtttacgatgacctcattagattgtctgtcggtatcgaagagactgaagaccttgttgcagatatctcccaggctttggacaagctttaatcatataacatgtaaatttagatttcccagtcccttaatgtaaaataaaggtttcatccgatatcgatgtcagatgacgcttcgcgcttaagccttctaagatcccaagcattaggtggagtgaggccaagtagaaactctctttcttttatttgaaccttattaattgccataactatcaaatgtcgtctccttccaagggaccgtacgaacctaacaagagggttcttcaagctcccggtatccctatacatgtattaaatgagctgacgtcctcctccaataaacacaagcaacagactaccgtctcatctaccaatgcgtctattgcttcgtctgaagactatcaaagacctaatttttcagcaccagacgttgatttgagtacacccaagggttctggctcctttggcactgcctatggaacgtctttccctgacaatcacaatctaacagttccaggccagccaggtacttctaccgcgagtatggccaacatagtgcatccttcgatgtctagaagttcgacaggcacttcagtgatatcgggcaacatagcgagaccatcgtcggcgatactttcaaccactgaggcagacgagtatgctagtgtttactccctgtcttcacgtactaatgtttacttagatgacaacaagtctgactacagctactcaggaagtgctggagggtctcatgttgagtcttcgagcaacgttgccactactggacctccattgtccatccgtgagaagctccggttgatgaaaacgggtgtcatccccgcctcaagatccgactgtgtgtctgaaaaatccagtgcacactccacaacccagccagagagtgataagtgattacaacctgggattaaaccatagaactttttgcgtctatttcaaattacttaagatattggttttaagtgttacgtcaacatcctttaccccctctcccccagacaatttgtttcagactcgatgtctcattgattgcgcgacaggtttgacaaatttcgtcctagataattaactccagtgacatttttttatttgccgaacatgttgaagttagctactaaactggctccttgcagccgtgtagtgtatgcaataagcaaaccttcgatcttggtttctgcaaatcagagaagattcaacagttcaactcccaatgatactgtctatacctctctcaatgacgaaaatgatcctcaaagggatgcgtttttccagtatacttggggaacttggttgaaagatgataaagagcagaaacagaagcgcgtgactcggttttccatcgaaggtgtcaactctcttctagctaagatgtatgatacaagtagggaaactatgaaatcctccaatgtgttgactgctccagtatgggacaaggagttaaaagcaacgctgctaccttccaacttggatttagataccatgggagtgcttaatcctaatgagaagatagtcgtcactcagatggccagtattcatgagggaaaacatcatcgtgtttacaagttggacacaaatactcaaaagtcatttgtgttgaggttgccatataacttagacggagacttttacaacgatgtccgtgttaaaagtgaagcagctactttggattttttgagattaaagcttggtatgaaagtgcctaaggtttttgcctatggtgctgacgcccagaataacgctttacgatctgtgttcacgttaatggagtttattgagggagacctactaatgaagcgttggaatccacttgtcaaagactcagagggctctcaagagcagttaaagtctgtactggatcctctggcggacattcaacgtcgattgttagaagtgacatttaccaaatttgggtctctctactttgctcatgatgttgaggaatctttgagaaaagaccttccttataagggtgaagttgacactatgctggtcaatcgttggaagatcggtccttctgctgaacgtgtattttatcgtgatggtttacccgcagaagaggttaccaaattcactggaccatggaaaaatgccattgatgaagtggtggcggtggcagattctgcattgaatagtgtcgaactgagccttcaaaaggatctgactcaagaacaagagacaattctgaatcgtgctaaggaggtgtatcaagattttagatcggtagctcccgttttgtttgaatcagatttgactaaatcttctctcccaaatggtacagaactttttcttccgcgtctgcatgtcccagagttagatcctcttaatgttgttgacaatactgccgggccatatctgttggacgttgaaggtgccaatatcaagccatttatcttgcatggataccctgttttcttatcttatgatggaccaaagatttacaacgttaacgaggatgttgagggttattctgagatgtcaccggaagaacagcgatcttatgatgtgatgtacatgcgtacacgaaaccagtttatctgggagtttgcccttaatgccagatgtagagaacttgtaggggctgttgcccctgccgtaaaaatgattcgggagccttaccttgctgctgttcgacgaggagcagacgtgcaccattatttaaatgttgagtcgtcgctgttggccttgagccaaatgtgggattcctatcgtgctggacatttggttggggctgaaaaattcccagttaaatgggcggaaacagaagaagctttcaaccaaaaagtgcaaagacatagagaggatctgattgcttaccaaacaaagatcgcatctgctccatttagtgctaccaacggctgggtaccccaagatatgtttaataccttgaaagagcagggtataattgtacaagatggtgaagattatgttatcaaggacgaataagtgctgtgatattagtacatagttaaatctgtaaatgacggataggcagtaggtattgtatttatgactctatgaaatagtatgcccagagactggaagacttcaactgaaattgaagttgcagcttgaacatcggccaaagtcacatatcgtacatccaacctctaaattccgagtttacatccacctcatcgctgattggtttaccccaacaccaaataccgcgcgcgagaccgaccccggtccttcggatatcaaaaccttgaccaaataccagtcagccatcaaactatacacaaaccaaaccatgtttcgtcaaggattaggactagtcagacgtaagtgttctccattccataatcttatgcagttgccggtggactaacaataaaatagctctctcaaggaccacctccccagctctcaatagagtcgctcaatatcagcttatccgtaatgtgagtactgttaaggccagtcatgatgaagaacaagagatcttagttgctcagcgtaaggtgagaccttcctctcctcatttgactatttacgctccccaactcacctggatactttcctccttccatcgtatcaccggtgttggtttggctggtggtttctatgcattaacttgtggttacgctgctgccaacctcctaggatacgactttacctctgctgatattgttggtttatactcacaacttcccgaatacattaagtacagtgtgaaggctatcgctgcttacccatttgtgttccatatttctaacggacttagacacttagtatgggactttgggaaagagttgactattccaggagtttatcgtaccggttacgctgtcttagccagtactgctttggtagccactggattgctgtttttgtaagggagccaaagtatcgctgtctatgcccttaaaataatctatatttatcaaatcttatactagtatataataatacttttcatgtcatcatgtcgtagacgtcgtaacctaatcctccactgggaagtacagactcgtccgctgcctgcagttgcaagtcgtaatcttgtaaagtcattgaaacttgagaggtttctgactctcccgaatcggatttgccagatgctaacgtggtcgtttctatgagaggctctgggtgtcggctggagccccctccactgtctgagcttggtcccaaaaagcttatcttgaccggatcgatcgtagtagaacctgtatcggtcagtacagggatgtcgaatctacttggatccagaaaagtgtaaactgaatgtgattcagtggatgttggggtaatcggcggtgaagagcttgatcgtgacaacgctgctgagctgcattttttcttcttatgaggcgaagcttggtactctagtttgagtaacttcaaggtagaaatctcctggtttaatttatcgatgacttttttaaggtttccgttttctcgtgttgcttcatgtagttgagcatgcaatacggccttatcgtccgtgattatgtcgatattagaatggatgcgggcgtcaaatcctagttcaggagtttgagaacgagtgtctctatgctgatttgtttgtggttgtgactgctgctgttgttggtggtggtgttgctgctgcttttttttaagagcaccatttcgtttcactcgactcgcattacagcctgattttacaggatccttatgcttgtaagattcgtctgtgggtttcctaccgggtttaggccttggcgggagaacccactgtttcgatgtcatgattttttgtttctcgtcatgaatgctgccctttgtgctctgtgtgctcacggtcttactcatgggatacagtttgggtagcacttggattggtttctttggagctatagctggcagcccaggcttgacagctatgctcaggggcaccctagaaggggtttgatgactattcacgccttcttcgcgtggttcttgtttaatcattgccccataataaggaggttggataggtctgtgagaagtataagatgtgtaaagtcgtttagagagggtctttttgacttggagccttaaatgaaaaatcgcgactctgcttacatgtaattaaggctcaaatagctctggtcgggccggccggaagggttggactatttcacaagaaatcagagaaagagatgttttgagcgcagatcctgtgcgattggccaaagggcgacgccgataagaagggtgttgctatgatcctgacacgaaaatgtgatatattagagttattatggcaaaagtacctgttccgggaactttatcgtatgatcgatctactgtcccccctgttcgaggatccggggttcgtggggtatttacttagggttccctatcttgggtagctttatgaggggggggagtaagctgagtagtgggaaacaatctaggttgagtggagtttctattgtcaagtgtgggttgtctgtaaaatgttcacacttggagagactatttccctcaggacgaccgaaaatagagtatgcgcgccgagctttctgcttgaccagttacatgacgataacataactgtcctgtaggatagaactgatgaaggtgtgcgttcataagtaaaatgtttgcagcataaccctaactataataggtcatgtggccatgcttgcgttgactatgtttccttggtcatgtggtgatacctcaaccacccttactgtccaactcttgttcctcattttgatcttgaacagtctctgcaaagtttgctgctgcaaaactctctcgttcaaacacatcatggctggccatgaacaaagatccatgcattaacccaatcttctcaatgtactccgcttgaattgcagtaatctttatcaagttgtccaaatcggtaaggtttgcttgtaattgtgccagttgtgcattcaaatgtgataactgcctttgtttaatggaagaagtactgttatgaatcgatcgacgtgacatgttgttgatggttctgacttcttgatgtccgcgttttctgtctctcaatagtggtgttcgggggaagtatggttctaatacttaacaggtaagatggttgcaatgagcacctggtaaagcaacttgaatttcctgccctgtctccgttaagttatattcgactcaaggtccttgcttcctgtctgttctgtaaaacttccctttggtgtcttctatatcaactttaaaaacaaggtagtgtgtcgagcgatagtactgtgtctttttccctatgaaaaaaatcgcaccatccaagacttctcaccttcaacagcttcaacatcatgttcggtccttttagagctacgctggtcgatctaggaggtctgctatggaaacgtccttggagaatgtccaaaccacagaaatatagactccgcaaaagaatgcaacttgtagactccaatatcgacattatttaccagggactgactgaggagggtctgtcttgcaaagtgatagataacttgaaacaaaacttcccaaaggagcatgaagtgctccccaaaaacaagtataccgtgtttaacaagacagccaaaaactatagaaagggtgttcatttggttccaaaatggaccaagaagtctttgagagagaaccccgagttcttctaattgcacatttcttcctgttcatagattatcccacacatagttgctcacaaaaaaatcactataattttcctccaccggcagtatatcactaacacctttatctttattgtagattataatctgatctttatccttagatgtatctatcatcaaccccatgctcttgaaaagcttgagtcttaacactgtcgaatcgtagttttcttgtagatcattcgatatcactgctttttcttgctcttctaattcgttgagattctgggtcaaactagagattgaattctgaaggtgattcatgttcatctccagatctgttattgattttgctaatttaaatttttcgtgttcaagctcttcgatactctttagggtctgttgacggtcttctgtttccaataattgcttgttgaactctttaagttcgtctctctgtttactgatacgtgacaacaaatctagctggtgatcgagtttaagtttccgtttggagctcaacagagaaagattttcattaatttggttgatagtttgcacgtccggttcgatctgaaaattctctatagtcgacctgattaaggacacagtctcttgaagatcggacattggatttatggagaagggagatcaaagcggaaccagttgcactgtttacctttccagtcgagatacttatcccacagggccctcactttccaggcagaagtcacctaggaggcgcatccctccgtttgcttccctcgcgacaaactcccctgtaaaagaaaacttcactgaatcgtacacctaatcatacgacactaacacagatataatggatagaaagagaatagatgggcttcctccttgggttttgacccccaaagaagagaaggaagtgtttgagaactggaaaacaactacctataaagcatgcgacgatgatgtcaaaaagtttgcagactgtgctgcatcgtcagggtacagcgcttggttcaagtgccgtaaacaaagcaaagtgatgagagattgcatcgcctccagacaggctacaaagtatgtggatgatgagagagacaagtatattcaggaaaaaatacgtctattgcaagagcaggggaaaatccagccaacaccagattccgatgcagaacatccgacatcctcgtactcatggtggaaaagggagagaaatccctaagaggaaaatgacgaggacactagcattgattaggtaataagctcgataagagctgtcactaggtctgacgattgaaatatgagagtcgaggtcatcgtgaaagcaaggtttcgaaaagcaacgcatttcatcccctccttgacacactattattaagcaacctctactgcaaaaaattggttctaggtttgtggatcgtattagtcatgcaattgtgatctccacaccggaatcacaataactgtatataaaccctggggacgtatgtatatatcgatttcaccactactctacaaatctcataaacactctattataatgtcatcctttttagacagatggttataccgtatgaggggaacctccaacaccggtagctactactcaacaccgcaattatcaactagaagctcaggatttcctgacgatgatccccagaccactactccgaatctgaggaatactccgagagcatactttcatcctgtgattccaggtgatccacttacggaagaggaaagtttgaagatgaagaagtcctcggtggacagcagaaaatcatcagtcgtcagtgccagttccgaggagaatgaatgatgtttcactagtttttgcaggaaatagttgattgcttcgactggttcgatagttggtattatttcttatttatttattctttccgctataatatacgtccatattcaaacgtgcatgtctgtaagtcccaagtcttggtcaacctctttactacgtacgaactcttccgtggtcatgtttggatctggatctggagcgtagacgttctgaatataagaggaggccaatgggtcttccatggtgatagtgaacttgatctttccatcggcagcgtcctttattctttgcaggaatgtttcccaacgggtttttgtagcctcatccatagagtctgaggtttcagtgaacactcgatcatgcaattcctcctggacttgacgcaataacccttcaatggtagtaaatctaccacccagggtgcctggggtcaagtctagatgtagctctggaaccgtcaatccacatgtttcagatttaaggatatctctagccaaatcttcagcgttcaccactttcagagtgatcttttttcccttatctgggatggcaccaccggttttgacttcatttgatttgtagccgcatctatcgcacactgtagccatgataatgacttctttgaaatgaggaatattcaccattttcatattagtagagcaagaagcatagcatgaaggacaagtggcttgaaacgtctggacttcgttctcaaagttttcaatatcagtctgatcagaaataaagccactactggtcgggtttctgtctttagtatttgatgcagcaagttcgtgttgagccacttcatcggcagagaccagcccaagttgcacattctgctgtggagttctcgtatattcaacctgagaccatttgtgctgaggttcgccagggatatattccacccaagagttcccggaggggtcatctagaataaacgtcaagggaaaatgacttcccagtagaaccgacttcacttttgcaacaaattcctcaatcttttcatatatttcaggttgttgagtctttctggcttcctgttccgcagacaagtcttcaatcatcccagatagaagtccctcgacggtgattatctgccccttttgagcaggaatctcaagctccaattctttgaactcgcatgtgcatgtttcactcttgacgacttgcctgttgaaatctttgacattctcaattttcagcatgtacttgcatcctttctcttggatcttagaagcgggttgcatctcactgttcttgaagccacagtgggaacattcaaaagacatgataactacctccctaaagtagggaatactagttaataatagtcttgtgacaccattctttccacatttcatgcagagagattcaatctcctggaccggatggccctcagcatcagtagctccggtgtagctaactccctcctgggcctgttgccctaatggttgaaaaaattcctccttctcatcagtcttctgtttcttgttctgagcttcctgttgttggtctttatccataactctaatgattttctacaaagatcaaacgatatttttttgccttcctaattttttttgtcgtttgtaaaggcattacataagctttttcactacaaactgcagtatgcgcatttcagcaagtgagcttagatgcctactgttcaagtccctctgggccaaaataatcagtctttagtcatttcatttattatttatggtagttttctaattgctcgtgcttcgagctatgcataggtacaggattagcaccagaacttgtaagtgcggtaccaaaatggtttctgccttaggagttctctttcctctgcaacctcctgctttaataggttaaggtccatctctctgcggcctgtatccaagtccatctcttcactgcgaatgtacattgcccaatttctcttgtagattttgtgtcccaggtataatactagcactaacggaacacataggtacccttgaaagaagatgacgggggatggctctgctcctcctactgggaagagtgaaacccagaattgacaaatgacgatcaggatgttgactagcagtccaaaatatgacccatacacccctgtgttactcacataggcaagttcatccaatgatctaccttgttttttcatcgcatatcggaatcgaatgtgcgacagaacaatggcagaccacagaaatatggagctcagacctgagatactcaatagccatgcgaatacggtgtcttgatccttgtaggcagcgataaaggaaaacagtcccactactgcagatagcagtagggcatatagcggccttcctttacgatcaacgtaggcaaatatcttcggtgccatgccttgagcagcgagagcacaaattgttctggagcacgaaaaggtggcagaattacctactgaaagtagtgatagcatgatgacggcattcataacagatggaaggcctgagattgtgtgtgtttggattgcgatgacaaatggcgatgcagatgttccccctccagctcccagtaacctttcagagttaaagggaaccaacataccaactaaaagtagcacaacaatgtagaataaaagaattctccagaatacgtgtttaatggcagctggaagggcttttcttgggttggctgattcggcagcagctagaccacacacttcagtacccatataagacatggcagcactgacaaaaactgaacacacacctttgaatccagacgccaatgctcctggatcatgccaatattgtgcacctatgtattcgtgagttggacctccaccgcagatcaacaccaaagctaatattatgaaacccatgatggttacgattttgatggatgaaaagacaaattccgcctctccataccctttaaccccgaagaaattaactgctacgatgaaaacataaaatatcgccacaaatatgtctggattgatgctggtggtccaaaacttaatggtcattgaggcagccactaattccaatggaagaacaattaaccatagcagagcgtaatcccatgccactgcaaaaccaaaggatctgtcaatgaaacgattggcaaatgtggtatgcgaacctgcgactgggaatctgacagtgagttcggccattgcttggacgactgtataacaacatgcacccgtgataatccaccctattaaaacacctaatggtcctcccgttcttagggccgttccagaactgacaaatagaccagtacctatgtttccacctagagtaattagcagaatatgccttggcttaagggatttttgcataggagaattggcagttgccgctatagctctctcagcttctgtcatacctggggagaaggctgactcatctaagtcggcgcgtttgaaggagtctttgaactcctgccacttacttgggttggagacagatggatctgccgtcgatgttagcacagagacggcatccaggttctcgattttctctttacctgacatgaataggatttgatggaaagaataaaactgaaaagtcagagaaaggagaaaaagaaagtaaaagtacggaagaaataaatgcaagtgttggatgaaatcaacttagcggtccataatgcggagagtagaggatcggtttcggcgggtagaagtctccagttaatgccatacgattttttgtcacgttagggagcgtagaaacaagaagtatattctgcatcgagtcaataaaaaaagaaatgtatgcataaagaaatgccgtacccgatgagttcccacttctcgtccaacggtcgcatcccaggaagggctgagcacgtgactttgctccccttttttctttccttggtagatggaagtgccagaaatggaaggagtttgcgagaacgtatgttattagctattcagtatgttgtttgaaatacacagcagtcttctcgtcaacagccacctgcagcggaacatgtccctctgaatcctcaatagttttatctgctcccagttctaccagcaatacagcggcatcagcatggccttcggataacgcgtgatgcaagggtgtgaatccatagatatccttgaagttcaagggggatgacttttcagccaatagtttaatcagactcagtgagccaatgctagcggctctgtgaatggggtattgtccctttttgtccttgatccgtactgatgccttgttttctaaaagaagctccacagtgtctttgaaattctttgagacggcaaaatgtagtgctgtttggccgttagacgtcgtctggtccacatcaggagctggatcataatgtagaattgcatccacaatgtcaatgttaccgatgctagcagcagtatgtagtgggttccatcctgaatcatctgtcaaatcatccaagtcgattttttgttgccttagcgcatctagaagtttcgtcacaatttcaacatgttggaaggcaattgcccagtgaaggggagttttgttaccatcgtcctcattttgaaaagctgctgcctttggtgtgtcccccaaaatattctggacggttttaagatctccttctaatgcagccttgtgaatttctgacatgattactaggttaatctgggggggacaaagatgacctaacctttggggaagatgactagcgaatgatcaccagcttatgtaagatcagttgacagattaattacagactgttaagattattatgatgaattgagaggtaaaattagctgcaatcagctgaaacctcacgtaaatcatgacccttctaatttaaccaaattaatgcatcgtttcttgacattgggctaactggccggcatcatgtaaaaagccagtttcaaacatccgacatccagaagtttcgctagagagaactcgaagttcttcattgcactcgccaccacctacacaaccagtatgaacaaccaaaattgggaacgatttgcaagagagctccagaaaagggcttccagtgccaacactggctcaaggaagggaccaggccccatgggaatttttgccggggctgggggactgattcttctaggtgcagcagctttaactctaaatgcctcgttattcaacgttgacggtggtcagagagctataatttactctaggttggccggtgtccaatcccaaatttacaatgagggaactcattttgctattccatggtttcagactccagtactttatgaagttagagctaagccaaggaatgttgcctcgttaaccggtaccaaagatttgcagatggtcaatataacatgcagagttttgagcagacctgatataaaagcattaccaactatttatagaactttgggtcaggattacgatgagagagtcctgccctcaattgtcaacgaagttttaaaatccgtcgttgctcaattcaatgcctcacaattgatcacccaaagagagaaggtctcccgtttggtgagagaaaacttagtcagacgtgcagcaaaattcaacattctcctggatgatgtatctttgacagcaatggctttctctcccgagttttccaccgccgtcgaagcaaagcagattgctcagcaagatgctcaaagagctgcattcgtagtcgataaggcaagacaagagaagcaatccactttagtcaaggcacaaggtgaggccaagtcagcccaattgattggtgaagctatcaagaaatctaaggactacgttgaattaaaaagacttgatactgctagggagattgctcacattctttccaattcccctaaccgtattttgttagataatgactccttattgttgaacactgtgtctgacgccagaactcataaatagtcctggttgattgtatataactagtataagttttctcttagtaaaaaaggaaaagatataaataacctccacagatgaggcgagataattgtacgcgttttttttttctggcttttgattcattcttgaaactagtcgtaatcaagtcatcgtcatgggctggaaatcctctctcaaacagctcctatatagcactaccaccaacgatagatatgctgattacaaatcgaaccaaacaacgattaaatcggaggattttctggctaagaataactccggtacatttgtcaaagcctcattgacatcatatcctgacgacacactattcaataaactatcagtggatccagtcaaagctgctgaaggagcagaaggcactgaggaagtcgtttttgcatggcaattgcttgacgagtggtgttcgaaacacgaactatcctccagatttgctaaacctgtgacagtccccgacataatttgtgctcaaaaagatttgggaattgagtttcccccttgcttcgtcaaatccatttccatccatgatggtcaagagtataccgaatctagtcaggattccagtgggctgatattcgggttagaactcatgtccttggactcaattgtctctatgaccaaaaattggagaaaaatcacaaacaaaatcgaaatggacctggcgaaagctaagagcgcccacagcgttaataacatctcccagccacaattagggtatttgaagaatgagaatcacaaatccggccacttgtcaagttctcccttcgacgactcgacacagatcaaaccgctaactctaccaccacagcgttctataccagaaaagacaatcattcctagttacagtcactcgaactggattccggtgctaacggattatatggggaaccatgtggctctggatcttgctccagatgagaaaggaacagtgggtcaggtgatactgtttgggagagatttcgataccaaatatctggttgctcgcaattggggagattttttattactcgtagctggagatctcgagtcgaagaactggaagttggattatcagaatgatatgtatgggacttttgctggtttagcatacattgacccacttactaagcaagaggtaagttactttgatgttttgaagaaacgggtgttggaacagcataaggaaaacattgtcaacatcaccagatgattctctgatattccaggggctcactgggccatttgaaagtgtattggatgaatacttcgtaaagaagatacgtgaaagcgacaaagtatgctaactcaaacaataatcttgtgcgattgttggtttttttcaaagactcattctcaaacaaagtgctgtccgaaggacggactagaagcctccagaaagtgaatggaataatgaaatatcgtggctcaaaaaggggagacggcactaaagtaagagcagtgcatattgaaagtgcagcaatggtaatgaaggtgggcttgatgggatcttccccttcatcagcaaaatcctcctctgtaaacctttccttctgctcgtactctgtctcttgctgttgtatctcttgctcgttagggagcgagagaatgttatcagcaagcattttgaaggtgacataaatggagaaatggtaggcgggggctagcatatatctggaataggctgtcaagttgatgattcttctccaaatataaaatgtgtaatgacggttatcggcaagtaaaaatggatgcacaacagtaaagtaatgcacaagtaaagctatcacagcccacgagatgatggtcgagattatgttttgtctcaaaagtttcaagtatcccaggaaaaaagagggcgatatccacaatggaatggaaagcattgcaacaaaagaggtaaagtaaaataattgagcaatatggacactgaaaacatgattctgcttatcacctaatgttattcctccattggtgtaaacaaatgccaaaaagagtccaaagttgatggcaaacggaagtactcccaggatgtttctccatgtttcagcgataaagagttttatgtcggagaatgaattcgttcgatctttcgggtcgatctgttgatcaatgaaggttgctagaatcagggcattccatataatgtttgtctgtctgaaggtcacacttgccagtcctatgaacgctgaaatcgtcgcacttctatatttaccaaacggctgtttgacaataacaacataagaggccacaataaaaactgtagaccaaacatcagtgtagaataacgaatagtataatgtgatcaacggattcaatgatatggaacttgtagagtagctattacccgtagtccccttctgaaggtagaaaatcagaagctgtaacacaacaaatcctacgaagttgatatccctcagagtattggtatcacatttaaactcgccgccattgagcactgctagaatttttacccagacataacccaaccagtataaacccggtggagtcgtgattttattatcccaaacgtcaaatctccctctgcaatactgtcttgcctgaggaatgtggaatatttcatcgatgaatggtttccttaccacgttagtcaccttttgaaagcagctacgtattacaataactgtcaaatgagacaatagcgaaatgctattacttcctgccattctggttgatagaatgattttgtatgtaaattacgctgttaattggtcaagctctaggttcctctgagttgcagcaccgttgcggaatcccccagcctatttcagtgatggtgaaccttgccagttgagatctgagatatcagaaaactaagcattcgaggcctgtattgttaaaagcccaaatgttgctcgccgcctgtgtctctttagacttatgatcatagccttttttctcctgatacaatgcgtctattgtgtcatttggccgcctttgtctgttgataatgaagtcgctctgaggtctcaaagggatgtctcctacaatgtcagcgttgaccagttagttgatgttggggtccggctgtcaacagtcatttttgaaagagacacatacactcaaccgtatttgaatcgggtggacaaccttttaaacgcgtctgtaggaaacatcctgattgacgcctattgggatgagggaggatttaattggcaattatgtcctgctccctttagtgctaatgttactccaattgctgatggtagtacgatcctacaactggaatgggataataagcagtacacctgtgacagaagactggatttggcttccattttcacgagaattgatgaacatatcagggcctcagctagatccgtatccttaaatttgattactatttatatgagtttgcattcaattggcacccaaaacccaactccagtttcccagccgggaaccttatcaagaccattagttaggagcatcgatcaagtacaaattttgacccctgcttcgttacgggttgctcagctatccaatagcacatatcagggtttagaattcgatcccaatggctacccaattttaggagagctcttgcagagtagagggatcagagtgataccgattattcttgagaataatatgtatgaagatacgagctatgaattggagcgggactctaatctctatttcatacaaaattcaactatcgacgttactcagacgaacactgctgacaccaagttgaccgaccttacgacgaacataacaaattggactattgctgactcacaagcccttttgtctgagtcattcagactcgtaatggagacagaggaggatcctttttcattagagtcctacaccaaccatatctctcatggatattcaccctttttgaaccgaaagtataatgaatcagaaatcagacaatttgcagtcaacagactatggagttggaaaaactcatacctccctgaagttagtgttcccttacttggagatcaagatgattctaactctgcaaacgagacacttcaatgtgcttctttttccaatctttcgtggattatctcttcgtgtgacgagccacgtcaagtggcatgtagaaacagttcatactggctacaatggacggtaacatcgacactatcaaattattatggtgcgactgaagcatgtcctgttgggacgttttttgacattccacgtacacccctagacagtatgacgcttcaaagagagattccactcaactcaagtgtttggattgatcttaatactctagacagcggtggttgttggatcagcggtggtgccgaggccgaatgtccttaccacagagtgactcttgttagcctttacgttgagatcttaactccatcatcagtagtttcgatcgttctgattgctatcgtagtccttcttcatttcgtccgtataccaattcagaaaaatagaaagtactggagaaaacttcaagataatattaaggatagtgatggaattccatcataggtactgtctatctcagattatctgttctagtcccgacaccttcagctaattccagtaaggtacttccaaatactccctcagtttgtgagctcaaagttagactgtatttagatccccatatgtggtaaaatctaaccgtttcatcattggctacaacgcatactgacttcccatcgggagatggtactgctgagagaactcttagatcgcaagtagccgggacattaatcaagatatccatttttggatatgagtagacgctcatgagtaagggactagagaagtccgtgaagccaaacgaaaccagtaactgcttggaagatacagaccaaattatagaagtgatttggcccttggtgttatacgcatccagcaaagtccctgagttagaatgccaaaatctgatcattctatcttttgacccagctccagttgctaaaagagaaggggcccatggacaataagctatggctttaacggctgcaaaatgtggtaacatgaactttaactttggtgtcctgatatcctcaatatcccaaactgtgcaacaattatcatttgccccgactgtaatctgggtattgtctgcgtttaatgcaatgcctttatcgtttagttagtatactaagtcacagtgtattcgtgaggggaataattaccgcaaatctgttgttggtggcagttccaggaatttttcatcaccaaatcataactgcaatatgtttgtttaatctcataatatagaacatttccagtgtcatctccaataaataattctttcccagtgttggtccactggatacagcatacacttgtatttggtttggtcacggttgagcagattaaacttgcgttatcatagagatacagcctgccagctttagttcctacagctagaaatgtagtgcaaggagcatatgaaacacaagttatagcttctgtcaagagacttctcaaaggagcgacctggccatcatcggcccaaatgaaaaccttatcaaggccaacagcaatcttgttggtaaccttagaccaagagattaggttggcataaaagtcattacgcaatcctggagcatccaaaactcggaacggattagttatctgagggaacttttttgcctgcttaactgtttgtttatggtgtgttacttgggacatgcaatccttcaagctcgcaactggtgatcttgaaccgggaggagttttatgttgaaaaccatagaccctagtattactgctcatatccaaggcttgagctacctccttgttctcaaaaccttttttgctaacagctgaagagatatcagatattggagtgggtggatcactggtggcaggcgacctaattgtcgggagtggtggagtttgaggcctcaagctggaaaagtgaggaggacgatctaaaaatccgggctctaattcctccgtgatgaacttatcatcaacgtgagagtcagttaatccatgaaagttgacgttactaaccaggttggggataaaccgatcaacttggttcgcatggtggtttagtaaatttagatgattcgagcgagagcattgttctgtgtaaggcattcaatagaaaaaatgatagcaaagatcaaaaaagcagattacaaaagatggacgaagctaactaaaacacaaattgaaattaagcttttaaactaaatatcattgaatccggggtaattctcgcgaacagctattatacgttaaagcattcagcatggaaatgaaatccacagtcattagcccacaagcggacattattcaccaaaccagtaggtccagcgcctactacccaaacatcatcttccatctggaaacctcgctgtctctttctgttgtttcgtgttttttcgtaaagatagtgaagatattgctcgtccttggcaccagtgcctaaaaactcgccatccgatgttctatatctaagtgctgctccattcacggaaacacctgatctataactgtcaggagggatccgccgtacatcctcttcttccagtataacttcctgacagcagatattctctccgctatacaaatccaatactggaccaatgcaggaagatgccaggcaccactcgtagtaatgaagccccatcttcggtcttccaaatccaatcttgcagcctagatctgacaaagcccatatctgtttcatttcgttagggttacaagccaaagtggcgtgcacatcgtatgaatgctgatcatacacagaaaacattgaatctaagccggcactgaacccctgaggaaacgaagaaggatcttctaacagtgctcctgttggtgctgtttgcttccttcttatcttagactcacatctgtaggatgcttcgttgtccaattcaacatcaacattctcctgcttgtcttcatcaagtacatcttgtgtgatggagttaattgatgaaatagagttctgttttcgaaaaccctggtgtgtattttcagttgagccttcagataacggtgagctcattgaaccataataggaccttgattttgagcttggttcacctgaatatacatcgagtggcctttgcgaatccttttcctgatcactttcaacattattgaagtttagctcattatttaataccaggtcttgctctatgttttcacgcctacgttttaatcttgatagctcgtccaaagtacgaaagaaaatttctttgtcttcctctgtaaaagctcctgtaatgaaaatatcgatggaatcgttggtgaccaagatattcttatagtgattgaggattcgcatatcttgatagtctcggataacccaaataattttcgcaacgcaaccattgtaagacaaaattctcattattggcaaagcaaaactaatagctgatcctcccacaactatcaagcagcgtttgcatcggggcttgaaaaacagtgagttttcgtcttggtgttttctcgcaggggtcaagaaatccaaatgaggcaaaaaggagcctgtaattaaatactctttggtaatatcgaatttgaacttcccatgacgaatgattaatttctgatcttcatcactaggtaaagtgctgattgtgtagggatgttggagaggaactataagccatttccacaagttatggagaattctgcccctctcccagcttattagtcgaaggtgtgagcctggaagccccgttttagtcgttatactttcattaggtaggatgacaacagataggttgggtgaaacttgtatgacgtccagttttgtagttcgagtatgtaatactctgtatgcaatttgatagagaaggatggcacaattggtaactgtaagcagagtaatcttgggtcgtgcatgcaattggaggaatataaccgtgacccaagtgcaaacataatggttgacgtaaaatgtgacgtaagataatcttctgacctttggtaaagaggtgataaatatgacaataaacgacagcattgccacaattccataaaagttatcaagcttgtaagctttataaaaagtctttcgaacagtgaagatgtagacatataataatgtgtgtaataagctctggagtactacaatacgtgatacccatttatgaatgggtatgagagccaaataaagagttttgggcaacggggacggtcttaaagtaagaaataacaatgttggcattgtgtagacagcaactcttccaagtctagctgcaaagaattgcaaatcctcataaatctccagataactcagtccaaagagtagtaaagaccaaaatgtaatgatctgaataacttcaaagttcaagatcacgtagttgtttctcaatgcaacaatcttaactcgtcttgcgactctgctcattgttttgtaaaagaacctattgtacatcaggtgccaaccaggcaacagcaaaatacaggacatcgtgatccaaaatgtgatcttaccgtacttgactgtgactttctttcgcagttttttccggtcatttgccaaattcttgtctactaatctagggatcaatcgatggtagatctccgtcaatagattccaaaagaagtcaacaacgattggctgctcatcgtctggagtcggggtaggagaaaccaaagtatgatctggaatgtcctggtccataatataaaaacatcaaccacgtacgtcttaagatcctttggagggtgatagattgaatgataaatggaagaaagtcttgtgatgaagaatgctgcgtggcgattctgatctgagtgtaaaagttatctgattgatctgataagaatgcgatcgcgaagaaacaggaaggttgctacctcatttggttattattaagttagtcttaggctggtgactagaactgtcaagattgaatacaccaaagttgaatttgtgaaacccaaaaattcgaaaatgtgaacaaaatggctttagagctgattttgttggaacatcgtacacatcgagctcatggctcaacgaattggcatccttctttatcttttataaccggtagtctaccaacatgacacctccatggtagattgttccacgtgactatgcccagggttgagcctcgtcatacctatattttggtatcaacacgactgaactattgtattaccacctcacatcgcagggtaacacccacaactgtagcgatccttccaactgaaaaagtaaaaactacatcagaaatttttcggtattgctgaagtgttgaattaattacctgaaaagatgtctcttccagcttcatttgaccttactgccgaggatgctaagctgttattagcagccaatgttcacttgggtgccaagaactgccaggtgcacaacgaaccatacgtctacaagaccagaccagatggtgttaacgttattaacatcggtaagacctgggagaagattgttttggctgccagaatcattgctgccatccctaacccagaggatgttgtagctgtctcttccagaactttcggacaaagagctgtgctgaagtttgcttctcacaccaacggttccgccatcgctggacgtttcactccaggttctttcaccaactacatcactagagaattcaaggagccaagattgatcattgttaccgacccaagaaccgactctcaagccatcaaggagtcttcttacgtcaacattcctattatcgctttgaccgacatggactctccttctgagtttgtcgacgttgccattccatgtaacaacaaaggtaagcactctatcggtttgatctggtacttgctgtctagagaagtcctgagattgagaggtgttttgccaaacagaaccgaggcttggtccgttatgccagatctgtacttctacagagaccctgaagaaattgagcaaaccgctgaggaggaggctgaagccgctgaaggtgctgagtttgaggttgaagaagaggaggttgagcaagaatggcaagaacctgctgaggctgactggaacgcttctgctcctccagccgactggaacgatgctgccaatgccgaggccttttaatttccaaattagtaagtataaatggtagtttgtatattgtactgatcatttaaatgaggtggtccaagttgagttggttttgacctgtagacattggttttcatcggggcatttggtgaaccgatgtttcatttggactgtgaattatttcacttacgcgaatactcttctacgtaacaaacatccagcattcatctaagtctacctggcacataccctggcccccatctactcaatccaactacactgtccttttgtctagggattgatcgtttggtatgctggtgttctggccatccgatctattatccccttactacttcaataagaaatgttatgtcgtgggttccaatctcggtgacaagattatagtcatcactactctgccctatgaggacacaatccacgaattgaagtataaggatgatactttacccctgacaattgtggcaactttgaactttgaaaaagattcattgttgacactccactataatgcggaagaatccactgtaattggtcccacttatgtcactcttgttgtgtttaaaccacctgattcctccaacttagagtactattcgagtctcccaatctctattgagatctcctggactagcagcaaagcgttggtatctagtggtggaagctttcgtgatcttgaagatgtcgaaatggttcctgatttagctagaaagatggagcttcatactttgaaaaggggatccagcgatgattctttaatgctggtactcaaatatatcaacctgaacaactacttacgatcaaaattcactaagaaatatgcgaatcagcttaattatattgacctttgtccttgggttttcaatgaatctttgaaatctaaattgataaagatactgcttagtattttgcaaggcaagtcgatcaccaaagtcgttcagttattggcgttgattacccgtattatcttttattttgtacaagcgtggtgtttgatggtaatcaaggctctcaactatcggttctggggacaatacagtctagcatccatgtcgtatttttttcatcaatgggaaaaaagatctaatcagttgtaccatttaccctcacagtatcagaaaactaaacaagccaccaaagactcagaaatttcacttatcacaggaacaaagttttctccagctgagtacataaagctctataactccttatggcttatattcaatgatctggttcttgggtacgtggttgcgacttatttgtggaataacgaatctgcagcctctaaatttgttctggattggctggtttccagggtcctgattgacaaacttaacaatgtcattatttggttacaacactctccagcaggtttcaagctcaataatgaactttgtgagttttttggagaaatgttcagtctagtgttgagtttgtggatacatgccgttaaacacaccctattcaatcctaagttattcaaacttttgatacaaatggtcgcaattgcctctgttagtggaggtgtttcatttttcatatccattctacttgacttgcatacgctggtgacattccacatacaatcattctattacacatccatgagactatatcattggcagtcaaatataatcaaatccttgttccggctgttctgtggtaagaagtataacattttacgtcacagaatagattccaatccctacgactttgacgaacttttgctgggaataattttgttcacaatattcatttaccttcttccgacggtgtttgcgttttatcttacctttgccattatgaggttaacctgtttagcaattggctccattctagtggtttttctgatcctactaaattatctacctctcattgcattcattgtaaaattgaaagatgatagaaggctacctggtgggatcacgctgacttctaaaagctcacaattactggtattgaaaagcaggccactcacgattacagaaataatacaatcttacgtctattcgattattttatttaatcgagtgaacttcatgaactcacagaattacaaagataccagccagctgaattggcaattatcccccctggtgatggtaaggaaattgctccaaggcgagatcattgagggaattgactacaaaacacttttctgaattcaatatattcatcatatatgtacatgctgccagtagttctatcttattcctttatcgcttcttctttttcttaccatcactattggatgcttccttcttcttaggaggtgcacctttacctcttcttctacgggaggcattaaccatcaagcggtactcttcttcttcgttaatcagaccaaactcttggaacttataaatcttttggacatctttaaacttgaggaagtcggggtcaccgtaatagttggctattgtggttcccttcaaaggttgacggagtatcttggctccagttctttgattggttggattgaatgttgtattaaagatttcacaactgagtttttgcaactctaacagcctccttcgggatggcttcgtgaaagctgacatttgagttggcttagacttgttggtttaagggaaagaaatagtcccgtcttttttggtgaggtttgatttttcaatgttcagctacattcgcgcactattcctagaagaacaagggtagtgtgctcaccgtaggctctctccagtctcctcttcccttccttcactgtttctagcaagcaacatgagcccgtgtcatagtagactctatggggctgtctgtagaaggttcttctcatctggccgtttccacggagcagagtttactagcggccagccgcttttcgaaaatagaccacatatggttcgagaaggtgaactgactactggaatttcagcccaagaatattatgaaagaagacttcgtttggccaagaatatgactcgggcgagtattgccattcttccaggtcaatctataagatacgcgtcgggaagtgtgttttatcaatttcaacagaacactgatttatactatttcactggatggaatgaacctgattctgtggctatcattgaaaaaccaactgataagttagaagatgttgtatttcacatgttggttcctccaaaggataagactgctgaacaatgggaaggttatcgtacaggcgtacaaggagtccaggaaattttcaatgctgacgaggctgacaccaccaaaaatgtagcatcttacgtctcgaagctattgaacaggaacagcacagtgttctatgattttgaggacgcttccgagttgacgttaacctctctatacaacaagttctttcaaaaatcaaactccaaattttctggcacgcttgaatctcttttgaaggagcatagagtatctgttaagtctctctcatacatttctaattctttaagagcagtcaagtcacctgcggagcttgatgttatgcgattggcaggcaaaatttcaggaagagcctacaatcaagcttatgcccaacggttcccaacggagaaacatttatgtgcgttcttggagtatcaattcatagcaggtggctgcgacaaatcagcctacgtcccagtcgtcgcaggaggagaccatgctctttgtatccattacaccagaaatgatgatgtgttcaaagaagactccttggttttagttgatgctggggggaatttgggaggatattgtgccgatatatctcgaacatggccagtcaatgggagattcacgggtcctcaaaaggagttataccaagcagtgttgaatgtggaaaagaaatgcatagaatattgtacagagagctctaatatgtccttacaagatttgcataatgagagcgtaaaactcatgactagagagcttcgtaattgtggatttagcggcttgacccaatgggaaacaatgaaattataccctcattacattggacacaacttgggaatcgacgtccatgatactcctggttatgctcgtaacaaaaaatttcaggttggaaatgtagttactgtcgaaccaggtgtttatgtgcccgaatcaaataattaccccagttcatttagaggtatcggaattagaattgaggacgatgttgccgttggaaaagattccaatatagttttgactgtcgaagccgcaaaagaaatagaggatatcgagagcatagccgccaatggtgtaacaacccctttgtcagaggttgtgaatgtttggagagatatcaaatgaatatagcaaacagaatctgtatagaatacttgtcaatagtgcctcataatggtaaagaattgtaaaccatggtaccaacttctactcctcgtaggtcgtcatcaatttcgttcgtcgtctttattagttcctccaacaattcattctgattttggttttcgatgcaaacgtaggagattgttgaagtttcataatcaaactggaaattcagtccaagaagatgaatcagttgtaaaatttccagcttcagttgaggttcgtctatagccaaccttgtcgcaagatggagcgttgaggctctttgaaccatggatagatatatcagatactgacgaaatcgaaacaacaggctgagtctatcaattttcttggaaatgaaaagatctaactgaaaatagcgtaaccactcttcagaccatatcttattgcatgattggaatgcagcgttggtgaaatgctccaagaaattatgaagctctggttgcttagagaacactaattggaatttatccatggaaatcacatcaaagatttcattaatgggctgcgctacaagcatggatagaatgatcatctgtaaaacgtcattcttggatacaatgtcattttgccaatggtcgttaaacacttcaattgctgatattccttgaagtggttctgattgcagcatatcaacaaaatttttgcaacagtcaatataatcctggttggaaaaatagataaacgataatagccatctacacctccaatatgctattgtctccgtttgctgagactttttgaacggtcttgaatcgctcatataaagttgttccgtctttcctgagctggtgtcttcactatcgtcttcctcatctattgtatcagtactggggacctccaaaagggtatactttgcagcagtgagctttttggtgacaaatgggatatatttgctgatcttcccttgataagtgaaaaagagtatgaaagcctccaggtcctgtgccacgaattctttccataaacgggtgttataagatgagattagccctgataaaagatatgattccgcgttgatcgccataatactcgttaaataatcacgcttcaagataagctctctcaagtttaaaaaactattcaaaccagagacattggtctcgtatctctcaatttttctatccagctgaaccaaaagatcagaattaccgttaattttgttcattacttgtttaaacttttcctcatcctcaggacccacatatcgttgcaactccaggatgaaaggaggtaaaaactcatgtttaccagctatcagtaaaataaacttgagtatctctcccgacttctctggagacagcaatctgatatggtttaatctcagaaacattataggtgaagaatctatttgttagtataatcaattgtttcaagtagctaaccagaatgcttctatggaaagtgttgaaaccgaccctgtacttgcaaaaagacgaatcaagtcaaaaaaaaaagatccctaaagcaattaaaagacccaatgagtcattttaaaatactcacgatcatattgctcaatcagattattcatgtaacgtatcaaatagtctgatgagtccattattgatgtatttgatgagatgcagtttgcctatcaaatggcctccactttatctatcattttggtgacatttcgcgaaaccgaacctaaaaaatccttttctcttcctttttgaaaagcctgaatcagagatctcttcctaaggtcagcccactaataatgatacgtctggggcttttgagaaggttccacatacttatacctacacaagggaactttaagaacaaactgaatgtggctaccaagtatggaacaatcaaaaagaccctgtccaagacccaactgaaaaagatacagaaacaagatgatgctaaacttatggctaagaacaagaagcaactggctccagccgctgcactaaaactggctaaaagtattctcaacagtgattccttggatcgggtagatcccacggtaaaattaagtttacaagatcttcaaagcctatatcagaatcctaatcgaagattattgtataactttctggggacttccggcgaccaattgaacgattcatacgtggttgaaaaagatgttttgaagctcctagagcgtgatgacttgccgagggctctgtatttggtcagactcgccaaggataatggtatcgttggaatgaacaggattatgcactatttgttgaaacgagataaaatcagcttaacatttcaattgattgcactgcgtaagaaatggggtgttgcaactaacagcttaacatacacgataatttttcaaggttgtgcgaaagcagagtctaacttgaacttggctcaatcaaggcaactcgttgcattgttgcaaaaagctcacaaagatagactagctaacgtcattcacttgaatgctctgcttgatgcacttttaaagtccgagaaacttcccttggtatgggaagtaaaggaactgttcatagatactctaccaaagatagagcccgatgcaatcacatataccctactattcaaggctctgggaaaatcagaaaacaacaaagaagctttagaaacggctaattctctatgggaggaaattgtacataacaggaaggtcaagatagattcgtacttggctagggcctacgccttgctgtacttgaggtcaaaaaatattgagttgataaaacgtggaataataatcctgcgatcgtactacgacgtgtgtcctgttaatgaggtcgaaaatatttccatgaagcctcctaaaaaggctaccactgtgcctgtattgcttcctgttgacaccataaaccctagaaaattacgttttcaacctgataaagctgtggaagaaatcttgcagcattcatacatgagattgacgaaataatctgtatataattagtcaagtggctcttgctgtagcagccaagatgacatttaaagtgtattataaagaaacagtcaaaaacgacaaaaagtgaagttccgaaaccgggaatcgaacccggatctgcacggtgagaacgaactgtgatagccattacactatttcggaaattgtgacacttttcgtctctctgataataggtgagatttttcattaccaaatatgtacagctttttgtttcgtaatcatttcctcaactatctaccgtatcagattcgtagatccatagtcatacacctcttgctaagcacggagctctaaattgtgttttttaagacatgattatccgattttcgtgttccattcactagctggtataggatcaaatatcaaacaattggtgtcgcaaatcatagtgtttaacagtaatgtattgtaagggctagaacctcaaaatcctgcccaacttcaatatgctcactccttgacgctcttactccctccaccaaaagtaacttgacaatgcagggtgggtctgctgacttgggatacacctttcgtattacggccaattcaataatagtagaggcttttcgcaaagaccgcttaccttgcagtttaccccttctttgagcccaatcacaacgttgcgctacatgacacatttaggtctataaataagggacaagttcttagtaaaatagtcaaatgttcccctgaaatgtaaatcatttatttgatacacttcgaattgtgaccccctattgaacttcaactgtcattattgatggcaaatatcaaaaataaaaaattccgaaaccgggaatcgaacccggatctgcacggtgagaacgaactgtgatagccattacactatttcggatagttcatcactcaatctgaaatttgggtatgtagcatcgtcatctagtcacccaagtactaaaaaataaaagttccgaaaccgggaatcgaacccggatctgcacggtgagaacgaactgtgatagccattacactatttcggaatttattactgttttgctgatgtttttctttaagttagcttttataccatccagtgtttcaaactctttcttttcaaactttgtactcaaaatcaaaaagggctgtaaaagtagagagatatttttataatgtgttttggtaagcaattttggtgcccacagcttacctgtaaaagaaactagttgtccatgttttcctcaacaattggagccggacttttagtccccctaataactaagaaacaatagcaacagctcggtttatcccaaaaaggttaagcacaaaattaacaaaaaagacaatctgttacctgattgtttaagatacgtttactgctaatactagatttaaataggtcaaaatattcacttttttttggaacatatagataataaatgttgtcccttcagtttgatccgaaatagtgtaatggctatcacagttcgttctcaccgtgcagatccgggttcgattcccggtttcggaacttcttttttatctacctgaatcatcaagcctaccgaaggaaagtttgatcaaaaatcaaagacaaagcctacgttgcatttcaagacgacattgaattgtgctcttgactagcacatattatcaagttgcctgacgagagtattggtcgcctaagctcgaatctggggctatggtaactcacttgggcatgtcttaaagctcaggaatggcgttgtattttttcacttcgagcctgcctctatggccaagttggtaaggcacctcactagtaatgaggagatcatcagttcgaatctgattggaggcattttttttgctcgtcttaacctgaattcacctttacaaaccagaccagacagaacgttcaaatcttctacttctctctccaggatggtacaaatgatttagttatatttctaaatagtgtttcataatttttcataaagtatatgatcttagcttgcagaaaaacatacatctaatccaatgaagaagcaccggtaataatgtcgaccaactcgttggtgatgacggcttgtctggttctgttgtacagaatggagtacttgttgatcatgtcaccagcattcttggaagcattgtccatcgcatttcttctggcagaaatttcggaagcataaccgtcagcaagggcagatagaatggagttggctaatccgtactcggaaagagttgctggaatttcagcgtcttcgtcaacttcaaaagtagacagcttctcggaagccttaatggcgtcagtggagaagacggaaaattcagatggaaggaaagaaacaccggaaacgaatttgttatacaagacctcaatcttctggtagtcacccaacttcttgatctcgtcagcaatcaaagctgcctcgtagaaagtaggggcttccttaccaataccgttgaaagagagcttgacgttatttgggtgtgttctaagcaattggacctttgttttgtcaccaatagttacgacatcggcatttggaagatccttcagtctcaatctagcagacttggcaatttgggagtggatagaaccacatagacccttgtcggaggagacgacaaccaacaatgttttttcagcatcttctggagccttggtctcagcagtggtgaaaacttcttggtctccctcatggtaaactctggaagtggccatggctctctgagccttgttcaatctggtagaagccacaatcttcatggtgttggtgatcttctcaatgttcttaatggactttaaacgcatttcaatttcacgtaaagtagcatagtttctacaaacaatgttagtaacgtcgggctgaaaattggctttgaaaaacgttctgtacttaccttgtggaagcaccggcagagcgggcaatgttggcaacacttaaacgaaacattttgttgtgaggttaagaaacaggcaagttgtgaaccaaggggttttgtctgatttcgttgttcagtttaattcgttcaatgagaggaggcctttattggttcacacactactacttgggagagttttcgaatactggaagggatatgtgagggatagaaatgaagcgactctattggtggacgaggaactagggattctacgttacccggcgttcgcaagacattagtgattaggtaatctattctctatttaaactaatctggggtgaggtacgaactctatgatatgttatagtagtaagactgaacttggttctgacgtatttgggataagaatggttcagagttaatcctgttttgttcatgagtctcaaaaagcttgatgaattcatcaacatgaacttgatcacaatgatgcgctctcacattctccgcctgagcatattcgttgattgagtttttaagtattgatttgggtgaagttgtagaattgggcattgagattatagtagagttattctgactttgaatgtttcttttgggacgttcgtttttgctgtagatgatcaatctggcgctaccatgaaacttaattgatccttgaggatgaacgtttgcatgatttgaaggagaacgaatggacaatgtgctgacatttttattttctttatccttggtcatctttagactgtcaaaaaattctggatcgttaatcgtcaacggtaatatttgtggttcttcttttgcaggattgaaggtaggaacagagtatgattcaatgatactattcttccccgttgagctggctgtctgattcaaacccttcatgttaggttcatctactttaggagcaaagttctcctcctccagaaacggagacatttgtgtttcctcatgcggaaggtctgcaggttttgatgagtcaactgaagtaatcgtttgagactgggatgccaattggtttgttgaaaattcatcatttctgccagtactcagctcagagtctatttccatagctgaataatcagatataaaccaatgacagcctgcagtagtcttcaattcaatatcatcctccaataacgaagatgagtccaaaaattctgaagtatacaaagtcaatggcataatgtagtcttcatcagtttcattctcatcatgttctgtgtcatcattattccaatcgtcttgatcttgagttgattcttttctaaacgtgcaattgaatttctgggttaagtattctaaacccaacttgtaatcaacccgtctcttcttcctttgtggcaagggagattctaaatgcatcttctgtttctctttaaacttttctttccaagcatgtaagactgaagttccctctctctgcccactaaacgattgaactctgttcaaagctttcctcttacgagtttcattgccttgcttctccggattgtaattacctttcctaccaacaacgcttaaaatcctttgagaataaccacccctatcattagtgggcttagcagtaccaaacttattaacggaaatggcaaactcatcattcttcaataatatcatttccttaaaaggaaaaagcttttgatagccaagaaaagagcagtactagaaaaaaaaactacagttggtttctcaaagccaacttctcagcctagcatagtcgaagggaagccaggcacagtatttttcctttctgtgccacacccacctttggagggctctattgtggtgaatagatatggatccatcacataacgtttgtggtacgggatgcggttaagcgtctcacgttaccctgccttaggtgattttggctggagtttttttttattttctcttcttttccaacctcagaaatccacgtcatagatgctagatattgtccaattcattgaagagaggggtggtgatccggaggctatccgcaagtctcagaaggccagaggagattcagtcgagattgttgatgaaattatctctgaatacaaagactgggtgaagattagattcgaattggatgagttgaacaagcaacagaacaaggtccagaaggagattggattgaagttcaaaaagaaggaggaccccaaagaactactgcagaagaaagaggagattgtgaaggcaaaggaacaactcaacttgaaggaacaggaagctgacagaaacctccgtttcaaagtaaatcaagttggtaatattgtgcatgaatctgttcctatttcagacaacgaagacaataacgaattggtcagagactgggctcctgaaggaaccaatattaaagaagtcaccaacattgctaccgcaactggtgctcctgccaagttgtcacaccacgaagttttgctgcgtctggatggttatgatccagagcgtggtgttaaaatcgttggtcacagaggttacttcttacgaaactacggtgtctttttgaaccaagctttgatcaattatggtctgagttatttggcacaaaagggttatctccctttgcaagctcctgttatgatgaacaaagatgtcatggccaagacagcacaattatctcaatttgacgaagaattatacaaggttaccgatggtgacgatgaaaagtacctgattgctacatccgagcaaccgatctctgcatatcactctaatgagtggtttgagaagccacaagaacaactgccaattcgttatgcaggtttctcttcttgtttccgtagggaggctggctctcacggtaaggatgcctggggtatcttcagagtgcatgcatttgagaagattgaacaattctgtctaactgagcctgacaagtcatgggaagagtttgaccgtatgattggtgccgctgaaggattttaccaatccttgggtcttccatacagagttgttggtattgtctctggtgagttgaacaatgctgctgctaagaaatatgacttggaagcctggttcccattccaaaaagagttcaaagaattggtttcatgttctaattgtacagactatcaatccagaaacttggagatcagatgtggtattaagtctgttacccaaaaagagaagaaatatgttcactgtttgaactctacgttatgtgccacagaaagagccctgtgttgtgttttagagaactatcagactgaggatggactgaaggtgcctgaagtgctgagaaaatacattccaggagaacccgaattcattccttttgtcaaagaattaccaaagaactcaacctctcaaaagaagaaataaattaaatagttataattcattatgctccaatgccgtggtagtaactgtagcagatggcgatgttattgataaggatgagttgattgccttgattacttttttgttcaacgaggaggtggctgaactggtgagtgattttgtagttaaagatgatggaggaagctttgctttcaacgaggaaattgatcctattgtagtcttgattgactccttgagagtgatagtagtgtgacttgtgactgtactttttactgatgttttaatggaatctttaataatgcttttggttgaggagctcgcagagctttgcgttatgcttttgggtgaacttttgaaggcactcgttattgaggaaacgattgctggtttacttgacgacgaggttacaatatctttagcaacatccaaagtttcttggatcagtttttccgtttgttcgatttcctttgaggtaaaaccaaacaatcgtaatacaaagccaagaatgttgaacgacttcaagaccatccaaaacaccaacatgacaggtcttcgtagcaatcgtctccaaacaatccaggccgagacagcacaaaaaactgccaaagccatatatatatcccgcttctcttttttggaggacttattaatggtcttcattaattcagaggtacctgaaataattccattgaataaggcatatctatctgacaacgtttgtagatccctggagttttgatccaactcttctagattcaactccgattgcatcactgaactttgcatcatttctcttgatttccccaatgagtccgtgatcaattgattcttgttcaaaattttgacttctatcggtgtagaatcctcaatggtgtcatccactgaagacttgctttcatcttgaccttgaactttggattgtctctcttcagccaatttataggagttttgacaataaatctgcctatgtgcttcaaaacatctcttttgattcgcttgattagccaaaatggccgttcttaactgggatcttaggtctgacaagtgctctttgaaaacatccaagaaaatcaacctgtctaagtttttagttgcttcctggtccaagttgtagacgtacaattcaatgcattccgaaaatgacgacaaagagttcaaaacttgttccgtctccctctctcgcagagattcaaactcctctggtgctccttcagtgacagaactcaaagtatgaagactcagctgtatattcttcttcagaaaacgaagtttgttttctataggctgatagtcttgttgaaaataatcctaaaggttagtaaatgcaactttgaaagctactgtcacacttacctcatccatgatatgccagttttgcagtggagaaacgtaacttaaactgtcagcgaagaggttgacaatctattacataatcagtgtcaactgagatcattgaggaatcatatcatctccaggttagttaggctgcaactattcccacctcacgtcacgccatgcaaataaagtacaatgtgatcttacaggattgctccctaatatcagattccatatacaaaaagtcgacttccaatgctgccccttcccaggactcatttattaagacaaggcttatttttccccaagtatcgcactcgtatagacatgaagtgattgaccctcagatcacggagtctaacaaaaatcatagcagaaataaccttctacaggaggcaatcgacaaatctggtcggaaaaaccatattacgtgcaatttcgatgaagataacattattattatagattttaatgatgacgggtctgaggtaattaaggttgacagttttagcaatcactggcaagtccactcttatgatgtccagaaatggacatttgttgacgaagtgactcacgaagaagaattatatttagatatttttgtcagaggcagtgaaagtaatttggtcaatgagaatatcgattttacaccaaaaggggatctgaactattgcaacaggatatttcaagtgtttcagaccagaaataaacaactggagggtattttgaatttgaacaatgcctagaaacaactgttaaaccaaatcactgaagtttgccggcatctcctcaatttttttcgaatagtatttttcaatggcatgaagttctccaatatcctcctcggttactagattcacagccataccttttcttccaaatctaccagacctaccaattcgatggatatagttttccttggcaaaaggaatatcatagttgattactaaggaaacttgctggacatcgattcctctagcccatacatcggtggaaatcaatactctggaattacccaatctaaattcattcataattctgtctctgtcctcctgtttcatgtctccatgcattgatacaaccgtgaagttagcctttcgcaaatgttcggtcagccaatcgaccttcttcttggtgttacagaaaatcactgcttgggtcactgtcaaagagtcatatagatcacacagtgtatcaaacttccattcctccttttcacactgaatgtagaattgtctaattccttccaaactcacttcatccctcttcaccaagattttgacaggatcattcatgaacttattcgtcattactagaacctctttagttaaagtcgcactaacaaccaccacctgagtggaaggcggaagagttttgtaaatgtcataaatctgctcttgaaatccctttgtcatcagctcatcggcctcatccaggactaacattttaacattcctaacgttcaagtttcgcctttttatcatatcacagactcttcctggagtaccactaactatgtgttgacctttttgcaatttctttaaatcctctcccacacttgtaccaccaatacaagcataagtgtggatgttcatatagtctcccaaattttgtattacgttgttgatctgcacagctaactctctcgttggagataaaacaatggcctgagtatcctttttctttgtgtcgacaacattcagcatcccaatggaaaatgtggcagtcttaccggttcctgattgggcctgtgctatagtatccttaccggtgaggatttgcatgatggctcttgactgaatagctgatggtgcctcaaaaccatacccatagataccacgcagcaagtcttccttcagattcatctcttcaaaggaggccaccaccggcacacctttggtagtcttgaatttgaggtgtttatctgcttctctgtcaaactccattgattgaagagaaccactatctgaaatttttcgtcaaaagatgcgattacataagcaaacgaggtgcaaggacttgatgacatctggtctgacctcatccgtgtctcattcactaggtgtgtctaatttgctgtccaatgtcttctagccagaacactgtggttgttttgatagggggaggtcacaaatccggaaaggtaggttgggtcacttttgtccgttaaacaattgaatattttctaacgatctagtcaactgcttcaaaacgtttagaggaagagctgaagcttcgaactacaaaatcttttgaaattaatataaagattattgactttgacagctacttagttgatcctgaagctaagtttttggtcactaaagagattggacattgggacaaagatcaatctttaccatcaagatttgatttcgaaagattgttagaggaagtcacagagatcaagcagaaacaaggaagagaagctgttcacgttctgcttattcatggaatttatgcactgtatgactcaaggttaacgaatcttgcagacgtaaaagtctttattgacttggattctgatacaagacttcagagatggatccaggatgtaattctttcttcagattacgaccgagaattgcaaggtatctatttggataacctgttgaattattatttgaaatatgcaagggttgaaatgtcagagtttgtatctcctacaaaggcaagtgcagatattatattacccaacggtgctactacttacggtaacagtttgatcacagatggtatcattccgctgcttagaagttcccaagacccactagctacctcaagttactacagagatagtatcagtctcagaactcaacagaaagatagctttggcatacccttggttagcctcgacactgataatgctgatccacaatatggaaacatgagttgagatagacttgctacaatttctgctggtggatatttatcggaatggtactcccataagttttaagagtaacatagtcttccaaagataaggatataaggttggggctcatcatgttgtcaacatcatattgtccagtactgtattggcgaacgagtttttgtgtatcccccgaggataattgaaccccgttattgaagtatgcctttttgttaatccactgattcagcagagctcttaagaattcaactctggagagatctagtggaactttgttccaccataaatttagttcttccatgcatagttgaatggttgaccttagtgcactctccgttatactaccgcccagaatttcaccgttcaacagatcatcctcactgatgtaatttggagttttgagatttagcaacggatcattgaaaagttttatttgacgacgctgactgacgtttttcaacatggaaatgtagtagaataataatggagtgttatatgttaattgagactcttgggctaacacttcacctgttgtggaaatgaaactgttcatatatttgtatctgttgtgatgaagaccgaccacaaatagtttcaattgttggagaatctcttcgatttgaaacagagaatccaggctgtctatacatagaatagtgttgatttcggttttgtaatagtgctgagtgaattcaaagacatctctccagaagcttgcttcattgcggctggataaagatgaaatatagaacgttactttatcaacgagtgggaaacttttgaagtagaaaattgcaaaatccagaagtgctccgctcacaggctctccgtcaatcatcaaagatttttcattataattcagtcctcttggctcaataatcatatcccgtccttcttttatcttttgatgaagcaaggcttgaattttgagagagttctcccaaaccggtaagacaatgttattcatgctcacaacgtttccctccaaactaccgttcgccggtgaagattctaatagattttccaagtcggttgctttttcatttttccaatcatcttgtcgaagaatcaatgattcctccgagaatgttggcaaaactccacgatatctttcttgatgaagggacatgaaatcctgcaacaaaagctttcgtcttgcattgaagtttctatgaagatcagttaacagagtcagacattcgggagttaaaatattgctgcctccagggactggttgaaacgtaactccttccatatgctcactagaagaattcacaaaggactgaacattggacattctggtgaatttgcttccaaagagagacaatgagtgattgtactaagaattatttgatagcgggatagattaggctatttcatgagtatggggtaaggcttacataatgattacataacgatactcggatcgttctctacctacaataaagaatttcaacatccctctgacaactcaattctcaacagaaaatgaaacagaatctttggatggtggaaaatccgtgcattctcccttgtatacctaccattatccagtacatcagctaggtttccctttttttctatagcatgacattgacatcttctgtgattggctgaccctcgaactcttagtggatcggtcaatttttcagtctctcccgatatcaagagaagagaaaaaaaaattcatctcattgactcacaagtctcttgtacatcaccaagtaacggataatgaatattgcgactcgtgcccaaaaatgctcgggaaagcggttcttcagcttgtccctgctcagaaatcaggaagttaaactcaataagttctcttctattatcacacaacccaagtctcaaggtgcttctcaggcaatgttgtatgccacgggatttaccaaggaagatatgaacaaaggtcaagtcggtgttggatcatgctggtggtcaggtaacccatgtaacatgcatttattagacctcaacatgacctgtacagagtccgtcaagagagctggtctgaaaggtatgcagtttaacaccatcggtgtctctgatggtatttccatgggaacgaagggaatgagattttccttacaatccagagaaattattgctgactcttttgaaactattatgttggctcagcattatgatgccaatattggtatcccagcttgtgataaaaatatgcccggtgttctgatgggttttgctagacataaccggccttcaattatggtttacggtggtaccatccatgcgggtaaaccatctcacgtcactgacaaagttcccgaaaagattgatgtggtcagtgctttccaaagttacggtcaattcatctccggtcagatcaccgaggagcaaagagaggatattgtagcccattcatgcccaggacccggatcttgtggtggtatgtacactgccaatacaatggcatcctgtgctgaggtgatgggtatgtctcttccattgtcatcatcttctccggccatatccaaggaaaagcaggaagaatgtgagaatgttggttttgctatcaaaaagttgatggaattgcaaatccttccaaaggatatcatgaccaaagcagcttttgaaaatgccatcacctatgtcattgccactggtggttcgactaatgcagttttgcatttaattgctattgcccacactgttggggtggaattgacaatcgatgacttccaaagaatttctgacaagaccccatttttggctgatttcaagccttctggaaagtacgtcatggctgatttacagaaatacggaggtactccagctgttaccaaatacctgctaagaaacggtttgattgatggagactgtataacagtcacgggaaaaaccgtcaaggagaacatggagaactttgctgacttgccattagagcaggatattatcagaccactatccaaccctttgaagcctacaggtcacttacaaatcctgaagggttctttggcccctggtggatcggttgccaagattaccggtaaggaaggtacattttttgaaggtaaagccaaatgttacaatgaggaaacagatttcattgaagctttggaaagaggtgaaatcaagaaggatgagaagactgtcgtcgttattagatacgagggacctagaggtgctccaggtatgcctgagatgttgaagccctcttcagctcttatgggttacggtctaggtaaagactgcgctctccttactgatggtagattttctggtggatctcacggattcttaattggtcacatcgtacctgaggcttggtcagatggagccaaggacccagctcacgcaaattactatgtcgacggtgttgctcctattgccctggttgagaacggtgatgtgattactattgactctgataacaatactatagacataagagtcgagagatccgaactagaggccagagcaaagaaattcactcttccagacaagagaattagaagaggtgttttgtccaaataccagagattagtgtcagatgcatccaagggttgtgttctggacgctgactactactaactaatacgaacagatgaaaattccgaatgataacttatcatggtgtttcctatattagttgaattaattagaaacattatttattatacacacatacattacataatcttaagtacttgaatgtactatggtcaataattgaggattggagacagacccaaaggcaaagcaaactgctccaccaccgatacaagtgattttggatgtttcatcaatggttgcgttgaagcccaccaacatggggaagtttttccagtcgtcatctgagatcttcagtgggattactgtcttggtatctatgttgaatttgactaaccaattctcttgattgaacaattgatggaatgaaactcccccaataaaaatgtattcaggtcctttcagatgaactactttgctcccatatctggctaatagtttatgttggaaaattggttttgatatgacagtatcgccttgaacgtagaatgaatagacagtaccattaatcgtacccgacttgagcattcctcctgcaatgagtcctagtccatcatgatagcacatagcagcagcttcgaggttaggcatgctagacgatatatttttccaggtcgcaggaaggttaacgtctgatagtaacgagaacgcatcaccattgcatcccccaaatagtagtaacccattttcagtgctaacagcgcaatgcctagatcgtggttccaataggtcaggtagtttctcctgtaattttccaatggaccaacattccgttgttggtttacctggagcgcttcttccaccggataaatgcagtttaccattatgattggttaatgattggcacattaattttgacagtggatcgttatgcgttatttcagttgcacagttacctttaatgaccacggtagtattacttcgtgttatgtctaatcccccgtgaaggactatatctccttcaaaactttggcaggctgcaaacttcctttgaattagttccgggccttcgattgttattaactttgtttcaacgaattctgtactttcagttccctccttctcgtcctcagtgtcttggtaaacctgtacgttcgaatttgtagcatgaaggacaatataatgctgtgcatacatgacgaattcttcccattcatcgaatgcctcaacggatgcgattttacccttgatatcagcacttaaatccttccaaaaatgaaacaggtccctagcttcaacattgttgaaaccaagactagtgattctttcacattgtttttcaatcgtaggataggtttgaacacactgtaaaggactatccagacgactaaaatgataaagcatcgtcctactgaacggatgtcgttcgccagcaggtagcaattgctctaacaacaagaagtgggaatttggaaacttactagtttcttgaattataggatttgcgcaatttggtttcatataggccaacgaaacttcggcgatgaatacactacaaacatcatctctgccgaggttcagttctgtcatcagctgctcaaataagggtagatcattcatgtcacagcctactgcggcatagttatcggtcttcaacatgattccatgtttgggaatgggactttcacttttctcgttaataatgtgtctcaactccgaagagcctctgattaatgatattttcttggatatcaagtctggataatcaacgtctatgcaaaaaatgttcgtcttctcattctcaagtagctcaaaaggtaacacgtcataaccagcacccaaattaattattataacggtttcagaagtcgattgattcatgatagatcttagtgattctttgatagagtgcattctcaaccaatagcctctgttgattgctggggaccttctttgtggtttctttaccacatgcttaaagtactcagtaggcttgtcctcgctaccactcaagactggtttatacagcatttccaccgatcttttggacactattgagtaatcgttagttccttggatcatgatatcggagtaaagctttttccgcttgtctttctcgatcttcctccgttgcctgtttaggctcttctcggaaggtacttgagctccctcattcgcctgtatcgtcattgttggtacaaacccgctttaaggtgatcttcgtactcagtatttttcatttttcatgaatctttttattgtgcgcgatagtcttatcagatcagggagcacaatgtttctaatctttgcctgtctgtccgcactccctaaacaatggaagactatgggaataagccccctcaggccaatgacagggacacagataagcccgtcgatagggtggccaagctgaaaatgacaaacggtttccaaaagaccaaaaagtttcccaagttggttatggtaaaatacacaatttactctacaaatgagaggatctacattgtgggtagtaataaccgtgaaacaatgtttcgaatacttgaaatagacatgaccacctctgccactgaggaattgaatataatagaggagaatgtgttttttacaagattggaaattatagcaattctcagtgatttggaggaaaacagtgaaggtggcctgaccaaaaaactctcaggtatcggattattggggtttattaggtttacttcttactattatctttgtgttattactgaagcaagtataattggagttttaggaggcagaaatatctaccacgttgataatacggcactggtgcccgttaccaacaattacaggaaaccggatagaaactctgaggaggcaagatttctgcacacttttcaaagtatagaccttaccaaaactttctacttcagttacacttacgatttaaccaatacaatgcagaaaaatttcatgagtaataagaaagaggcccaaggcttgaatgaagagagcttcaacgaaacatttgtccataatgaaatgtttgtgtggaactcttggcttctcaatcccattaaagagtttgataacgtctacgactggttccaaatcatcattcatggatttgttgaccaagccaaaatatctgttttctcgaggcaagtgtatattactctgatagccagaagatctcatcattttgcaggtgctagattttttaaaagaggtgtcaatgaccaaggaaacgttgccaatgaagtagaaactgaacaaattgttagtgatatgctaaccacgccattccacgacccaagtgctggtttttataataatcccaattatacctcatatgtgcaacataggggctctatacccttatattggtctcaggaaactagtcctaatcttaggcttgctaaacctcccatttatatcaacttgatggatccattttatacctcatcagctgttcattttgatgatttgtttcatcgatatggttctccaataatgatcttgaatcttgttaaacaaagggagaagtctgccagggaatccaaactgtcaagagaatttgaaaactgcattgaatatttgaacaaatttcttccggccaagaataagttacaatacatggcttgggacatgtctagggcttccaaatcccatgggcaagatgttgttgagtttctagagaagtacgctgagaaatgccttcgagtcactggtttctttcataatggaagaactttgcaagaaactaaactgcaagaaggaatttgtagaacgaactgtatcgactgcttagatagaaccaacgcagcacagtttgtcattggcaaaagggctctcgcgtaccagctttgttctcttggagtcattgaagacaactatctggaatacgattcagatgtggttaatattctaactgagatgttccatgatcatggagatactatcgcattgcaatatggaggttctcatttagtaaatacgatggagacttatcggaaattgaaccattggtcatcgcattcaagagacatgatagaaagcataaaaaggttttacagtaactcatttatggatgctcaaagacaggaggccataaatttgtttttgggaaattatatttgggaaaaaggagttccagttttatggaatctagacacagatttctaccttcacaatgattattgggggaacaatctaatgacgtgtaaaccgagttatacacattggtttaatgataggtatttgaagaatcgaaaagagttagtcttgaaaaagttggaagatacgaagtctcctgatatagttaaatgggaaagtttaataaaaaagaaggtggagccctatccaggatgcgtcgacaattatttcaatgaacattatcctcccggagagattgtttcattgaaagacgtctttgaattcaaaatgatttcaactttgaaggctcttgaagttatcccacagcccgaagaaaaggaaaggagaaggtcagtttacagtttcacatcccccaccaaggaagtcacctccgccaaagaatctgataatatttcctctcctttcaaaaccagaaaaccccagcctgcaagtcaaaagtacaagatgttgtacgaaaagaataaagaagaagaagaagtgaaagatgttaagccaagatcacttgattgtgagacacagttcagtagactacaagctatgcgggttaaaaactactttgaaaggctgactaacagtttggaaatggaacttggaaaagctcagagaatgttcaaggaggaaagaaagcttccactctttgaaaatagtagtcagaagattgaattaaatgcgttaaatgaggactatctttatgaagaattcaatcttgaggatgagaaggcagctaatacggatgacctaaagctggaagtaactgcagcagacaaagctatttatgaaaaaaacaccaaaattaatggattcattccgctcattgaattatctagtgatacagttgagaatgcggagagtattaggcacttggtaaatattcgcagttaccaagaaacttgctatcgtgatacgttttctgtcagtgaagaagattaccagatgtactcatcgattggggtttgatcgaaaaaattggaaatgctattcagttgaaagcagcccacacttctttcaactttttgggaatatcttgtttggaccaattttgggattcttcaattatcttcacacaagtgattgtagtctttactgtttctgatttaatccaaattctaccgttgcaaccaacggccagttcaaatttgcatttcttaaccaattcagtgagaatttcagcattctcgttaaataaaaggtatctcgcataagccaggttcacagtgaataaatatccatcctctaattgtccaaagccaccttctttacctgtagtagggtcaatacattccagttcgacttctatgtctctttcagcactcagaacacgagcatatatcacatctcccacttttaaatggggtctatttttcttagatgcattagggaaagcgtatacagacatttgagcagcctgtgtaaactcagataagccgactttgtagagctcaccaaatgtaccagtgatgataccaatgacgaagtcatttgttttgggaatatacgttttggacttggaatctatcacatacactgttttattttgtttctgagaaacttccaagatgccggcattagttggaagtatctcgtcagttttggggtcaacataaaaccctggtccaagaattatattctcggactttatatctaacctgtctccgggtacaataagtgattcagtcatttctacgtagaggcaggaaacaaaaagttttttcttagcgttttcttttagcgagagatgaggttatgtaataatacaagcaaggtgagggctacttaacttgtcctagtatacatccccttccctttgtttaattaccaataacgtctgattaggatggctgatgattgataaggaaaccaacaccccacagaaaccttttcgttccagccggtttgtcaattcctctcctgttgggcctagtggcagcagtctggagcagatggagcagagaatgaacagcaggaaccaaaagatgtttagaccaatgagttctccaataagaaaagcccagagtttagtagcgtcaccaaagtctcccactaaaagggcgcagtatgttccaacaagattacagaaaaagcgccaggaaaaggctgttcagaacagaggtggactagaacagatggaagagtttgtgatgaaaaatgaatattctcagtacgtagaggagctagagaatcaggcaagactaaatagcatagatcctgagatgttagagtttgaatcaaacgatgatcaagctttacagccacagcagcaggaactcgaagagatgattaggttggaacaggaggaattagaggccttggcagcgacattcgaaaacaatttaagttttaaaactgtcaaacagagtgactgagtggccaattgtgggaagaatggctgtagaaaagacaccctcttgatatagtggtccaggctaaagatttgtccatagctctattttgttaggattatataatccagctaatcgcttaaacttagtacagcatctcaccctccttttccgctgacaggtgcaatgtctgattatagtgatgattacatggatatggacgatgatgaagaggagtatgagttcgaattcgaagatgacgatgaagttgacgagccagacctcccaactcctgacgctgaaactagtcagcaaccaaacttccctacaaacaaaaacgatgcaagcaccaagacattaaagaataatgatcttgaaatgatgtattacacagcaaaagcattaaaagatgatgatgctagccaagctttaaagagctttagagctataattgattcgaatgctggccaacattccacgtacgtcttcaagtctatcaaacagagtttgaagctcgtgtacgagcagagaaatatgcctgcgatgctggaattgatcaagctgtttgtcaaggagtcttcaaacgttcctcccaagtatagggatgactccataaaaaaaatgctggacaattacgataaactttcctattcaaatcctgaagttttaagttccatttatgatgaattccttcaactaatttccacagaagatggcaagtattcaaacgagtctttatggcttaaattgacgatgaaaaaggccaacatttccactgatccagagatcaaaatggcacttattagacaaatgcataacgtactagatggagctaatgaaacatacatatacaatagctatttattggaatgcctttcaatggagatggatacaagtttggattcctctacctcttcaacacaatactcaacgttgagacaactatatcacaaagctttatccatcaatgttggtattccacatcctaggatactggggatcgtcaaggaagtgggtggattggtttacagtcaattgaaggactttaccaaagccagtgaggaatacttggaaagtttcaaaaactatgacgctgccggaaatccaaaaaggatccacgttctcaaaaagttaatcgtgtctactatattgagcaaaagtgaaattaatcctttccagtctagagaatttgtgtcatttattgatgaacccgaagttgccaaactattggaactatattccagtgttcagaatgattctatcgatgttttcaaccatttggtcagagtagatccttttttcaaggaaatcttaaaaaaagatgcttatttgtcgaataatatggatctaattgttcagttgatgtactctaaagtgcttttggttttgataaaacccttcaaaaaatgttctttctcatttttatgtgaatcgcttcaaaccgatcagaatgtggtggaagatttgcttcttcgtttacttcaccaggggaaaatctcggactttagatgtgattttgaagatggaattgtcattttctattcaaaacctgcttcgatattacctgatttcatggatataaatgagattttaaatcatttcattgcatatcctgaggagccttttaaattgttgaacaaagatgaagtaaatgaagtggaaatggaaaactttgatgcccctgaagtggaggaaccagaaattgatgatgatgatgaatcagatgatgaaaacccccttcgtgtcgacagtaacctggattttggaaagagagatgtttcgaagaggtccaaacaaactgccacgatgctcaatgccacccctctgatgttaaaagtccttggggatgccataaatgttgattcaaccggaaacaaacccagggttgccgatgctgatgtcatgagagcaatatccagttggatcaaggttgttaatagatgtctaccaaagcgaatagctcaaacgctgtctcaaatcgagcaagttgcattggagcaacaggagcagttggagaaaaaacagagacaggatattggaatccttacgaatgccaccgaggatttgaataagaacattgaagagattacccaaacttccaagatggcagggttggacccaatcggagattctgaaccggtacaaagaaataatcaggatcacgaaccaagtagagcagacgtcttatggaaacttttgaatgaagttaaaggctatcatgagaagattataatggaatctaaaaaagttggaactgaaggctcaaaaccacttgggtttgaatcagatggatttttgatctaaaattgatttcagataccgataatgtctattaggtttgacaatctttcgacattttcgaccaagtcatataactgtgacacattgctttctatggaattgacgtgcttgctcaattgttgtcttacattcttcagttgcttgtcttggtttacactgtagatacttttgtgttcggaaggccttttgtgaattgcgaaatctgactcttccgtgaggtttagtttcaagcccttggactttctttccatctcttttatttctttggttatagactcttcaaactcttgaaaatattcaaggtcttgctggtacaatgactcttgagtgtgtagttcgctctctaattttgtcaattgttctaagtttgcgcttaaattggattttaagttaacgttaatttcctccagatcaccaacagacagtgaagtgttgggtccgaaagacggtatccgaactgtagttagttcctgaactaagctttcaaccagttcctcaagaaagagtctgcttatccgctggctgcgcgtactattgcttatacccatactaacggcttccatgtttgaactgagcaattctctcaagctttcggagaattctgttgtcagatttgaccattcctgatttaccctctgaggtgcttgatctgttggttcctgttcatccaagggggagtttagttgatctttgggggactcgtatttgacgtctgaatttctttgctggcccggttttgtctttatccgggcctttttggaccttgaaggctttcgtaccttgaccatttgattgtttttataagaacatacgacagataacaatagcgacataccatcggattacataagcaaaacaaacatctggaagttggcctcactaaacagctggtaactataaggtaaagctacaaacggagtattctatatggccactgttgttggtatatctggcgttaatcttttgccttccaaggctagtcaatgctgaaaccccggtttcctgtctcatccctacattgaacattcgtctttctatggtatcaatcgcgtactaaactctccctttgaccttcaccatctttgtcaacaaacaagtgttgatatctatccctagaaatgtccaacgttgtactgggtaaggttgctgctcttataaaggcagaaaaggaccttgaaaacatcccggcattgaaagatgaaatcttgaaagagaaaaaatccatcgaatcgcagctgagattggaaactgaagggcacctccagaaaaccgttcagggtatacagtcgttgagtgtcactgttgattcatttaaagaactcaagcaggatttacaaaaaatagatgagcttgcgaagctgtcagagagtgccattgaccggtatgatatcgttcagagggcaacacagctttatgaaacaatccaagaagtcgatgaaatctacaaaaagctaaactcttttaacagttcactgactgaggtaaacgctctgtgtgatgaggaaattcaaagaggcatcgatattgattctgaggtcccaaacctacttccaatccactttaggctgacagaactgagagattttagtgagaaactgacagaactatccaccaattcgcagcaggatactaaacaaaccattcgcaaactgaacaccctcttggaacctgccattgaaaaattcgattccattgtaagggaaataagccttggtattacggagagtttgcgagagcgtaacttttctttgatcattagattggccaaagttttagactatgaagaaagagaagatttgaaggctcaaatttttcatgaaattgtaaccaaagttgataagagaagcgaggatgatagtgatgggaaacgtcacttgacgagttccacaaattttgtctcaacactggatgttattgactcagatacaaaaggagcagagctttatcaagagcaggttggaaggttgcagcagagaaaatacaaacaattggcatttgatgcgattgaagaatcaattagagacacattcaagaactgtaaagatacttttgtcggcgacgacaggttcgaagtcttgaataacttggattgggtttatcaagacttagcattaattagagaaacgcatgcgatatgttttccttccaggtggaacatgtttcatatattctttcaatggtattacaaatacttgaatcaaataatagttgaactgatagaaagtgaaccggaaacgattattattctggatatccttgagtttgacaagaactacacaaatattatgaggcaagattttggttttagtaaagacaaaattgtttctatcataggggttgaaaatagagagaagttactgcaagattacttgagtttgatcatagtgaaaatgaacgaatggctgttcaacatcgaaaagaatgaacaagaagcttttattaaaagagaggaacctcctgcaagagatgaccaaaatcacttcagtttaccgggagccttcatagtatttcagatgtttcaacaacaagcaacagttgcgacggggtcaggtcaaggcttaattttggatggtgtgattaaacatttttgttcattactttctaaaagacaaaatcaatgggataagttattaaagtcacaactcaacagtcagattcagcaaatgtccgaagatgccacggatgacgaattagacgatacctctaagatagctccaggattgatggagtacattattgcccttgctaacgatcagatcagtggctctgaaaagcttgaaactatagagactgaatttgttgcattagtgtcgaaaaagtaccaggtatccatctctacagagattggtagagccattgatgattgtgccgatttagctcacgattgtctgaaccatatcttggcgttagtcttttttgatgtttcggagttggtctccaaaacattcagcaaagcttggtatccggatggatcctcttttctgaatgaaacagtagcatattttgaagaatatgtccatgagttcatagaagagatgaaaccagatctattggcaagtttccttcctgaacttttgaacaagacaattttggaatactttgcatgcttgggttataaacgtaagttcaaagaaagcaaagtttttgactgtgttaagcgagatgtacagattctttacagttttttctcccaatatatcgaaaaggaagaagttcaagccaagtttactgtctttgaaatatttttgcatatattagagctggagaatgaggctgatattctggaagtctggaaagaatatttgcaacagtttaatgatttaagtccacgattcctagaaggaatccttgcttgcagaaaagacttcggaagtacacagactaagaagatagttgcagaggtggagatggtgaataggattttcgaacatgagtactctgattcttttgaggcatcatttatgggtaaattccgactagcagagccttagtagtagtaatgtgtgctttaatgttaaaactgatgctttacctatatctgttgtattgttgctgctcttcgtcaataagtccgagagggcgccgcagattgttacgatcaatgttggctcctcttttaagcaactctcttggtccttggatctgagcttgttgtgactttgggcttgataattgcggatcctgtctgctgtaaatttgttgtatttgtttttgttgctgattcctgttcaatggcttttgattgtattggggacctagaattttgctcaatgcctgttgcacctgttgttccagtacgaactgaaattcgttcttgtatgacttccttatttcctctacttcttgttcaagcaactttctttgaaattccagttcttcattcagttgtttcactattccctcttcgctcaagattaacttgttctctcgtattttcagtttgcgttcacgctcattcaatctgtcctcccttatctctaaattaacctccttgatatacacattgaagcaactttcctgaagaagttcgtgagtagatggtcgttggttcaggtctatggttatgcaagcattgatcagagatcttaaccggggtgaaaatacgtccggaagtggagggaatgtcccttcttggatcttttgttgtaattgtaaatgtgtagtggcttgaaaaggaggcctcaatgcacatagctcatacatgacgcacccaagagaccatatatcacataatggtgagtagggttggtccaacagcacttcaggagacatgtaatacggcgtaccgacgtatgttttggcaaaatcgttttcttggtccagaatttttgctaatccaaaatctcccagtttgacaaggtttgaattgttcatcagaaagatgttgtcgggttttatatccctgtgaataataactcttgtcgagtctacccacgaaggattctgggttcgtctattacctttattgagcgattcaaactcctttgaagccgtgaaatcagttccataatgacaacgatacaatgctaataaaacctgcgtaaaaatactccatattttttcttctgaaatgtactctttgttccttctatgtgttcgaatcagcttggagagatctccaccatcacagtattccatgtataaattgacagttttattctcagaaatatgttcgtgatgaaggtacttcacaatgttgggatggcttaactcactaagaattctgaactcagctatcacttgagatatctctttggcattcatcttcatgtaggatacctcttttctgacgaaccactttccatctgttttcctttcaaccttccatactgagccaaaagaccccctgccaatgagctccaaggcaacaaattgactactcagaccgacattcattcgttattgattttaaatcaacgataaacggaatggttacttgaatgatttcactttatgatcattgtttactaattacctaaataggattttatatggaattggaagaataagggaaatttcagatgtctgaaaaaggcgaggagggtactaatcattcaagcccatttcttgccagtaattgcttcataagcttcaatatacttttctttactcttgatagcaatttctgcatccatggctacgccctctttgccattcaatccgttggccgtcaaccaatctctgagaaactgcttatcgtaactctcttgcgatttacccacttggtaagtcttttgattccaaaatctagaagaatctggagttaaaacttcatctactagtaccaattcattgttttcgtccagtccaaattcgaatttcgtatcagcaataatgatccccttcaaaagggcgaggttttttgcagcagaatacaactcgaccgccttgacagcgaccttctcacaaatgtctttacctacaatctcagcagcttgttcaatagagatgttttcatcgtgttcaccctgttcagctttcgttgaaggtgtgaaaatcggagttggaaaggcgtcgctctcttgaaggttctcgttttcaaccttgactccatggacagtttttgagttcttgtactctttccatgcacttccagtgatgtaacctctgacaatggcttccaaaggtatcagtctgtgcttttttactatcaaggatcgtccctctaattgagatttgtatttttcttcagacagttttgatggtagtaaagcaaagacttccttgtcattagaagcaaccaaatgattctttatgtagggtgccaaaaaatcaaaccagaaaactgagagctgagtcaaaatctttcccttatcaggaataccgtttgtcataatcacatcgtaagcggagatacggtcagttgcgacgaacagcaagttgttctcatcgactgcataaatgtctctaacctttcctttggcgattaaaggtaggattccgtccagatcagtgttcacaatggacatacttggaaggatacagcaaagtgtgttggaagcgatgacacatggaaaggaatttttcgagtttcctagagtagtatattggggcggtgaaagttcagatgtttaatgcttaatactcttatactcttcaaagcgcccaagtgtttctgccaacctgacttttttctgaataatgaatcgttcaagtggagtatttaaaccatgattaagttacgtgatttggcactggataaggtcgaaaaatatccgtattcataaacgattattggtaaaagttacaaaataccactaattacggagaagcttagtaacagttatcatctcttggtcgactctccagcaaaccaaattgcacaaaacgatagcacccgtctccatgccacccatctaatgttgatcaacgaatcatgttccttgcatgtaagcttctctgtcattgaatcaactccggcaatttagtcaaatccatacaccaaattatccctaagaattacctcatcgggtaaactttagagctggggtagataagatacacgccaagttcacctggggagattcaagtttacgttcatttttcttctcaaatacagcaatccatgtcaaacaagggcagtaataacttgacaaaactcaagtatttactcgtcttgctcacatcacacgatgaagttaaagaattactgaagatcaatctcaagcagcttgaaaagcatgatctagttgcattggaggaagtgcagttgaagttgtggaagatgagtggcttattatcgactgtagaacagtcattttatgagaacgacacaacaggaatactaaaagtcaccataaaggcagctagaaacttcaacagatggtttctattgttgtttggatcgttgggcgtaatatttaagatcttaagaaagttgaatattgcaaattctagaagaaatttaatgttcaatgatcgggtgaatttgctaaaattttctacatcactgggtctcttattttcagttaaaccattgttcaacaagattcttgacattttcgcagagagctatttaaaagtcactgagaagcaaaagtttcttttcaattcagtcgtttccagtctattcacatcagtggtgtcatttgccctgtatcccagtaaaatatattaccaaaagaattatgcatcaatatattttacggtattaatggtagagtatggctataagttcttggaacaggtttaccccgaccaattttccaaagagacatcctctatatacgttatcaaggattctgatatgaaagacacagacaacgctgaattcgaagatcaaccagaaaatagttgtttcattcgtaggctcaaagcgctaaaaagtgttccaaagagagacaaactcttacgttcatggtatctattcccattatgttactcgcagattttcaagtcgtttatcatggattacgagaactgtccagtatatttcaggaacatcttaaactttatgggtgaaggcctattagtcaaaagaggaacttctcgcatggtttcatctggtgatatggtcaaatctttctatgaactggaaagcataattggtaagaatagcatgaaaaatcgatttgcatttgatctgagaaactttctgttgcgatatttgccaagaaaatacacggtagtccttgaatacctctttccatttttcttctttatgaacttgagacttagcacggaagaattggaacagctgaaagcggctagcaaatggaagtattacaaacagatagtcataaaaagcgtaaaagaaagtctcaaactctccttgactgttgttactgtgtcatccacgtcgttgttgatgtcatattacacaagaaaagggcgaaatccatccatgtcatggatatggaggtcactcaccaaagtaccactcatgttcagactgcatataattgggctactttctgggtttttagtcgcattttattccaaaagacctgctcaagattccatagatctggatattgagcaagagtcaaacttggaagcaactgcgacttatagatcgatatggttatacatcttgagaatgactctgatttcatcaatgaccaagcacaattcaaatgaaaagaaacacaactttttcactcttgataagatactgctaactctaagtttcactggcttaatatccataaaagatagcatcaacttgaaaaaagccgagttgccagaaggcttatcgaataacatttttggttccaaaaagtggctgagtgattcccttgatgtgataagcgacggaagtacactcacaatgtaactttagactcaaccttgtgcttttatggcttaataatattattcaatataacatcttgtatgattcttcccttgctaggcgccaatcttttaaactctcttgattcggcttgattcacttgatcaatcagctcctctaccgtgtttttccgacaatagcccaaaacttctctttctgcaaatttttcagtgagctctagttggtgattatcggccaatgtatcgtttacaacaaccaccaactttttacctgctctcagagtatctagaatagagccagttcctccatgtgagatcacgagatcaactttggacgtgtaattcttgacgaaatcagtatcaaagctcaatccttggattaaaaagccatcctttagctttatgttgtatagctgacctaattgagacttcttataatcttcatcggttagtttgttgatcagcgacagaaatagtgattcacctgtgggttgagttccatactgaacaacaagtttatcgaaattgtttttcttcaaggcagaaataaacttttcattgagagtcaattggagtagcgcaacaaatgtgacagtggctcctcctgttacaagtacactcttcatagaatggatgatatttctctgcgcttatggagtaaggtaggtaaattctgatcgcgcgatgcatactaactaatctaatcattctggtgtgaagactgaaactgccgctccaactagattactatcatctatgtaaatgagggaggctggtcgattgatgatttgaagttttgaggccaaattcaaaaccatttcaactttttcccgataaggcttgaaacactttagcactgaaccaacatacccgattcggtaaggtcgacatgaaccacttccagtcgggtcaattgtagctgaagactcgctgagcttcagaagagcaatgatagcacaccccaaaactacagacgctctttcaattatcgaatcaacaaccttaaacaatatctggtaatcttcttgtgaaggggcaaggggagcccagagctcaggtagatgtccttctgattcgtagatttcactaacaattgctcctcctaggctatacggaacgttaaatgcactagggatattttgccgacttcctttgaatagctgtttagagtcaattagcgacagaatagctagccttgtcaactctccaatatatcggccagaacacatcatttcaatcggctgaaaacatccaagagcaagagtcatatgtggttggttcgtttgaactgagtgatgtagtgcccagttctcatgcaccattttatcccagatggtactatgttgacacagaaaaccaccaaagaaacctagttcggagttcagaactactttgtcgaagtttccctttcgtaaaggccgaatctgttcctgtgacttttgtaatccaatcattttcctatcgacaaccaaagcacaattgacgccagtgccagcaactaatcccgttacgcagctttccaagtaattcccagcaacgaaaactgcaactgagtcatttatgatgctctccacagaagcatcaatcccgttcgatttgaggctgttttcgaaaagtgttttcagatcctgaccatgtgtcgactctgaaagtcgaaatcctttacccattgtttgtaggactgcctgggatgatgaagtttgttctaatgggaagctccaagatatgcctattcgaattgtatcgtttcgaaagtgagatcttagactgggaatgtttgttatcttttgggcaatttcatcaaaaaatttcaagtcaatcaccttatcactctcagttaatgtccaatctctttgataaagattttcgtatttccttttttccaagcgtaagactgcaattcttagagtggagcctcctaattctacaactaaacatgttccacactcattgccagtaggtgtagacgaattggtgcaatacatggatacattcgaggaatgaatggcttctttataagactcataaagattgctcgttatggaaacgacattggagcggtttataaaggctgtaaagtcagaaactgaaggtgaagaatgaaattgtggggtcaaaacaggaaccatgttcgttctaatcttaagttctttacttaagttcagtctctgcttcttcgttagcccacgccacttctcctatagattcatcacgaaacgtaagaaaaaaaagactggtaaagaggcgtattcctgttaggtttctgtttatggtcaagtgacatcaatcttatcttttactcgaacatttcagattacctaatctattaattgcaaaactaactgccaatctatgattcatcattgccgattagaagatcaatttcattgaataaactgttgatatcaccttcaggaatatcaatacggccatcagcatcttcactattctgtaacagttccttcagatccacgtcactgcctagatagttaggattgttccccatcaaatcgtcattggttgcaaactggtccatgtcttggtcattatcaacaccaaagttctcatcggtgttctttttagattccatcgatgcaagaatatccaatgggttctttgtattgtcgatattagccaattctgaatccattgcattggacttctgcttactatcgatgttcatattgtcgacattattcaagtttgccatgccgttagtgtcgttgttatctgtaaatttctgtgtttcgttatcgttggaattaaaacctaatgcgtcaaaattggccatgccaccagtgtcagcagaaaagtccatgaactcatcaaagttttcattatagaagttattattatcgacagaaaacgcatcgttggacggtatagcaagctctacaggctgctcgactttgagtggtaggctgggctcctctttcacttctgcttttactgtactagatgacggtgccaccttattgagtaaatcgtttttcatttttcgtaacatgatctccgtgtctttaaagtccatcagatgttgggacagaagactattgtacacattgatatcattgttgagcctattccgctccacaataaacgcacttgaatggtttggtgttataatattgcaagtctgtgaaagcgataactggtcaaatatatctcccaaagaaagaaagatattattagcgctatccattaaagaattctccgctgtagacatggtagcagctgtaaactatactcgcagctgtgataatctaccttgcttttctccccttctgaatatcagatgaaggaattggcggagtctgcctgcacaggttgtttcctaccaaagagggaaaatattgtcgtgtaccacaaacaccacacattatcgaaaaagtaagattgatctagggccattagcgagaattccctggcctttttttccttggaaagtttcactctcgatgtgtattgcccattttcttgcgtcgtcgtttattggacagtgctcgaccaggggttcactctaaatattaaccttcaaagaaagtcagaaagaaaagcacaccaataatgttcagacaatcgattagaagcattactagaggagccaatttgatggccaagagaacttacgctgaggccgctgccactagcgatgttctcaaggtttctttggctctgcctcatgagactataattgacaataaggaggctgcccaagtcaacctacctggtgcctctggtgaactgggtgttttagctaaccacgttcctatcgtcgaggaattaaaaccaggtgtcgtagaggttcttgactctgctggaaagtctgacaagtatttcatttctggtggtgtcgcttctattcaaccaaattccaagttgtctatctcaaccattgaagctttcactttggactctttctctgccgaggagatcaaccgcttgttagctgagtcccaaaagaatgtatcctctgctgacgaagctgttgctgccgaggccgccattgaagttgaggttttggaggctttacaggctgttgtaaagaaatagatgatgtcggccctccatattcactgatcagaaacaaaaggaggtcttagaatatacaacaaaaaatataacaagaattaaagaatttgtgatgatttaataaaaaatgactattaggtttgtttttcctttctatctcaatcatataagggcaacttcttctgcttgaataaggtccttgactaacctataactcagcacgtaaatctcatcttgcttcatatcaatctcttcgcctccaataacaattggtatctcaatatccttcaacactctgataaacacgctcttggacaactccggactttctatcatggatatccctccgctggtatcgtcaagtgtgtgtaaagattcgggcagtttactgagaaattgcttattgtacagctctaccaggatctccaaatgcctattcatatattccgtttcttcaggggatagtttcttcaactcttgctcctcattatggatgtaaatggtaaatttgtcaattttatctaatcgagtcctcaagtaacttcgaaccacgaagttgactctatctaattcactttctattatgactaacaataacttgatatctttttcctccgagctttgcaattctatggagtttagttctatgaattccatctgttgtcggattcgcttcagtacacgttccatgagatctacttcgtaatgcaataattcaggcgaagtcctttcatttatccatgctttcttgagcgattcatagtcctggcggtagagtttactttgtgatcgttgtggtcttgaagtttcttggtcaaatgctttgagaatatcgtcgatatccatggtaacccaggtttctataattcacttctcgtttgagccgaatcgatctatgcgatctgatatatacggaacatatttcgctaatcttatattttgatacacttataatgtccattaaccacagtaggaaggcggagttggaggccaagaaggcccgtttggaggagttaagaaaacagaggcttgagaggacgggaaaaacaagctcaatccctgttgcctctcaaagcataagttctgttgacgttttggtagacaaaatacttcaggataggacccaagattctaatgaaaaaagtcgaccaagtcagccttataaggaagcttccacacaagttgataacctcccagagcaacttgaaatcaagcatgatatccctgttgtagaggagagaattatctttaataaatcagtccagacggaggacattgattgggaggtgtctgagaatggctatttccatagaggtcaaggtccacagcagggccaacatttacagcaaaacaattctgaatctccacaattactggtaccatcagatcagatatctgaccctgaaattgaagaagaacgtccgttcgatcctaaactgacagaagaaacagaagaggatgacccgttggtatctagtctcgccaactctctaagaattgcagaagaaacgctacaaaagaagtcaaataaagacaaaagttccgctgaaaatgatgaattagttcaaaaattacaatctcacgacctgattgttgatttagagcttttcgatcaagaactgaccgaatctagatcaatcttatcaataaattggtcaccacacaatccagcattaatcgcagtgtcctatgcaccggcatcaaattcaatcaactcccaaggaatggtcattctttggaatataaagtccgccaacgcgccagagactattttgaagtatacatctcctgtttcctgcgtccagtttgccaagcacgcatccaatatcataatagggggaactgttgacggaaggctttgtatatgggacttgaaaaatttggatttgtctcattacccaacacaaatatcgataagcgacccatcatctggattgtacactggttcgatcacacagattgtggaaatttccagtcgaaagtcattcaatacaacagcaaccgatgtggtgaccgcttctgcgtctggggtcatcgcaacgtggtcgatacacatgctgtctagtccggcgtcaactcctatccgtttagttggcaataactcatcatcagttcgttcaagcgaacccataccagcgtctgctatgatttgccttccaagtgatacaggatacttgcttgtaggctgtgaggacggtttcatttatcgagttagaagatttgaatccatgggattgaaagctgggatagaatcccgtttaaaagcgcatggaatagggctagtcacttcgctttcttttcctcagctcaataactatcctcatgaaacgaatgatttcagcaaagtttttatcagttcagggcttgatttttcgatcagacttcatcgattaacagcacattcgatcgaagataaggatatagatagttcgatactgctgattcctaccgattatgtaattatggatttggcatttaggcccggtttccctctgcagtttgttgctgtaggaaattctggctctgttgatctttatgatttgtcagaaaagtctgctctccctattgtaaacattttcccttctcagcaaaaagcttccaagaaaggtgactacataaaggaaacatacgattcattcgatgaacttagcgatgtttccatagggtttaatagagtttcatgggattcttcaggtgcatatctggctacagctgggctggatggtaaagtatatatcctgaagtttcaaaatcagctggcaaaaatggattcagactttgacatcgaccatacgagacaagtcacaaaattgcaagcattgatagctggaactattgatttctagtcctctggttcacatcctgcgggacattgaagttccttgcaggtgacgaaccaggtcttcatacacccaaaatggcctctgtgaccacatgacaacaaactcacgaccatacctttgactggttcattgcagaagatgcaaccgtctaatgacttattacagttatcacaataccagtaaccaaattcaatgttagaattaccacttttcatcttttctttagacttttcattcaatataagagaattacaatgatggcaatatgtccgaaatgaggtatttgtttggccttttattttgaaaatttcaaacagttcggaggttgttttcaaaagctcgctggcaacagtgaataattgtcttcttcttaatatttgatcataggtatatagccaatcctttagctgtaacgttgataaagatcttggatacattttgaaaaatagaagcccaatagtgccactcatcgtcaaatcaccaaggctggcactatactcagcagcctcccttataataaattctggtgcccaaggaacctttaactgtgatagagaagcttcgtcttcctctttttgtttcatctcttcctcctctttccttttatccatagttagattctttggaccctcattcaatattttcgtaagttgactcttattactgatactgctcactttggaataagaccttctccatttcatacgagtgtcgtttgaacgttgatttttgaagtcattcgtcaatctcctcgtggtggccatcaagttaggaggtgtataactcatgtcaaaagatccaggagatcgcaaatgtggggacttttcatcgtcaaagtcaggttgcagtaatccttggtatgaatacgtcccaacagtagagggtagtgagccatacgttttagagtttttaccaggaataggtttggcacttgaaggaccactaagaacgttttctgattcgggatccagctccgagttcgtggtgtgcttggaagaagagtggtcatcgtcatcaccgtcaacaatagcctcttcaaaagtcatatcttgaggtctcctatcggtcattgtatttgatttcctggcaggaggcttccatgcatcattgaatgaatttctatgggagagtggtagggaaccttgaggagactcagcgtatctcgtggaatgagaagttgctaaagattctaatccagtgtcaatcgcagattggctatcatcatcgctgggtccgttgttattttgtgtaatggacttttctggatcatcactggattttgatccaggcattgtatcggcgtcctcactcgatcgtctaaattgatcccattctacactagctttaatggtcctccaagtctgggcatccctgaatcgattcacacttgccgaaacatttgcattgtactcgcagacggaaaaaatatccatatcagaaggaacagaagttaaatagttagcagcaagaaaattgaataccttatcgtcattaaactccaatgggacttctacgttgtagattataggagaaccctctctatcatcctcttggaaattggcaatgtttaccgactgcgaccttgaagtggatagtcttgatggtataggagatttcaactcgtgtagtccatgggaacttggaactctaagctgttgattttgcaacgaagctttctctagagttctagaaagtccatccgtggaaagatcgctatacatcttgggacgctgagcttcaatatgctcaatctgtcttaaatcctgagtagagtactctctggagaagggaaaagtagagtgggatacctcttcttttcgatcactctctgttgttaacttctgactgtctgacctttgcatagcctctgatgagggtctgctatcaaatgtatcactataatctatctcatctgattgaagagtgacatgatcacctgtctgtgaggaatttcttcctctggaaacaaagttatcctgaaattgagatacaaatgataaagaaagatccgagctactattccatgcagaagtagcaaccggcaaattatcactgtataaggaggaagtggtgagatcgtgctggatcaaagttttatctttcgaacatgaccaaagagtatcgggcttcttccataatatttgggtaatttggttattatgaccttctaaaagatattttggaacgtatctccgtttcaggttccatatctggatacaattgtcgtcattgtagtaacatgaagcaatatctgtattgtatatgtttgccggagagttttgacgagcattgcaccatgaaacttttccgacagcaccacttgtagatatcacatggtctggttttctaacatctagggcagtactggtcatgttccaaaactggatctgtttatctcttccgccactaacgatatagtcaatatcaggatgccagtcaatagacaagcctggcccagtatgagcattaactttccgttcaacctgatttggttgtctcatatcccatttttttataacaccagaatcaaaaataccacatatttttcctgcagttacgtttgaaaacttggcagctcttactgcatcagcgttcccttgaatggttgtcgttgctttagtcctcttcattctcaaatcccaaattttcaccgtaccgtcctgcgatcccgagagaagagcatgagaagtaaatgaactaaaattaagggagttaacacttctggaatggtcatttaatacattgatctgtgaaaacgaattcttggcgatattaaatgtatagatggctcctgaaatagatccggcagctagcaccttactataattgtgataaccaaaaccaacatcactgataaatccggcaccacttttgccctttgtttgctgatttttcttagcagatattgagttgatattatgaacaattgaaatattgttatccgtagctcgcaccacttgcagcaatttttgaccacctatagctagcacatcgttggattcatgtgacttgcacatgcagttaacttctcctgctgcaccaaatacaagctgcttctgagctgtctgtggtcccccaaatgttgtacccgaagttctttgtttcctcgataagattcttgtgggagagttagcgcccgcaaaagaagaaggactgtttccagccccatttccatagatattaaaagcaaaacgtgaaagttttccggcactagcagcattggagcctctattgcgggacccaaatgattgactgaccatatcgatgtatgtattactgggtgaagatgaaatggtattgacactagatgacacattgctttcagcaaaatcatcatgtgcatgattttgtggcattgtagcaaacaaccagagggaattcgcctcgtttgctgggtgtgaagagctgaacagatatttattcaggaccagtgttccctaaagttgatataaggatacttcgagaacacatagtatgatgtcggatggcagatatcagtttcaattatctacactatttgaactatttaccacaacactctccttttgcactatcaaaagccaatctggaaaccttatcctctatttcagccaaaggctgcttcatagcctctgaagtggtcatgacatacgatggtttaacatccaaagctggattctccaagaagaagtgcctgggtctcataataagcgatattggctcagatggcatcaacgggaaatcctctggagccggaaaatgggttaagccgaaggtgtgaaacattactaaatctgtattcgtgatgttgtcctctccatcaccaatccaagtaactatattctcgtaatcatcagattgttcaccagaccattgagtgacaaactttcctgagggatagaaacggtcatctttgtaaggaacgacttgaacagttctagtagaccatggagctctcttacaaacccaggaaccttcttgagctaaagcagtaggagtcatattggagactaacttgtaactcggtggttttccagagtaggcattcttcttgttagggttaaagaaatcccaggttctaccagtggaagcatttgcttgagtgagagagtctttaactttttcaaaagttgttttcttacagtaaaatccgttaccataaaagttctctttgctaccaatcggagcctcgtaagcagtaccgtcagacataccaatcgaattaccatcaccgtcgattcttggatgcacccgtagggcaaataagtgctgatggttatgggcatttactaaaggataaacctgagtaccccaaggaccagcatcttcaccttcagccaacacataagtgtttaaaataccagtcaacttgacatctaaaccaatggttccgtcttgatgaaagttccagtacaaacagtactcgtaattagctgcagtaaaaatttgagagacgataagcttggtagcacgagtaacaatggtagtttggaactcgtctctgaaatctgaatgcttatgaagcaaaccatcatcctcttcgtgaatgcaaacagcgttcggaacagagaaagctttgccatgtctatcagcaaagtgggcatccaggtagtgaatcacacccttgcaatcgcatcccaacttcaacggattagtcatgaaaccagcgccgtattcaccaatgtccagggcgtgttttctttggtgtggaaagtctggacatccatacggaacaatcatctcagctaaagacaatctgtaaaacagtggcctcacatttccatgatcattgtacgtgatatcagaaagaacgattccttctctgttgttgaaaccgatatgaaacttgaagttggaccattccaaaacgctaccatccatagtaaaggagacgccgttaggttgggaaatgctgatcgtcttcgaggagtctctgaatccaccatacttctcttttataccttgggtgtggaagttggcgtgtttgaacttggagagtgggcgacgtctgcttgggatatcaatgtagattatttccttggtgttggcgtccaagatagggcaaaaatcaagaggatgagagtactgagaatcatcttcattggatctgtagtacattaaagcctgctgcaatctccttgtagagccccatctttcatcatagccaatggcccaagggtcacagtaaacgttgtgcatttcagcttcaggaattccggaaattttgcattgttcgataacattagggtctttcctgacaaactcctcgacatcactcaaatcagcaacggttaacattggctgaaagttttccaaagatttcgtttcatacacagaaccaatgttcagatcgaccaagccctcatgtactcccttgatatcggcctcgacggcgacatagtaggcaacacgatggggtaatgcctcacccttttccttccaagcaagatagtcctgcttcgttggctcttttagagttattgtgttgaacgaaatggcattgtgcccattggtggagaaataatccaacacaacagaagaggccttgttgatctcttcatggctcagttgatccaaaggatggacagtcatttgattagattgtttgcttacgttaatgatttgcggactaacctgccggtatttatatgtgatatgtggttagcaaagaaaacgttcaaatgttggagggagataagataagcattagataagaattgaggaacatcgagccgcacaatagtgtgatcatcatgcaaaaagtgaaaaaaaaaaaaggctgtgaacaggagagaacctaaccgattcaaattttcagatgctttcattagaagccttttgatcagcaaggggctctcggtggggaacaaattgtctgagtgccgcctttgaaggaaggaaacatcgttcagagcggaactagcttgttggagagcaattggagcgtgtattgatcagaccttgtatggaactaacttcctaaaccagctagaatacactcattgtgttcttatggtttattttcaccagtgttgaagctgatagaggacacggatagagaataaagtcattcgcatcgaacttcctaaataggtagttaaatccgagttgtttacttcagtatttatctttctggggagcacttgcaccgacttgaaccgattggatagattagcaccaggcatttgtcattaagaacgaaccagattgacaacacgcaaaggtatgagaattaatcttaactggttcatttaatggtgtctctgatgttcccagcgctggatcgttggtacgaggttggatttcaagtagatgttggatgctagttggttgttatttgaatgttagacggtcgagttacctatcagagtccactctcacaaattttgctacacatgtctgatccctgagcgtttcatcgccttaaagcagtaatacccctgcaataaacatcaagttgtgacttccgtgcaatttcaaagaacgatacgcatcccttaattgccctagttaatcccgtttcattggtgacacacactatttcaccctgaccgcgcgttaaaccctgtagaatgtacacaacgcgtgaccctgagcttatataatattcacgcgccttacgtgaataaacgaaatctacccagagatctcccccttcaacttcaccattccttcccactccaaaaataatttgttcctccttagttttgtccggtagttgtcttcagaagcttttccattcattcgattctctattttgagcctctttcacaaccttcctaccccacaacataatgacgacaaggagacttcctcgaccaatctccaaaagagaacaagagatttacaagttgggaccgcccaggaacaccaaacctggagctacaaatttagagttggacaaatatgaacaaatttgcaacaggaaacttatcgatgagtacttaaacgatgtcttgcattaccatgccgctttagaggaattagatcctgttaacgcgaggatgattgacttgcaaccagagatcagttggtatatgcgtccttatctgattagctttctgattgaggttcatttatcctatcgtctgaaggcttccaccttatttttgtgtgtcaatttgattgatagatattgttctaggagaattgtcttcaaacagcactatcaactggtgggatgcaccgctctgtggattgccgccaaatatgaagataagaagtccagggttcctttgttgaaagatttagtactgatgacccagaatagttttgatgagtctatgtttaaagagatggagttgcatatgttgagcactttggattggcaaatcggccatgtgtctttggaagagaatttgcaatcaataatgttatgctttgaaatcgactcactaactgtctcccaccacgttacaggtgatcataaagcgcttcgaagcgcgctagtggccatttcccgttatctttgcgaactatcgctctatcataggagtttcatatgtgtttctccaaacataatcgctaccactgctacgctaatctcttgtacagtgttggagatatctaacggaacagaatttatagatgaccttgtacaagatatcctaagagataagcaacaacctgaaaattatgatattgatgatatggatgatatcttcttctcagacaatgaagatgaacttaatgatgaaaatgaaccctcatacaactctcgtgtcatgtgtcctccgtttgttaccaactttgacggtgaacaaacacttcgagtgatgaagttagtagcacttctatttttgacatgtatgttggatcccccggatattttggttgacaaatataagcctttgggtgtgatagacgtactttctggatatctttcaacgaagcaagatcacattcaacatcaaatggatatgctagatccttctaagctggactttgaagcctcagagaaaacatatcaacttctacttgagactaatccacaattactacaaacggccgaatggctactgagtatcacagaaatcaaatcatcaatctctttccagctaccccacactccaaaccaagaagaatcctctgaatctctttatagagatacaatttactcgcttccaaaatatcccgacacaacaaattacactgccaagagctcaagagatacgttaatgttatcctcatctccttcgatgcctccactcactccaccatctgtcgcatctacgcacttttcaagttcttctatgagaagcccatcccatgttgtttcctatgaaaacaaccctgccaagaaacaagtgattacttatccgtcttcatcaccgatatttaattagttatacccttagcctaaattaatgcatttattccctctactaaatactagatgtagcttcgctgggctcgtgtttggatggattactgaacacatcgtctgcctcattgtcagtgtattccccagtattaggctctaggttggcctcaggctccgattcggtagggcgttctgtcttacttccaacttcatatgaattggtagcagtcctcttgtaaataaggtcagtatggttcttattcttacgttcaaatgaagttgcttttttcctatttgtcaaatgaatcggaataggagcaagctgaggacctgggaggggcgtaaggggtgatgaagaatcgggggttgaagatcgggaaataggttgaaaaggctcaggagatcctagggtcgaactttcatctccgcttctgtcccggtacctgttcctatccttgatgtactccaaatggtcatcttcataagtggactcaatgtaggtttctcggttgaagatgacaaatgcaaataaacacagccctgcaaatatggtgaagaaaattagctttttttgaaacaccaaatcatcggaaatggaactgattagctcaatattctctacaagtgctctttcatgctccgttttgcttccggctagaagagtctcaaattcaaccttaaaatataacttaagatcatcaatcagttgaatctgattctggattgaactattgacagaatccaacattgcttcaaaccgcaaagactgtcgttcttccaactttgagaatgcatttgacaacaatctgctttgctcttctatgtacaacaacgatagcgtagcgttagattccaataacgaaatcctctttattatattcttgtagattgactcctgagttttgggttctgaagaactcagcggaggttcgattgatatatgatctgagctttgctcatctttctccaaacatatttctttagagtgctcagtcagaaattcatccagtgaaaaatgtttgaatgagacaggacaatcttcttcattttcatcttcatctttcagaggtttaacttgagctgattctgggtcacaattagtttttgaagaattcttacataatactgtgatgttcttcccattaggggatataaacttattctggacatttgtttgattagcagcaattgctttagattgagttgcaatattggtattctgaccgttttcggtgtttgctttttcttcttcttcaacttcttcaagcttgaatttctccatcattgtttttccatgaactcttactagagacagggggcagtaatattcatttccatagtgagataaaatctcgattttcaggtacctggcccaaattaaagggctctcaatgttgaaagtttgaatacttctagtattagaagcatcgaagtcacctagtactttccatccattggctggaactgggaacctatcactaacactaaacctgacagtcttgaatccagacgaaaaaaactcatagtttgccaatacgacagtatcaaccagaatatcttgacagagttccacaacggcatattgattggcaacatcacatttgtttagtaagtaggagtctttattctcgttcaggatagaagaagctcctttggcttccgtattcgtctttactatcgttgccgcacaatcaaatgaggcgtaattgaatctttgctgataaacttttccgatttcatcatctctatcaactcccgtgaacatttccaggtcaatctccatatcttcacctaagactccattcaattcattattcctgtaagatctttcaggttctctatagacattatgacttttctgatcatcttgaattgctttatcgtttctagtattgtctatttttttcttcttccactcttcaaaagacataaatcgggaatcttcctcctgttcagcttctttcaaaggattgctatcgtttaatttatcatcattacaaatacaactggacacgagcaatagaagaaaccaggcgaccaacatggtaacgctgtattctagtcagcccgtgagttatcttctatggtaagcaagataaaggatagagccttactgcagatcgcataataattgcgtgcgatgtcagatgctactcacccaagagcctacttattcaccgtgtcacgtggttcgtatctttgtctaccttaatgcactatgcaagtctgggggatatctgaaacaaagtccctctagaaattctacaactaaacgaacaaaaacctagttgccccctactttccttctgggacgtctaatggtccagcgctttttcaatggatagtcaaacaaacaaggcgaaaccatcaaagcagggcaggcaaggtgacaaagttggattcggggtaaataattcttcctctctggttgacctcgaggcacttgctatactgacaaacaccaagccacaagcaaggtctccggacaaggataaacagaatgcgggctcaaccaaaacgaagtcaattcgttcttttcgatttcccttaaaaaacaccatgagtacgtcaccaaacagattaagtacaaagaataagaccacaaaggagtcgtcaaaaacaaatccagcactaatgaaacacttcaaaaatatgagttcccctttcaaggcttctccattgactccaccttcttctgatgaagcgttctttcgttcctatacggacggtagattaagtttcacttccccttctgagagaatgtttgctctttctcctgtatcaaacaattcgccaacgctaaaacccaccataccacctcttccgccaaggattaaaccttttgttcagaatagcaagtccaagaaaagattagttaatgagcactgtgtattctgcgatgagatgttttttacgctcttgagaccaacggaaaatgagagtcccggtactgactttgagagaattattgagtttgaatgtggtcacgtttgtcatggaagctgtctgatggttgcggtggagtttcaagatgacacagaaactgagtttcctagttgtgttgtttgttcttctccatgtctaattgatgataaacagtttgaaaggaacctaaagtctgtcaagaagaagacaaggcaattctcgccaactcattcgtctctttataaaagaaaggactctacaaatgaaccagaagaaggttcgggtattttgaatgcccttaagaaaacagttattttaaaatctccaactacccccaaggtaccaggtctgcttgcctcatttgaaccagtgccaaacagagatgttgaaactcgcagtagaaaacatgaatcgaaactttcaaggggctcttcaatatctgcagtttcatcattagtatcttcggctgacagaacatctcccacagagacccattttactagtatgactacaacttcatccgtgcttgacgcccccatctacggcattacagcatctacatcgacgttaactgaaagcggagtcaggctgggtaattctattcaactgaacatactaagatcacaagttatcaaaaacctcctggatagtaaatgtgttcttactgagtcttcgcaggtgttaaatgagatacttatcgatagtcttggagttttgagaatggttgattacttgtcaatagccgaagaaatcgataaatggaagcctcattttgtttatctgttcgaatacagtttattgcttgttgaaggagaatcggcatcttataaactgatcgaattacagaactctgattcatccaaaatatcttcatcggcgagagtagcggattcggacaacgtctgtgttaagatctctacacccagtgcatcattaattaaactagagtgcctttctggggaagtatcatttacgctaacttgcaaatctcaatccgtcatagaaaaatggggggcagtactgagtaatttggatattgctctacccattgatcttttttcttcaactcttgacatctcaaaaccaaacccatcctccataggttttgaactaattacagtccaagagtctgatgtcagaaggtcaatagaattgattgaacttaattcctcaagcttcaataatgatgtcgaaggtatttttttggttgttaacgttacaaatttcaaagcatcttctctacttattctgaaaaatatagtgagggccttaattttggttaaagaagaaatatgcctggtcctcacttcttcttcaacgttaaacagctatacctccgtgttgacagataaattattgtacaggaagggacttaaggatgaaaaagataagattttgaatttggttgaacaaatggaaattttagagccaactgaaagacagctaaggatgtcatttgataactttttagctcaaactagcttgtctaatcaagacatatgttgtattgttctatctgatgcgaaccttgatagtttcacctctcccgtcagtcaagctattttattacttctagatgtgcaggctcgtcacatcaacaactttgcgacagagaagagcattcaaagaattggtacctgggatgaagcaatggaaattttatgctctcggctggaattggattttgataatagtgatttcgatagctcatcctcgacatatactagttcagacgtagaggagtccaactcggactcgtttaacgattcagactcatcagtgagaggtttaaatattggaacggaagggcttacttgcaatgaagtttctggccgtgacaacaacgataataccaagtggaataatctcattgaggatattgatacagcgctgggtcaaatttaaatatacattattattgtgagtaacataagactatttattttttctccaattcagccagtttcttttcaaactcctccctagtttggtcacttctccatctcagatcataagcaggatgatccttatcaacgaactttcttccaaacacgctctctctgaaggttccacctggaattttataatcatcccagaacacacctctcttgttcaactctggaagcagtttttcaatgatatcatcaaaagtttgggggtaatctgcgtaagcgaagttaaagccatcgaggtcagagacttctgcccatctctcaagctcgtcggctatctcttgtacagatccaacaagtaagggacctgagcctccaactccaatctgtttagcgatatcttttctggctctaggcttattgtccttgaacttagtccagttcttaacatggctcttaatagcgttagattccacatgctcaagaggttcatcttcaccatactttccaatatctattccagtccaaccactgaacagtgcttgggccccttccagatcagcataactggcgagatcttcgtatctcttcacggcatcttcgtgtgtatcagctatgactactgttatcaaaattaagaatttgattgaatctcttggtctgttgtacttggtttcagcgatatctctcactgttttgattttttcttggagtgactctgggtcaaatgaagctaaaaagacaacctctgcatgttttgcagcataatccataccaaccttggaagtaccagcctgcaaaatcagcggtagtctctgaggagtgggtggtaggaactgggggcctgggacattgaagaactctccaacgtggtcgatagttctaataagttttgggtcagcaaaggttctggttttcttatccaatttataagcatcgtctctccatgaagaaaggaataaccgatatacaacttgtaggaattcttcggctctcttataacggtctgcatggagagggagtggttctccattcaaaagatttctggcggcactgtcaagatacgaagagacgatattccagccgactcttccgtttgtcagcagatctaaagttcccaatcttcttgcaaaatgataaggtgcctcacttatagtggaaaaagtcactccgaacgttattgacttggtagcagcagccatggcagtaactgcagcacttggttcaatcattggaaattgggcaccagattttgcagcagcactgtagtttccaggtccattgtaaacgtcatatccacccagaacatcggcaatgaagatagaatggaatttggccttttccagcttttgagctaactccacccagtaatctagggtagtatactctgttgatttgtctccagggtacgaccacagtcctggcgattggttacccgaagagcctgacatgaaagcattgataatcaattgcttcttcgcttttggttgagaggttttctgcctcttggcttcattttccttggtcattttggcgaaggggatgctattcccttctgaacggactcgaagcctatatttatatttcactatttggagatagagaatcctgcatgtattatgcaattcacctagagcacctgacctagcgaaactggaataccaatttgttgtggcgtctgggggttaaatcaagtaatttagaggttgggagagaattcagtatcgcatgattatcttggccaactgtatgcgagaataaccttggatcctatctgtttaggtttggtcggctgagtcgccgttgcccggtgtttggtatttgggtttgctcgatgcaattcaatgtagctacgggtaacgtgcggcgcagagttcttaaactacttacttagggacttttcgaattcttccttggacacaccagccctccatcttaagttataagctgggtgggtagatggtacaaagtctgttccaaaaaggtttttacggaatgtgcttccagtttctggatttgggtattccttttgggccaaccctcttcgctgaagaactggaatcaagtcttccactatctcttcgaaagaaagcgggttgacagcataagtgaagttgaatccgtccaaaccagcgtggtcggaccagtgttccagctcatcggcgatttcttctggggttccaacgaaagctggacctagaccaccaacggtaatctgtttagcaataaccttacgtgtccaacgcttctcatttggaattgctttagtccagttttgtacagcgccacgcatagcattggaactaacatttcctagttcttcatcttcgccatattgagagaggtcaatgccagtccaccctccaaataaggcttgagcaccttcaatatcaccataacttagtaactcttggtacttttcttcagctagttcatgtgtggctccaataacaggggttgcaagggcaacaaacttaatatcgtcgtggtttctaccaaacttttctttggccagttgacgaacttctgcaatcttgggtttcaaatcatctggagaaaatgaaatgacaaacacaatctcggcatgcttagcagcaaactccttaccaactttagaagtaccagcttgaagaatcacaggcagtctttgaggggtggggtcaacaatatgtggtcccggaactttgaaaaatttaccttcaaagttgatctttcgaaatcttgttgggtcagtataaacaccagctttcttgtctaaaactactgcatcatctctccaagacgataacaacagctcataaactatttgaatgtactcttcagctttcaagtatctttggtcatgctcgtccaatttttcaccattcaagaggttacgagcagcactctccaagtaagatgaaacaacattccatcctattctacccttggtcaagtggtctaaagtggacagtcttctggcaaaatgatagggggcttcgctgatagtagagaacgtcactccaaacgccaagttagttgtgactgcagccatggcggagaccacagcactgggctcggtgacaggccactgggctccagccacagcaggagtggctaaattctcaggtcctttgtagacatcatagccacccaagacgtcggcaatgaagagcgcattaaacttccccttttcggctaacttggccaaataagtccagtgatcaatctgattaaatctatgggatgagtccttgggatgcttccataaaccaggattctgtaacccagcacatcccatgacaaatgcgttgatcaaaagtggtttgcgagttttttgtcttttctggccgtttgtagtcataatttgtaattgtagttaagttgaagggataagagaacggaagggaacttcatcccagtatctctccatctgtgctcctggacaggggaggatctaccgtggcttcggtgatccaaaaaagagttcatgtgccagaacacctaactcaaaagccattctcggatatcagccgatatcagcacatttttcatcaattttgttagttgatcgtcctcaatatttgatgccatagtgtgcataattttggaatgccgatttattaggcggtacggctcacgaagctcaatttcttggtgtggcgtatgcaatattatgcacgagatgcataatttgtactatccccgtgatcttgctttttttcttcatagcgattgattggttggttgcaaacaccatagtgataaaaacagcaatgtgtggttctgaggctttcctgactaaacgatgctgctcttcggcttttcaaatagctcaatccttttaagtatcatgtttggcctgaaaaaaaattggagggaaaaccagtagaccattacgaaaaaagtgagaaaaatggtaacggccacaacgacttccattatcagcgaggaccgtacaaggggtgctgatattctgaagaaggccaaagatgaattcccgacacctgaatccactgtggtaaagaaaagacgtctttcaagtgtaagctcggactctgaagtggttgagaaaagtttcaagaaacagcaaaagaaatcactaaatctttccgctcctttacttgaaagatcaagatcgcaatccgctttggtgattacgcactttgacgatccttatgatttgaacaaggaacacccctatccagaactaagaccatatgaggttctcataaaaaataaggttgttggtttgaatcatgttgactggaaggccaagaaattcaaatttgcaatttactcatttccttgggtgaacgggagagaaagtagtggagttgtagtatcgcatggaacaaaggtggatgacactaagcttccagttaatcagagagtatttattgtaagcaccagctatagagacattcgtaccagcacattccaagaatacacagcaatagactcaaggctagtttggaaactcccagggagtttttcattcgaaaatggtgcaaccattggagttggtttggttacatctggtatggccttccattcttggggatatgcaagttcaaatgataggatagaaaagaattccaaaactatgttaatttggggaggatcgtctgttgttgcactttacgcaatgcagtttgctaaatattttggattcaaagtggtttctattgccagtgaaaagaatgcagagtacatcaaatcttttggttgtgaccttgtggttgacaggcacttaggctttgaaaagattgaggaaatcattcattcagaggtcaaacatattgattatgcattggattgtgtttccagggagacttcggagttatcattgaagctcattcaaaaagtcaacggagaagacgatgactctaaatcgtattttataccacttgtcgcaaaaccaaaagctgaaataccaaagaatgttcaaatggaagaagtctttataaaaaagttccacgaagacattaaactgggagaagagtttgttaacttttcgacttcattgtttgaaaatggcaacctcaaacctgtaaggcatagaacatttcatggaggtttaaagggcattgtagatgggttattgcaattagaagagaaaggtgcgagcgcagagaaatatgttgcttcattctaatatattatatcgagtaattgtaagttcagtgtaatggagtcgctgtaaacaaattccacggaagaaagagatagaatcagtaaagccgacaatttaaagttcaactttagtagatagcagcttcttcagtccaacatcactggagaccttcgcgcgaggttctgtgatgcgtctgggttctagagaatgaatggggtacagactacacatacacagaacaatcattcactaagttcactcattcatgacacaatatgatgttccacggagctcaagaaaacttgatgagaaatacgaaaaggttcctctttctggtggaagttttaccagttttcgacttgcatattgctctccctccgaactttgggagtcttccagagtcctatttttaggtccagtgcctctagctctgcttgaaggctatcgatcaaaagtcgttcgaactcttttaaagcacaactatcgaaagtcggtcgatactgtgaaatcacagtttgatctttggttccaggataccacgcaatacagtgatgaaacaaactcacctcccggttcaagctccaagaagtatgacgaagattgtagggaacttctaggtcactgggaaacggatgatgaagaatctaaagaagatactcaagagcatagttctttatcgcagattgatttaagtgcagattcaattcctctttcaacttctaccgtacaaaagcagttggaaagttgccttcagttgaagagcaatgctgaacgctcacaagctcttactgattctgattcatctcataagcatattctaccacttcaaaaggttgccggaccatctcgtgaaaaagtgagtgaatctctcccaaacactgaacttacaggatatgtgtatagagaggtattccacactaagctcgcaaaagaaaaagaaagatatagctcttctgacatggaaacctttgctacggccagggaaacttttgaaaacatcaacaatagtacaccccaaatggatttcgaagatgcttcttcctttaaagaacatagaacatctgtaaggtttgaatctcaagagaaaagtaactggaagaagaaagacgtaattcaagaagtctttccggtacctgaaatgaatgaatctttgatacgattccatttaaaggattctgactatggactgttgaatcgtctcaaggaaggttttatgagtaaggatcaccatttgaaacgtaatttagtaaaaatgagccctaaactgcatttgaagcagatgtttgcaggatatgaacatggtcaaataatgaaattggaaaagatgttggtcttagtaaaggaaacttctgtaaatattcctaaatcagctcttttcgaagtcacggaacttgaaccttatgacacccgagtcgtccaaagatggaaggaatatattgttgggttacgatcaataaataatgaagaagattcggtaatgcttcagttctactccaagagatcaatagacaaaatcgaagagattaattttaccaggaacaacttggatttcaaaatgaaccactataacaccaaagtcgccctatacaataccctggataaaactttatctgtgtgcaccaatgcattcaaggacaaacctaacaggatatacattttgaaatgccgtacaagatcttcttcgactcggtggctcaatctcttgaatacagtattaggaaagaaaaaaccagattttttttctgtttctctcccagctttaaatatatcgttggacatgtttattccgacggatacttatcgtaagctgttaaatgagagtctcgagtttgaaagctccccaagagtcttttataaggaaaaaggttatgcaatgaaaccgcttccttttctagaatatattggaaaacttgttattgactccctgaaagacatgaagaacaaaaaaatcatcaatgccatggagtcattttcagaattgctcaattttggttttacatataggaactatgaccgcttagaatggtttttggaggaggatctaaaattgctatatgcaagctggcccttatgcaaaacacatgtgctggaaatgagaaaactagaacattatcctcgtgaagtgaaaagcgatcgactcttgttacacgaaccttctcctcttgaaggatttctagttcgcttgacttccagaagtaatagaaaacgaagcggtttactggcgagacctgtttacaagctagaatatttcttcaccaatgataacctacttttcttttccagatactacaaagcggttcctccattgcgatcatttaaggtgtttatggctgaggaacacgatatggataacgactccttagaggacttggctagcagagatgaagtttacgaacattgtccctacccgattgatgatgacgggcacataaagtggctgaaacctggtgtttctgctcatacagtccaagaaggtgatttaaaggcatcggatgaactaaagaggcgaatcatctcacttatgaagacggagagtgctatcaacttatgcgatgtcgtcgaagttgtcccagtaccaccaagtagagttccagcaatcgtgggaattgcaaaagagctaacttggagagccattgtttctgagcccaagaatcaagaggacaacacttcatttgagttggtcctctctgataacgctagagtgatgttaactgcagccacgacagccgtgagagatttgtgggtatcaaaactcagtgagctaatccagtactggaaattgcggaaacgcaaagatactgttcagatgttggaagtatgtgagaaaaacctcaagactttaaagattccacgcaatatggaccagtttgtccccaacggcccaatatgggagagttcaagaggagaagcaaacactaaagcctataatatcagccacagggtactctctagatccctagttatgagtggtatactatatcaaaaacctaagaagcacgccaacttcagaaagtactttatcgttttatgctccggatatctaattctgtttcatatttacaagaggggttttggagctagggctcaaccgacagctttttattctcattacctgtctatccccatcaaaaactgttatgtctatacgggcactaatacctctttagaccttctttccaaatccttaaagactgaggtcgatacgaagggatctcagggtgttcctcttttgcatgatgatggatggtattccattgagaacgcttcgtccagatgtttcactctttggttcggaacaaagagattgataagtggaaacgtggcaagaaaaatggaagaagggcgaatctcgattgctaatggaacaggatcagttcgaaacccaggtatcattagaactgcaagtaggttaggtgttacgggaaatagtatggtgttcatggcccgatcaaggcaagaaagggacatgtgggtcactcgaataatcaatgagatagagaagctgagaggtccacttggtgagcagctttcagttctataggctcagcgctctttcctcttttccaaggtccgcattttcatttcactattcactgttgtctttcgcacttttcatctttaggctggaaacgttgcttaccagtcgctggttcagcgctgcgtgcgcgcccttctgtcaaaggtaaacaaacgcgctttcacggtacgcgtaccctttagaaaatccatccattcggttacatattttacttacaactagaattggagcgtccacctttgtactttgactttgacccaattgttttcaactgcgcaatttttttacgttctgaacaacaagagggtatttttttttgtgttcagcctagttgttgtgttcttctcccatttcctataagaagcagaattccagaaaatttcattctacttcttatttgacttctaattcatccacaaagcgactatatggccccaactaaagctagggcaatgccgtcaatgccggaaatggcatattgccttcagggggattcgcctgaccaaacacaacttgtcactctcaaggttctttacatgatcgacaataaaaccacctttctagcaagatcaagtctgccaactactgctagaactgcgaatatacatatacaaggctccgaagaatcgatcaaagtcggtgcagtaccattgaatatgtgtctgcgactagtcatggaaactagccccgagttattcagtggccaggatcttgattactcattgtactcgaaggatgtctcggaacccggtgaaccgtttgttggtcatggtttatattcaaaagtacaaaacaatggcaacgtgcttgtaagtggcctggtatgccagtcgttcatgggtatcttcaaccaaggtgaatcctcttctgtaagcgatacattagaagtaagacttcgactatcccgcatgtttcgtgtcaaaaatgacgatgaacaagctcaatctgggcaaaacattgaactagatgatcaggaatattttcaaaggttccgaaagaggaaatccgttagtaaagcgtccaactctaaagagtatccagtaaaagctactcgaactcaatcaatgccccaaacatttataggcttgggcaatataaataccatcccacaacgcataaaaatggcagaactagaaaaatcttcacaggaactaagtactattgatgaatctattgagcaacgctttcaaggtactaaactacttagcatgtcaaccaaaaagagaaataagaaaattttgccaaaagcagccaacagcccctctgtaggagtgtctcaatgcattaactgcaagtcaactaattcaagccaatggaagtatcataaatcgggtatttttgagtttggcaatagcggtatgttgtgtttagattgcaacgaaatgcaattgtcaaacgacattaaaggtctcagagaaagaggacgcttagccaatcagggatttttggacgctccttacaagaattccaagaagcaagcacgcgcaggtcgttttaaagcaggagttgatgatcccagctcggaaggtaacagtagtgtcatatcgtacaacgaacaggtgtcatctccgactactagttttctgatatcatcgggatccaagaagctcccattatttccgcaaccaaaggggaaatctctctccaaaccgaagggcaagaaaggtacaaactctccagggtattcatcttcacctacggtgactaatatcaaggataagacaaccaacaactctctcatcgataacaatggcaaccaaccacttcagcacaataactatcatccaaataatactaacttaaatccaccagtggcgtcaaattctagtgcgactacgtttaatgttttagaggactacgacttgctccacttcaacacagctccattgactgatctagatccattaccctccattgcatacactaataagaatgacgacgagaatgataaggaaaatcttccaccttctgatgaaaataacgaattgcaaggccttttggataaccacgagttagacaagatgtttaccgcattctctggcaatcaacgcccaggcgagactcctaactttttattttcaggctcgccatcccaatggattgaattggcctcccctggaaaagaaactaagggtgatgaggccactccagtagatgtagagacatgtcaaacgttggaatgcaacgatgacgattcatcctacaatagcaagaaggaatcgaagatcagcacaatgccttcttctcctttcatggcatccggcagggatggtacttaattcccacgattatatgcattatttatcatttatagattcaagactattactgaagtctctgtgtattccaaacgtataccatttcatcccagcctgttgtgacaacccagcctggttcaccccataaactccaatcacaacccattacgaattctgtatgtgcagagaatatcttggaacacggtggtgcatgaggttgactggctccgtccagcaggccaacacgagaagtaggagaaggactgtcattccaaacacgaaccgtcatatcatacgaacatgtcaaaagttgagtagggccatgaggagaccaggctagttttcttatcgcaaactcgtggcccatgaacttatttagagctctgggaggccttgaatgaacatttggttgtatcatgcgggtatcccagacctttgcgagcttgtcaacaccggcactagcaactacaaaaggtcgataacgattaaagtcgcacgaaagagcttctaggccgttgtgtgcaacaaagtccatgaaaaggggattaggtagcctcgtatcccaaagctgcaagtgagaatctgaattacatgacattatgatattgggatcatgaaaggagaacttagcatcgtaaacgcagtcattattgtcattccttatattaggacgtgtttttgacatagggacttgagaaggttgaaccactggtattggtttttctattcttccggttttttcttccctacttgctaatgatcttaacgttaacagggatgtatttctattggatccgggactccatacttttactgaaccatcccatgatgctgaacaaaacagatttttatctatattactccaatcgacggagaatacttcccgctgatgctctgtaaatttcattactggataatcctttagtgttgtgtcaaataggctaacgcagccatctccagagctagtcaaaacatggttttcattagtctcagaccaagcgacaccgaagagaccatcctgtgtgtcataagatatgtcggttattatattgccgtcatccattatggatagcacgtataaacgcccattaccgacgagcccataattggcggaagtggccacagctatcttgttatcataaaacggcgaatatcttacggcatacccactaaaaccgtttgtttggaacttaaacatgtaaggcaagagagagtaaaattttcatgagagtggtagaatgggcttaactaggttatatagtttggggaaactaagagatgcatatgatattcctttcgatgctggatggctatttcgaaggtgtttgttttcgttcgttgatgggggagagcgaacagctctcaagtgtcgagaaatgattaggaaaatctctcttgggcaacagaccgcctagtgctctttcgcgcttccttcgacatttacacctagggcgctccgtcatcacaaaaactctcctcttgctacagaaattactgatatcgaaagaatacccccaaaataatgagcattcaagtagatgggcaatctctcatcataaatgattgtgtctctatagctgcagccatgcgtcgggggtctcgctggtctgaacagagaaatattggggtcgcagctattctaggtggccagtttggatcagacgggctgtttgctgatagtgattcgatattaggttctcgagcctccaagcaaggcaaaatccattctcataactcttcttcagcttcaaagttcaaatcggatgacccattactgagtggtttgatacaattgagatcaatgttgataaacacgaatagtatcagtgaagtcgacagcctcacgttactgcaaccttttcttatggttgtcaagtcacctgaaacaagtggatatgttacatcgttagccttgactacgctacacaaggtgttgcgatattcattgctgacggagtcttcactcaatgctgttagtgcattgcatcaaaccgttgatgcgctaacacattgtcgattccagagcgacaacacatctgacgatgcagtcttgttgagggtacttggtttactacaagccattgtagagtcgtcagttggttatttgttgtctgacgatgttctttacgatattatccagacttgtctgtcattggcatgcaataagaaaaggagtgaggttctacgaaagggtgcagaaatgacaatttctgctattacagtgaaattatttactaaactgattttcattaacccagcaagtcacgatggtaaccatctagatacacgcgaccaccagttgggtgatgtatctcatagtattcaaccagacatgataggtgggaccattgaacctggaaatcctgttgatacagagccaagtgaacaacatgagaactcgaaaagtgaaatagatgagcaaaatggagcgaagaatctggaacagcaggatataagtaacgagacaaaaggaaaagagcaaggcccccaaatatccttgaactcttcagtaactgatgattctgttccttacggaattgtttgtatccgagaacatttcaaaatacttattgctataatcaatccaaaaaaacaatttgaaaccactgaaagtaccaaagtcttagcattccaattgatcaccactgctattgaagtttctggaaacgaatttcccaaacatccgtctttgatgaatctcgtttccgatgaaatatgtcaccatttacttcatacgattcagaacgtggaatcgccagcgattgtcacccatgccctgtctctcttctgtacgttaactgtgactctaggctcccgtttgaagattcaaattgaactcattttacgggctatttgcaattccattgtcgagatatcttctttagagtcagttatggctgagactcagaagcgcgtgttggatacaccagatcttgaaaagaaaacttccagtaaattggatgagacaactgctgctagtgagattgaccctgtggcttcttcgcgtcatgacactccagtacctggtagatccccagtgtttaaagaatttttgatagagtccttatctgtattctggactcgatcacctttgttttttacaacgctctatcagctgtacgattgtgattttgatcgaactgacctttctgttgacattatcaactttctgtgtcgagtttctcttcctgattcagcaactttcacaactgataatgttccgccactgtgtcttgaaggtttgctcagtttgatcaacggatttcatgctcgggtcaagaatatggcagccaagaagatctcgttaaatatgctgccagataattccattctggaaagaaagtctcggaagactgactttatctattgcacgaaaacttttgacaagtctttcaaagagggattaaagactttacaagaaaaagggttcgtagacaattctgatgatttagatgaattggcgaactttttctttgtgaagtctagcagattgaacaagagaactttaggtgaatttcttgccaaaccaaaaaaccttgacttacttaagaaatttgtcggtctttttgacttcaaggggctgagagtggatgaagccttgagggtactgttgaaaagcttcagaatccctggtgagtcgcaacagattgaacgaatcgttgaaactttcgcagaacgctacgttgaatgccaaaattatccgaaggatattgattcacaacttgccgatggtgaaaataatgagcatgtgatgcctgataaagactcagtttttgtattgtcttattccatcatcatgctaaacacagatctgcataatcctcaagtgaagaatcaaatgactctgccgcaatatggaaatattttaaagggaacatacaatggcaaagacttcccagcttggtacatagaaaagatttattatgccattaaagaaagagagtttgttatgcccgaagaacatgatggtagtaacaacaaatggttcgaccagatgtgggccaatttaatggctgagcaagccaattatgatcattctaacgttcaagatcctaagttatttaccaatgattctgaaacaaaagctgaagatatcattctatatgatagagctttattttccacttgctgcaccaatattttgacatccttggtgacaatattcaatgaagcgacagatgatcaaatcattacaagaatgattgcaggaatagataaacttgcgtcggttgcaagctattttgggctcaatgactatgttgacaagattttgtctgttttagcttacatgtccaccttgactggttctcgtaagacgtctctgaatcagcacgaaaaaaagagttcgtcatcagactcttttattccaacaactcaaatattatacacagaatcagggaaaacattaactgtcagtgaaatgtctgtatggtttggtagggatttaaaggctcaattgtgtactgtcgtttttttcagaattttacaaaaaagtggtacagttgcttctgagaactggaaaaagttgatggatgtgctcataacgttgttcgaacatggtctcatagatccagatctgtttattgaaatgcaacaacgaatcggtcttcgtggcctcccacattgcaagcctcaatttcaaattaccaaatctaaagctaaacaagagagcggcttcatagcatctttctcatctttcatgaaggggttttcggatgatgcttatgaacctacagaggaggaaattgaatcaacattgtctgctcaagattgtatcaaatcgtgcaatatttcttcattgatcgaaggcttttctaagtcatcatcagaaactattgcaggctatgtcagttctatgtttgaacatcttcctcagaaaagtccaaacacatttaattacgtgccaaaacttctctttattgtggaaacagcagtagcattaacattaatttcagaggatgacaagcttgccactgcaacacttaagaacttatcggacttgacattagatattgaagcggacgatcccaatgaactgttgaaaccttgggcaatgactcggttgaatatttacaaactcttgctcttgcatggaaagggccatgagaatagttttgtcttattaggagccatagatcaactgaatcaactactagagaaacataaagaaattgttcttcattatggtgttccaattttaaaacctcttcagttgttagttgttcatgaggggtatgctcagaaagttttactttcaaaagaggaatactggaatatattgagaactttggcctcctcccctaagctcagcaagtacgtctgtgaaacagtggaaaagattgttgaacttgaaccaactttgataacggcagggaatttcatgaacttactaggattgttagatgagatctccgctgtgggagctgtaggaagtcaatgggagcaagaatatgatcgcctggtagaaagtggtcataatattgagaaaaataatactttcaaagacatcattgatgtttccatcaaatcaatcgatattgcatcatcactttcacctcgaatagttactccagcactggcttctgaatttctgaaccaagaaacaaacgcaccagatgctcatcctatttactctttgattcaagcgttggcacatcaatgtttcaacccttgtcgtcaaatcagatcacatgctattcaagtgcttcaatcgtttatcctaaacattgacttggaatatcatgcgattgatgtggaaggagtatttcaatttggtcttttgccccttcttgcagagttgataaagtccgatgttgtacgtactgatgaaaaggggatgataaagacacagattcaggcaatttctgcaacttgcaaaactattctcaaattccaaaatgatttcactgatttgaataaagttttatcagatatacttctgttggagaccaaattaatctccacaaatcaaaacaggcaaaatttccaagacgaaactatagagattttgagaaacgttctcttggtaatgaaaccgtctcttgatttggagcagttatacatgttacgacttgatgagactttaaaatccttgatcaaagatgtaagtttcgttaaatagagttaaattgacattagtcccactaaggtaaagcggtagtagattcagtgctttggctcaagctgaaaacgtccaggtgcgaaaaaaataatgaatgcagtgaggttcgaactcacgcctccgaagagactagcacctgaagctagcgccttagaccactcggccacacatccaattacacacactaagttgtaattgctgattataatgatatgtttttttgtaaatttttttgagcattcttagaaactttatcaataaagtgctgaatagtttagaagcaaagccatgatatgtgaatatcaactagtgtcatcagacaattttttccagatacttgcttttgcaaatagcttttcgtcactattaggtcccagtcactattgctagcaaacaaactgctaaagtcctcagtcagcacggttttgcattacgcgcgatttaaactatataagaccctgcagtggtgattaataatagctttttcatttgtgtagggatgattacaaattcttgctacagccatgaacctgccaatagccaactgccaacttacaaaaatgctcggcaactgattgtaacgacaaagtcgtagcctcatcacccatcagaggtgagttttttttattggggccgcttgtgtagtcgcccaaattagtagttgggaattaatatctccggacgcgcttttttatgacaatcgagttgttgtactttaattgttttcatgcatactcttcaccaagaagctcttattactaataacccattagccaatttcgaagggaaatagctgttttctttaaagcagaatgccttgaggagtccctttgtttagactataaataggaagcaacttagcccaaagatttgacaggaatttaacctaagttcttataatgtctcatctattactgcgtgacagcttttggggaaggaccatctaccatctgagtaaacacaggtatttctcttttcctgaagagaaagatggtttcattgctcctgaaaagtactacctgaatatggaccaagtatcgatacatgctgaatctgagaaaaatatagtggaaggtttggtagacacttcaaattcttcgttggaggaagtaaagaccactagagtcatagtcgactgggatgaatatgatcagaaagaaaatccccaaaactggagctcgcttttaaagtgcttcgttgtttttgaagtgggaatcttaaccgtagctgtttatatgggatctgcaatttacactcccggtatagaagatattatgagagatctcaatgttagcagaacggtggcaacacttccattaaccttgtttgtgattggatacgctgtgggtccaatgatattctcccccatgtctgagcatcccgctatcggaaggacaacgatatatgtgtggaccctgttcatatttgctatactacaaatcccaacggccctgaccactaacattgctggattttgcattttgaggtttattggagggttttttgcgtcaccagcattagctacaggtccagcttctgtaggtgatgttattgcaatcccgcacttgcctgtagggttaggcctttggagtatctgtgctgtttgtggtccttctctaggaccactttttggagccatattttcccaacttgtgagttggaggtggtgcttctggtttctgttaattacctctgggacactatttatagttcttggcttcactttaccagaaacgtatgtaccaacccttctttacagaaaggctaggaggctacgagcattaacaaaaaacgaactgattatcagcaaaggggagttagatattcaggacagaactgccaaggaagttttgattgaatgcttatggaggccagtcgacatatcattcagagaccccgttgtcttgatgataaatctttacatttcaatggtttattctatttggtacatttggtttgaagcgtttcctattgtattcttagagatatatggattcagccttattggaatgggagctagttttgccggaatcttaattggtgtcttaatatgctctgcgtgctattgctatgcgtgtcatgttacttttgcaagaagaataattgcaaacgaaaccattcatcctgagttctttgtaccgggcgctattattggaggttgcataatgcccactggaatctttattttgggatggactgccaccaaaagtgtccactggattgtacctataataggtagcggtttatttgctgctggtggttatctcattttccagacactcttcaactaccttgcaatgtctttccctagatacatggcatcagcttttgccggaaatgatcttttcaggtccttttctgccagtgttttcccactgtttggacatgcactatatgccaacttgggatccgaaaagttccctgttggttggggttcttctgtactggggttcatcactgttgcaatgatcgcaattccagtaactttcatgagatatggtccaagattgcgtgcaaattctagatatgccgggccatgaaactatactcatttaaactgttccagaatattatctaagaaggtttagttattcagtcaaatatcgtaacagaagacgaagatttgtactcaatcatgtactcgctagtttgaagaatcttttacttttgcgttttatatcgatgcagcgtattcattcaatgaaaaccttacatatgcaaagtaattgagttgagttttgtgtgtctcgaagtataagctagccaaatcttagtctaacggttgcggccatatctagcagaaagcaccgtttcccgtccgatcaaccgtagttaagctgctaagagcctgaccgagtagtgtagtgggagaccatacgcgaaactcaggtgctgcaatctctttttgatctcaactgagtgatacttctattgacttctattggggatcactgcattgtaatggatactaaactggttgaaatctctaatcgtattggtatgccagtcctttccaattattgtcatgacttctgatttagaattagaaaaaaactgacaattccaatgctgaaaagggataaccatctttgtcgctccatctaactagctcagcctattacagtccaaactttcttggtgaattattcaagaacaggtaaagtacgcctgaagtacagtgctcattttaaccacacctctcctaacacgtcttaaatttgaagagaaagcatttatgcgttctcgcctaagagtaaccgttgtcgacctaattgtctgaatctcaaagattcaaatgcacgcagggactagaggcaagcatttggcccaaagtcacgctgacgggtaaaaaaagcccagcaataactatcagtagctaggaacttggacgcttgatagaaaaaatgatgaacgcggtgaggttcgaactcacgcctccggagagaccagaaccttaatctggcgccttagaccaactcggccacacgtcctacatattaggttcgcacctgtttgaatccccaagagctattacatttctccataactacgattcaattttattactaattctacattataaacctagtattcaaatccatagggtgtgaggaagacatttgaggcttttgcgagtacttcgtaccgataaggtttcgaatattctgcaatagtgtcaaataactttgattaggattctgtgtgagaaccgaaataaatgcccatgacatggcacctgttgctgttccattttggactgtatccgcactggtttgagtgtctttacagcctgaaaatgcaatgacatccgcaggagaaaatttttcctttttaatcctctcaacagctgaagaattcgacttggtgaccttcttaaacatgctgcctactgatttcacaactgtacccatattaccttgagcatatcccaagacagcttgcatagcatcaccgccactttctttccatacattgtactccttgatttgaccatcttgggctctataggtaaatggaatatccaaacaggtaccagagtgacaagaatcgaaaatggcagttaaacgacaacccattggaagtggcttcactaagatatcatgaaggtcatcatcaacaatatggcccgcggttttgaagtcgagagggtaaatgacatcgtcaaatccatcaacttcatctccattcaaatcctcagttcgtcctccatgaccagagtaatgaaacacgagtgagtcattaggcctagcatcactgaccagccactgcatagctgcaatcatgtttcgtttgttgggaatcgaaacaatatctctctggtcatcggtgagaataaccatgtcttcagccttgtaaccatgataattaatcaaataagccttcatgttttgaacatcgttaatgcaaccatttagagcactacttgttccgaaatagtttattccaaccaaaagcgccttctttcgtccagtacagtctgaggtctgatactgtccatattgagattgttgtggggcttgacgggagcttgagtatgaggcttgttggtattgctgcttctgaaaattattaggaggtgttggtggagcctggtattgttgcttctgccaatttgtaggaggaggcgttgaaggagcttggtactgattcacgttgtacccgctgttgtgtgcaggtggtggtccgaccggaggacgatgaaattgctgtgaattatttgggggaggccctgtgggtggtctctgaaattcctggttggatgaataagttacgtgctgtctaccggggaacattttcaataaaatgcaaaaaaaacctctaggagggactgatgttgaataaggacaggtaaagatgagggaggctggaaattacgtagatcgcggtgccttatataactagtcaagatcctattctgttatcgtaaagagtgacctaatattagttgaagttaaaactttattggataatgctaatccaattacagcatacgatcaatagtctcatttctaaattggtctaaattgtccaggttgtcccaccacttgaaaaggtaagactcgcagattaacttaaaccagggcgtgaagactagggaggaatctttgaacatttccttcaactcttccttggaaacgtatttactgtcaccgacttcattaggatttggagtatagcgggggtttgcctttattatcagaatataatcaatctcatgttctccccatttgctgtcggctcctccactgggagacatgtagtggattctcgtcaaaaacttgaactttttcaatggaatgtcttctgctggtatacccaactcttgatccagcttacgttgggcagccaccttggcaccatgaacagctttctctaaagaccattcttcattcacttttgtgtcagctcccagctctgaagaaacacacaaaggatgggagcaacatgtattcgtccacatgttggcaaacgtgatcttttcgtcagcacgctgttgcaaaagtagtttctcgttgtggtcgaataggaacacagaaaatgctcggtgcagcaaaccctgattgatattagccataagatggcaagttttctttgtacctgctccaataggaacatcattgtagtctagaacaatgcagttttcctccatgagtttgatttgttcctcatcttggcccttgaagagctctttatcttcgtttgagttggtagaatttgctgtagagggtgtatctgtggtttcgttaagaggaacaatatcatcaaacttcttcaatatttgctctttggtaagactttgaacaagctggtgatacgcggacgtagtcatattgaaaggatgcacaagagtgtaaagtcttgggtgtttactgtcgttctgctcgttcgtattgaaaaaaaaaaaccgtaagacaacgcgaaaagggaaatctggagaccgacattcaacatccgactggatcacttgaattgaagttaggggacaataccagtgtttggttaatgttattgaaaatactgttactgtgatatatgaatcaattttctctagcttcacaagtaaacctccacataaagagcagtatttttcatgtacgaatcattgatacagcagagggtcttggtcgttcaaaactcaatattgaagccacctcaccttcctcactcccaacgacttttcagtttcgacattcctactctccaattgatcaagttatcctcccaacaatgtctactggaaagttcattaagcgcccggactcatcggttagagatgagaagctgaagaagcttgacaaattgatcgcagccaaggatgccgaaaataaagctttggacaatgaactgaagaagatcgttgttcctcaaaaagttgccgaaaagagaaaggagttgatttctaaactaacagaactccgtgagaagcaagctaactttaagggcaagagaaacactgtgtttgctcagatcaaggaaattgagaaccagatccgaaagaacattgcggagatccaaaagagctctcacaaacagttcaagaccgcccaagatgttgacaaccgtgtcaaagaactggaagacctcattggaactggtgaactgcgtattctggaagagagaaagtacgctaaggagatcagtgatttacacaagctgcgtagagacttcggtggtgtcgaaaaattgcaagagttggtcgataatgacaaagctcaaatcgaatctttgaagaagtctttggattttggaaaggaactgcgcgatgagtacgatgccatccagaaggaattagacgagatcaacgctcagaacaagaccatcaatgaaaagagagatgttctgtataagcagaagaaggagatctacgccgccaagaatgaactttacggcgaagctagaaaagccagggatgattacgaaaaagagttccaaaagttcaagaatttgatggagcaacaaaagttggagcaagctcaaatggaagaacgaacccaattgaacaagcaagttgctgaaatcaaaaagagcatccaagctgaacaagcgagaaaggacagcccagcatttgcctacgagattgactccattcattctgttatcagcgtcttagacccttcttacgtcaaaccccaaccaatttccaagccatctgttgctattccttggaatacaagcaatgcttcatcttccttgaacaaaaagagaactatcaacagacaaattggaactcccaatggagaagttttgcataaacctgaagaaaccaaggatatcaagtcctctactgcttttaagaagactgcttcacgaaaagccaatgataaggccttcatcaacccggaggtcatcactagattggctgatttgaagattgctcaaccaactagtaatgaagagacctctggcactctggagtctttgaaggagaaactggcctactttgaagaaaatagggaggctgaagctgagaggatcaaacaggcttccgaggcaactttggagaaattgaacagtgaattggctgaacttgaggccaagctttctgcactcggaccattaaccgagtagaaagaccggacttgtatatgtagataggaaggtcaataactataaaagataaaaagtagatgaaagaaaagtagatcaatgatgcgcgaaagtcttaacatcagatggagaaaactgcaaaaaaaaaaaaatccagcagaagagctgaaaaataactgagctgaaatagattggtaatatggacacgaaactcaggtcttcaagagcttataaaagacaatactcgttatgtataagtaatgctctggttaagaactgtgtaaagtataatattgagcaaatcacgcatatttgttaccaaatagccagggcagcctctctctataatgtggtagaattggtggttatggacattgaagatggagctgaaggcggagacagtgccaacccgggagagattaaggaatttggaccaaaagggcaaaagaagatcaagtttgatgaaactctggagcctaaaggtgcttcgccagcagcagagtctcagcctaaaccaccagtttattctccagaaaccatgataatactggtactattgcagttttttgtcactccaccatatttagtcaagtcaatatttaccaaagagcaacagaaatatttgaaatatgccaagaaacttccaatgatacctactcttccgtttatgcagaacggggatgtgcatgccaaatacaaggaagggttatccgttccacaatattcttcaactatccatgtcaagagatggaagacaccagatggtaagatcaaaaaacgaaaaagaggttctaataatctgaaaactcgatttgttaatattggacgagacaccctttttgaactagaaaaaggccaggaagtccccatgaacgtaagggttaccgttgatttgaaaaagaaaatagttgtatctcccttggatgcttacggaatcacaggtttaaaatcaaacttcggctacagtgtcagagctgtcaaggaatttcaccaaatatatacagagagcggtaatccagatggttactctcgatcctgtttcgttgaagcaggggattttttcataaaccaatctcacacgcaggatcacaatatggaaaagttaccaatgattgataattccgaggaatttaaagatggtcaagagcatcttttactagtgatcacaagatggagagagctccaagaatttttcaaagctgacaattccgacatgctcaaagagatagagagctgcgagtcaatgtttgataaccgtcttgagataatcaacggaaccaaactagaagatgcgattctgatagcccttgccaaactagagagttagtatgttgatagcatcaaagttctaggatgtcagatgtctagaatcgttctgattcgaattgttcattttgaggcatatccaaaccattttgggcttgtttggatgcaagtttcttcgcgcgtgtattgctccctacgttatcaccacgacaactaaccgtctagatccgaaacagtgagtccttcaattggaagttcgtctacaggtgacgggaaaagaaccataaaatcatagtaaataaatgaaatcagtatcttaattatccctactaacccatccttgttgctaggtatgctctcgtatagtgtctcctcaaaaactcaccgaagctaaaaatagaaccgtatgatgtggtcgttccccacccgacaatctcgatatttcaaacccatctcccgccctttccttttcagtgttttcttttagattagcttcttctactgattacttctctgttgcaaagatgatctttaatcttaaaacactggctgcggttgcaatctccatttcacaagtgtctgcagtttcctctctgggttttgctctcggaaacaagaacgttgacggaacttgtaagtacttggccgactacgaggccgacttggatactattagaggcggctctgaagccgttgctattagagcttattccgctgaagactgtaacactttacaatacctcggtcctgctgttgaagagaagggcttcaaattagttctatcagtcagaccactggatgagagctactaccaggcagaaaagaatgcactaagtgaataccttccccaattatctgtttcgactttgcaatttttgtcagttggatccgaagctttgtacagagacgacttgccagcttcagatctggctgataaaattagagatatgaaggagtttttggctggcttgactgacaagaatggggactcctactcttccgtcccagtcggaaccatcgattcatggaacgtccttgtagacgcctccgctgcaccagctattgaagcatctgatgccgtttacgccaacgctttctcatactggcaaggtcaaggtccttccaactctacctattccttctttgacgatatcatgcaagcattgcaagtaatccagaccatcaagggatctactgatatcgatttctgggttggtgagaccggatggcctaccgacggtgacaactttggtgatgctgttccatctattgagaacgctgacaacttttggaaagaagctatctgcggtatcagaggttggggcattaacacattcgttttccaggcatttgacgaagactggaaggaagaggacgacgctgttgaaaaccacttcggtgtttgggacagttccagacagttaaagctggactcattaggttgcgacttttcttcttgagctctatcaagtcattttattattaccctcaaataggtcatatagcttttatacctcagacttaagcgtattacgtgattgagagaagggcgttagcaactattttgacattttttgactctgccacatttgattacataatcaaagaggccacctctccgacggagtcccaaaattctagtatatgaaccgagaatcttatccacccaccaaaaaccttgcacctttagctgatacgatcaatgctttctacacgtgtagttagactaccaaaggttattagcgggggcaataagcaactggcacgagggttggcctccctttcggatgaaaagtcgttaaacgaagcaaacccaacggatcttgcaggacttaaaagaaaggccaaaagaagacctacgaaacttgctgatgaattgaagacaggtccatcgttcgctgatttcgtcacggggaaggctaaggacatgctagtagatccattggaactggcgagaaatgaccctaatgcccgtcttccctcttggcttaaaacgcaaatcccaaagggtaaatcattccaccatttaaaatcagaccttaaagagctaaaattgtcaactgtttgtgaagaggcaaagtgtcctaacattggagagtgttggggaggtaaaaaatccgaagccactgcaacgatcatgttgatgggtgatacatgcacaagaggttgtagattctgttcagtgaagactaatagaaaccccgctcctccagatccgaatgaacctgaaaatactgctgaggcgatttcaagatggggattgggatatgttgtgttgaccacagttgatagagatgatcttcctgatggtggagcccatcatttggcttccacagttactaagattaaggaaaaagcacctcagattttagtggagtgcctttctggagatttccgtggaaatcttgaaatggccaaggttttagcatcatctccactagacgtctttgcgcataatttggaaaccgtcgaggatctgactccccatatcagagatagaagagcaacttacagacaatccttatccgtgttgagggcagctaaagaggcaaatcctagactggtaacaaagacctctttaatgttaggattcggggaaacagacgatcaaattcttcaaactttacatgacttaaggaacatttcatgtgatgtggtcacttttggccaatatatgagaccaacgaaacgtcatatgaaggtagtagagtatgtaaccccttctaaatttgagtattggagggataaggctctagaaatgggattcctatattgtgcttcaggacctttagttagatccagttacaaggctggtgaagcctttattgagaacgtcatcaaaaagagaaggacaaacgttggagccatcgaggaacagcaacacgacaaagaaaataacaacttactattgagcaaagaagacgagaagacaacccaggagaaagccaatttctaaactatcgcaacacatagattaataccaacagattaagaatgtttttctttcattaaattttatccagtaatgttacaaatattctaatagaacttctatacagtctcttgaacatccaaagtttggagcaaaaatgatccccagattaccaacacccattttgttgatatcctggttagctacaatttttctcaaataagaaaagaaaaccgtaaccagatcacaatttgctgtaggtaattttgacactgcttttttcacctcttcttcatgttgatgcttcgaaagatcagggtagaactgaagaagctcttttgaaacatctgtattgacaattggctccttcaacgtacgtaagaatcgtttcaatagtgtcgtcacggaatgcacatctggcttttcaggcaaaagcattaagtccacatcgtaatttgtgtcgaatttgtcctgtaaattcttaatttctagggtcatgccactcaatcgaaacagaccttcttgatattctcctttttgggaatcgagatacatcaggcaccgtccaacaatgctaggaactaaatgtccattataatccatagaagaaacttctaatgcatcagctaaagaagttccaaacaatctgggtgcatctgaaaacttttcgggagagttaaagacaagtttgggcaaatactctttctgagtctcatttgatgaattattctgaccactattaatggtaggagtgtacgcactatagggagtagattttaatgtgtcaaattcgttggaaataaaggtatcatcattgatactgacagtttctgagctatccttttcacgcctagtcttgaacaggccaccaattttgagtgtctttttggcactcgatggggttgatacctcgtcatagttgtttgcagtggacctcgtagacgaaagggtattcaggtttcctgagcccgattcaacttttgggctgttcactgtggaggaggatctgttataaaagctagaattgctggtgtttgaatcctgcttgaccggtgatatcaacgtattggcatgcatgctcttcaaattattcagcaaattgatccattgttttgcctcctcataagattcacaacatagagtgatctttgaaccagatgaagaaagtacccccttcctcctaggttcaagtatggagatcccacctgtggataactcctcttcgaaatagaaggtactgtcccttatagagatgacttgctgtcgtgatgataagccatgatcaagtataggagtatccgatatgatcaacctttggccttggtcaagttgcacatgaacgattctccaagaggaagaatgcaatctgttgctgttccttctcaaaaaataagcttccttaacactgggatcttcgaagtcaaaaacagcgtctgcagagaagaaagtacagaatggtcgagcaaactcagcagggtggatcttcaaatcgtagaccttgttaaagtattgagtcaataaacttcttctgtcgtcaatcgtatttggtgtggttttcaaaaacagagttttctcaggtaaatcgggaagatcaaagaaaaacggacgaaatatttggtcgacctcttggagctgcgaatacctcttctttaccttgaacagcaatttctgatctagctggtcaaagtagttgattcctagagttatcactgggtcgtcagtcttcttggtagggttagcaggatcaattacactgtagacggagaccaaagtagtgtcgatactatctggctttattaaaagtgctttccactcactatctgtaaatcctggagtctggttgatcattggcgtgtttggcaaaggttgtgccggtgctttcgatttagttttcttgtctgagttttttgatgtaacagaatagagagatgttgtttctgataaaatttctgtttcaaacctatcctctgtagatggagcattttcgacatcgtcattttgcaagtacggctgtggtgaatttcgatgggtgaaaggctgtgggtcagttaaagttttatccggctctgctagaccagcaaaagaaagagatggacccacatctgatgcaggttcttcaattattgagggtggtttttcattatcgttgctcaagctcagcttcataagtttggatgtaacattttctccagggcctgaattagggcttggactagaaatagggctagcagtaaggctagtagtagtaacactaacagcagtaccagaaggaagaatttctgaatctatgttattcggaactgaaaaatccgatttcaaaggagaggttgcagttctctctcgcttccttggagaataaactctccgaggagatgatccaagtattggttgaattgaagaagtgataagcaattcttgagctacaacagtctcttttggttcagcaacaaatggtgtggacaaccctctctttggagttgttataagtcctaatccctcaggctcatatggtgagtaattcgaactattcacggaagcacggttgttgttgttgtttgtgggagtggttgccagaggagtgggcccgatgaatgtctttcttttactgttacgttcaggaattattggagaatctttatcggcttgtttttgctgtttggatggggatataagaggattgatggtatctccatcaaaagccactgttcctttgggatagctagcttgagcatttatgggactgaaacttgaagaggagtctccgacttttacactagaattgttctgcaataatgcaatgagtttcgattgttcttcaagtttgtcttttaaagtaataatctccgccttcaattgagcgttctctttccttaattgatcaacttgtaagtgaactctattggagagagcatcgacacgtataggcgacacatttattgcttcacctcgtgtgccagtaccagagccagaaccagggccagaaccggaaccacaacctgagccagagccagagccagagccagagccagaaccgtcctgagtcacagacaagaatggtgattcaaatgaaaatgacattgacggacctggtcgaattgggcacgtatattcaaagaattatctatacgggctgaagtgataattgataatgataatttggacgtgttcgtgcagtttggattttggctctgtgacatccagattgaaagtcgcgaaggagcagagtactttattttcccttacaaaaatcctttcaccccagattcctcttcccagctctatacctaactatttacatgaatatataactatttgcacaaaacaaatctcaagacaatatgctaataaacagctcccatgttccaaacattatgatcgagttaggcaccgtcctcatcatatgaggagtcaatcctccatacatagatgcaagcccttcctctttaattattagcttgaaagattggagtaatccagtgtattttggtctcccattctccataggagcttgacgtagccgcgtacggacaacttcgtgtgggtaagtgattaaagatgccatgaacttggcagcacctgcagcaccagacctcgcagcccattcatatagctcatcgattgaggtgcgctcctgtccttccttagctctagaaagagaacgttgtttaatgaacgatttcatttgctcgtataaaatccactgcaatgtagattctatagaccccagatatgaggccgataaccctttgtaaagtccagagactccttcaactttaagaatcttggagatgcaatcccatgaatttttgtactgtttggtggaagacttgtcaagctgtaaacgggtcttaactagccatatagggttcgtggctgtactagtaacgaagccggcgtttaggccggctagtaaatgcaataaagatgtttcttccccgtcgaacacatgcttcctgagaacgtccttactatatccataagtgaaaaagttgatagatctagcaggtatcacacccacaaggtttggtcccaatcctttgaatagtgctctaataccttctacacggtacacggagccaatgatagagcaagtctctgaaatatgacgggccgcggatgaaatgacatttgctcctttgctattagttgagcggtaaagatcttgataaacacttgactgaagccttgtcttgacgacatcgaaaggacaagtaaaaactgctcctgccatacctcctaatccacctgccacaaaattgacccagggttttacttcctgcctgtcaatcgatagtttaggagcttcaattttcggttcagcgttacgaaaactggacgccttttcgtcactagatagaaatgtgatagagtcgttgacatcttcggctatccgttcgattttctccatccttgaaggattagccattttgtatgagaaaacagagggtcaagataccaggaaatttttttgatcgagaagttcagattttgtcaaacgaggaaaagatatttttcccaaggaaaacttgggatagaacgagccaatataggccgggtattggcgagtaacaggacatgttcatcatttaggctcctgcttaactagtttcgaagtgtatataaagtaacagaatactagacatcgcttactccactgagatatttcagagctcaaagtcatcactcacgttgcttttgagcctcaaccgttcacgacactacaaataccatttacaacatctcttctcaattagtatgtatacaccgattagatgaaagtctcgtaagcaactggggccagggtgattggctcaccagaaacaacatgagatggtcttggaccaactggttgtctctttgggaaagcaacagacttgccagattccttagcatcagcaacgttcttttggtgttccttgactctgttcaagaactcctcacgacacttggatggcttgacgtgctcaactctcaggttgaccttcttctcaatgtatctgttaccaacaaccttgttaatcaaaacactaacggaagtcttggtgacgttgaaaacaacaccggtcttaccgtggtaaaacttgtgaggcatacccttttggatggcaccgttggccttgatgtcaacgtaatcaccaatcttgtaaagtctcaggtaagtagacatggggacggctccgtgcttcttgaagtcacgcgagaaagcgtaacgagtaccagatctgtaaccacgactagattgtatgttagtatgctcggtggggccaggtttacggaaatgaaggaaagaactgatgtcaatgaaaaaatgtaaaacatctgccatgtgggggcaatcacaactggagagtcctcactccttgaacagagcatatcattggatcatttgctggaacattctctttcttgaaacttcttttctggaactttaacataccttttacccatcttatttaattgtgtgtgataactactggaaaagattttttgtcgttttcaccagaggtatggtaatcgcgatggaagaatcagaaaaagtcaaccctataataactcacgtgacacaaatgagtccgtgacaacgattttcatttcaagtaaaggtccttcttactgagctcagagatgatcttatatagtagttaaaaagcgtgtattagaggtaatatacatcggactagatttactcttcatcctcttcctcctcctcggcaccaccctcggagctcttagcttggttctttctcttaacacgaccagctcttcctccaccgtatggggaagtagaagcaaagtcgatgtgcttttgagattccaatctgaccatgaaagatggaatggtaacaatttgcttaccaacagcaatgtgtctttgagaaatcaaaactctggcatggtggatagacttggccaaacccaacttgaaaacctgagtttgcaatcttctttcaaggaagtcctcgaccttcaaagccagaacgtaatccagctttctcttctcctcggacaagataccggttctcaccagtcttctgatcaaagcattaccctcgaacaatctctttgggtccttctcgtctctggtcaacaagtctctggcagctcttctaatcttggacagttggaatccaattctgtaaatttccttcttgttcttaagaccgtactcaccggcaagtttcagctcttggtcgaaacgagcggagtcgtatggggtctttgggacggagtaagtcttagagtaagttcttggagcaccttacgggttagaatacatgttcaaacgatatctttctattttcaacaagaatgcatagatcaaagaaatagtgaatggaaatctacggtacaagcattctcacacaatttattcttcatccacaaagagaggtcgtctctatattgaggatatatgcaactgaagtgtcgggagttcagtgcaaatgaataagatgtgtgaggacccgaacctctggtttttcagagttgatcattaagacctctgatataaccgtttgattaacaaacactaagcctggcctatgcacccataaattaatcaaacttacgaggcatcttagttctgtcttgtggttagaggaaagagaggagagaaaaagctttgaaaaatatttactgagggactctcgcgcgggtacattttccagagcgatggagagtatttgagcatgagcgtatatttgagactgcctggagtaatcttggatcggggtagcgaagacagcgattgccaaatcggggagaatttgaaattttttcttttaactaactgaaaaaaatacattgtagattacgtaatacctaggtaaactacataacggtctcgtaatcagactattgatctaatctttgtttcttggtggcgggctcaacatcctcgtcattgttagtagcaacaggagggaatgctggggtggtgatatcagcatggaaatccttaatgatagagtcaacatcgtcaatgttcaatggtctgatgtctcccatctttttaattttggcagtgacctccttgcactgagcatcagtcaaatgcaagttcaactggtcgacacgagatttgatagcattccagccagttaatctgttggcaaaatgaatatacctagttaaaccaaagtcagatggttgcaagatctcgtatgtggatggattggctagaatggccttggcatgaataccggctttgtgagtgaaagcacagaaaccagtaattgggttgttgaatgggatattcacttgaacagcctcggcaactaaggtttctaagtccctcagtttatgcagtttgtatttggataaaacgtaatctctgtctgcggcaatcattctagccatcaaaccaccaagaggggtgataccgtttctctcaccgatacccaacacggagacgtcgataagtttggcaccagcttccaacgccgtgtaagcgtttgctatagcacaaccagtgtcatcgtggaaatggcactcaatatcgcagtgaacgacagatttaagggtcttaaccagctcgtaaacttgtcttgggttggcacaaccgacggtgtcagctataccaactctgttcacaccgatcttatcaacggttctgtagatgttcaaaaggtcgacgatgtcagaacggaaggaatcttcagaggaaaatctgatttcgattcccttggacttgacaaattcgatcacttcgattgcttggttggtaatgtaggacatgtcctttccgtgactaaattgtctcaaaaattgagaagtaccaataacaacatcaacaccatccacaccagtctccacagccactctagcatcgtccatatggcatctaatatgagttaagatcttagccttgaggcctaatttgcagattgcttcacagtcggatcttgactgctcagaagctacaggagaggtcaactcgatgtaatccactccaaagtcgtccagcgccttggcaatttcaatctttttctctgtggtgaagaaagcattggcaaattgctcaccttctctcaaggttgactctatcaactggaagctagaaacatttgaaaggaagtcagatgggtgaggtccgtatggattgcgttgctgaggttgggctccattggaggagccattagtttgaccgttcgtttcactcattacaaagctcttactgttactactattcatataggcgaaattatgggtatttatacctcgaatttgaaattttttcgttagtcacgcagagcgattactcatcctggggctaaaaaatcttgtggaaggggcagaaaagcttaaagagagcaattaatgaaagtttataggcggaattttaaagtttccctttatcgagagtactgcaggctcttttcaattgatcttcaccaagactagttggggaacatagtcgtcggccaaactgcatcaggtgcttttgactgtggagatacttttcctcaaagtttcattgggtgatgttcgatgtctgttgcagaattgacgatctctacaaaatgtaatttcttttctttcgaactctatcaattgcctaacagccttaatgtccattccaccgtcgtaaaagtggccgcactgcaaggaattgccctaactagagtgggaactatacccctccagaaaccaataagcccttgagtttgccaaatatgacgggcagcggctctagcacttccatggtatttactagttgatccaaaagtgtctccctgaactctacttttgatgacatccaatggataggaacctaaccagagaaactctccagcaagtgcgccgtataacattaactggggagtactgatctgatctcgggcaattccccacttttcagtggttgtcttcatcaaccattcgtaggctaaaaaccacacaccataggcctggatctctctgagtaaagtgatctgaaaacctcttcctagtgcagaaaatccattctctctgacgatatgcttaaccaattcacgcggaccatgatatccactctttcctttctgagtttggagaataatacgaagttgctccacaggcgccgttattggtgtattaacaataccagcaactgcacctgcagcatagaattggggcaaactaagagtcccagaattatctgaattgtatttcaacaattgtcgtttggcctcatggaaaccgtaaaactgtaaagaaacgcaagcgcccaccccaaacaaaggggctaaagttcctttgtaaaaagctaacagtccttcatttttcaaagtatctttaacagctgttaatggagagttgtactgtcccgtctggagtctcaccttgactagatcaaaaggttggccaatgagaacctgtacggcgccgcctgcaaacccagcagtgacatcttttgcctttcttaacagtgattcatctacttcttggctcatggaggtataactagaaagagaaatgaagaatagtaagaactggagagatctagctacaatcccagagaacagctggatggggttcgggaaagggtctctgaggaatccgatacagaagatggtgcaaggtcacgtgcttctaaataacattcgaggagagaaccggaaatgatgcgagggtgacatttaaccggttgtgaaaagaaacgaatatccgttaaagacataattcgcggcttcccaaatagaaactttgtaaacattcaacttcctctttccatctctttgaccccaatctaataatgtccttctttcataagtaagcatatactactccaagaaacagctttttctctatcaatgctaacatttaggaattcccagaccatcaaaacgcggggattcaagactctgacgtcagacattggtctgccctccactccagagactgctccgaagaccgagcaacaaccaagcacaacacacagggacataaagaactacgccgaggccacattaggatctggaagctcattagcacaggctgtcaagctaccaataggagaagacctggatgaatggcttgcagttcatgtggtcagcttttataatcagatcaacatgttgtatggaaccatcacagagttttgttccgctcaaacttgtccacgaatgattgccacacaagagtacgagtacttatggcagccaagtgttagttcaagaacgagcaatatgggtagtgccagtgggagcagttctccaagaaaactagcacctgtctcatgtactgcaccagaatatgtagagaatttgatgagctgggtgcaggataacctggatgacgagagaatatttcccaacaaaactggtgtaccatttcccacaaactttcaaactttagtccgaactatgatgaagcggttatttcgagtttacgcccatatctactgccatcattttgatgagattgcaggattatccttacaggcccatttgaacactagcttcaaacactttgtgctcttctgtaaggaattcaggttgatatccaccaaagattacggtccactaaaggagctggttcttataatgtttgatggcaacgacctcgatgccgatggagatacggatcttactgacagttaattttatatgagttcattcttttttttccactatcttaattacttcctaatcaggccatgcgtgtagtagaatagaaccacattatttcgttcacatatttatgtgtaccacacatgcgcgcctatgcctagctttattgtctgtgcccttaccatattgacaaccatcaaagcccagccatcatttctttcctttccctaccccgacaggaaacaaccttcagccaaatagaaggttcaggagatcttgatttactcaattatcacgtcaggtcatcatttcagaagtcaagatttttcaaccctttttggctccattgtctgcgtttaatagtaaatgactgccaacaatcagacaatgtccattctttcacaccagcagcagttacaaaaccagcttcagctgaagcaactccaaactcaggagcagaaacagcaggagcagcgtaccaagtctcttaactccaacaagtctgcggaactcgcaaacttggtcagcgagaaaactccccaaaaaagaaaagatccaagggacccactagcagttcaaattccaaccaccgctaatccaactgagattttagcatctcgtttcaactcttggcgaaatgtgattagggcgctgctagtctacttgaaagacgtcgtttctgttcacgaggaagtagtccgtcaacaagtccgactgcaacagtccttgagtttcccctttaccacacaagggctcaacggagatttatatcaacccatcacgaccgggaaatcaaattctgccggctcagatggtgctggtcctgctgataattttgctgctattcaaaactttttcttaccgctgggtaatggatccatttatgaccttccttccattttgctacaatttcactccagttatgctgtcaacgcacagaaaactatccgcgaactcaatagtactgtgattcctcgtcttgaagaactacgtagagatttgttggtgaaaatcaaggagatccgtggtcttcaatctgatttcaagaacaacgtaaacaaggaagttttaacaacgaagcaagagttgacggcatatcaatcttccattgaactggtctcgaaacatccaaataatgtgcaacctaagaatgatccttatctattgaggacacagctagacagacaaatcaagagacaaattcaagaggaaaactttcttcacgaggcttacttaaacttacagagctcggcaaaagagttagaaaaagtcatctttcttgaggttcaaagtgccctaaccgtctacgccaagttgctgggcaaacaggctcaaactattttcgatgttttgattaccaagttggataacggcttcctcactaaggaaccatcttttgagtgggacagctacatatctagggaacccaatttcattgatcccaaccttcccatgagacattatcgtgatctcgtttaccctcataataactctcctttgagttttgagattcgctcgggatacctcgagagacgttccaagtttttgaaatcttactctaaaggctggtatgtgcttacggccacattcttgcatgagttcaaaacgccagaccgcaagagggatcctattccagttatgtcattgcctttgaatgactgtcagattacggaacactccaaaatggacacagtgaaccctgactcgtggcataaatttgtattgcatgctaagcagaatggtatcataaacaggggtcataactgggtgttccgtgctgagggttaccaggagatgatgaaatggtacaacgatatgaagcaattaattgcgctacctactcctcaagcccgtagttctattgccgcccaaagagagtcacagagagtacaggtgaaacaatcaaagcgccactctaaagctggttctcttctttcatcttcaactgtaccatcagataaggggcaccagcattctactcaatacgaccagctgaacacagttctaagtttgcctcagaatgttcctggctcagagggcaatcaagctccatactttgagaactcacaaaggaatggtccccaatctccacgatccggagcgcaagcttctggtaacgactacaccacctacgctcagcaattacccaaccaagatgctgctcaggtgccacaagggttcaattacgcccctgaagtgagcgctcttggaatctcgactcaggtcgacgacgagtcaggaaatgatcgtagatctttggagactgcctccaatccaaacttaacagatccagaccatattcgaagcacaactgaagatactttaaacactttaactccaaaagtgaatggattaaaggttgactcggacaaggatgctagacctgtctccactaacaacattctagtggatgactcttgaaaggcctactgatcgattactgctttgggtacataattatttacctgtcatttggcaacataatatttttagttcattcaccggtgttttaaaatctttttcaagaagaatttgaccaatattaaagtgttcaaaccagtaagtagtgttttatgtataattcatgctcttcaccacaatgaataatctcctttctttcatcacctggtattatctgtgattataatatgaatcttgatagcgtttccggccatcgcggttatcgccgcgcgctgatagcatttcttcaagaactaggtttaatctaatccaacaacctatggttttttcagacaaacttacatttccagatatgcccgttgaagagacccagacgggctccaaggtggcactgttcggactagttcgttggtttcttttgccagggattctactttttttttatctgttatttagtagagtttatctacgatggagagtggtgacacctaacaactggaagaggtatgtgacgaaggccgtagcaacaggagagccaataaataccactccgttgcatgctaaggctggtgctgttagacggaggctaattttaggctctagaaatcctttcttttattctacggctgcggatcccacgaaggacaaatttattgaaatcgcaaaggaggatagggctaatgccaaggaattcataaacgaaattcttcccaagactgcgtatgatgtctctagaaagatcatctttggattttttcaccctttttgcaatgctggcggtggtggagagagagtcctatggcaaggtgttaagaccactttaaaggttgatgataagaacatttgcttgatctacaccggagatttagtcaccggcgatgaaattttagacaacgttgcaaggaattttggtatttctttcactgatgtagaacgtcccagattggtgttcatccatctttacaagagaaagtacgttgaggcgcagtattggcctagactaactctagttggacaggctttcggatccatgttactcacattagaggcattacaaaaagttattccagacgtctgggtagacactatgggttacccattttcgtatcctttggtcagagttggtgttaagattccaattgtcacctacacgcattatcctatcatttcaacagacatgctcaacaagatcaagatcaatagcattaagactctagccaagaagatctactggtgggggtttatgttagcctacaaatttgtaggacattttgtggatatcgcatttgtcaattctagttggacttctaatcatatgaagaaaatctgggcttctgtgtccacagtcaagacactatatcctcctattggaattgacaagaaaataactctagactcagtcagccctagagagaaaataattttatatatcgctcaattcaggcctgaaaagagacacgagttattgatcaatgagttttccaaatttttccagctagataaatcttacaaactagtcatgatcggttcgatacgttcgaaagacgacgaggatagagttgattttttgaaagacctggcttataagaagaaaggaattcctgaggaaaacttggttattatcaaggatgctagctattcagtcattcaagactacctttcaaaggcagaaattggtgtcaatgccatgtggaatgaacatttcggaattgcaatagtggagtacatgttcaatggacttcttccgttggcccacgctagttctggaccatatttggatatttgtgtgccttggagcctcgataagggtgaacagctatccgtcaactcatctaaacctacaagcgatgattctaatagaacggggtatctctttatatccgaagaagaccccgattttgaagcccgtactgaaccttttcctagtttacatgaggcgcttctggatatctcaaagctcagccaggagcaaaaattggagattttgaaacgtggagcttcagtggttaatagcaaattccaagacaatgttttcaatgaaaattggaaaaaagccatcactgatgctgcaaaactagagcaggtctaccggatatctaaacgagatggggaagttgagcaattattctaattttgaaataatgtagtgtcgtttatagggtatggtccttaagttgttccgaatgaattttcacttgtattatctggatttattatccgcaagacttctctttcatcctcaaaatcgtcatcttgatcaaaccttctaacctgtccgctcccaaatggacctgttgaatttgtatctagtgaggaaatcacggactgggaagatgatgacaaaatgcttccattttgatggtagttttggacatagttcctaacaaattcagaaacataatcgtctctttctgcaacagaagactcatcttctggtaattgcgcacttttaatgttcctccttcttctgacaaagtagcatattacaacgaagagtaccaagagcgaagaacagccaacggatattcctacgatagcaccagtgctcaaaacttgtccgttattctcaatgtatgaggccgttgccgaagatggagatggagtcggtataaactgggaagaagactggagttcgtcggatgaagtgtcaacagtatttacctgagtggcttcattggctgcagggactgccggagccactgtttcagctacttggctttcaatggaagtcgtctctgaccattctgaagagtcttctgacgatgatgttatgttggccaaagtgttccaagagaaaaatgtctggggagatgatgatgaggaaagagaaaaggtaaaattctgaactcccgcagtagttaatagtgttgaacttccttccaaaaataggtaactcccatcacttattgttgaagtatcattactgtcagatggcaaagtagtagaaggatactcactggtggaagcggatgaagagattgagtttgccagatcctcgtggagaaaaacctggaaactgaatgtcccaccacaagtttgcgtagtgttaccagcacatctaacttcacactcgatgctcctttcgctttcaacggcgaaggaatccgaacaataacactctgttccattgatcaaagcaaggtaaaggcgactcgagcaggccccactgcacagttcaatggtttggagtgaggtagaagactgaaaaaaaaacgactgctcaagctgagacgaaggatagcaacccgtataagtaagtgctatgacgtggcgcaaacatatcagtattgatagcagcttcagtagcatcaacattaagctatgttacggttgaaacggaaaaatgagattagggtccactccactattacagtttaatgtgcgcgatgttctttgaagcatcccgaaataaaaacaatcaaaagtgtgatttagaatgacacaatattataatttttgactcctacgtcacctatatatttcctaagttaactaaacttcatcatctgtggggttgtctgggtttataattctgagtccaccaagacctggagagggatcataactatcctgagttacatccgggagtgatccatgactaaaccttcttgtcagggcgttgttcggccttaatgaaacctgatcattctctgttgacgggtcagtaacggcaacatgagatggagggacagcgtaacttcttacaaagtcgctcactgcagcttctttcttttcattatctgcctcgagatcagattcaatatcggatttacgtcttctccaccaccaaaatgcaagtgcaactattatcaagacaccaccaatgacagatccgataacggtacctgcaattgcacctttacttaaagatgagccagaattgctgcctctgtttgctgttgaatcagaattggacgagctggacgaacctgtttcctgagaattatctaatgctgtaatgactgtagttacgacctcaacagacccacttctttcagctgatgttgtaactattatgacagacacctgttgggatgatgatgatgatgtcgttgatgatgatgcagatgaagtaggtgaaggggaattggttgacgaagaagacgatgacgagcttgaagtgctcgatgctgtcgtcaacgatgaagacgttcgggatgtgaatgaagacgtcgatgtggttgaagaagttgaagaactcgaagaactcgatgaggatgatgaagtggaagatgtggaagaggtcgtttcgtcatcatcgtcatcatcatcatcatcgtcatcggcatcctcgttcacataaacagacaaataatttgtccctccacatatttccagaggataaccatcacaaggttcgttgcaaaatgactcactcactttatctgaagatgatggtacagagcttccacaaaagcaagcatttcctcccgacatagctgcaacatcagtgtctccgcattcctccctacaatatgaagttgactgaaactggtaggtcccccgagacgtcaaagagttcacagaggaagaagcaaaacaaccatagtagttgtacgttgccgcaaacaccctactcaccaatgccaatatcaatataaacttggtcatggtgtttaagttctcagtaatgtgatttgttgatgaaattcgtttaaaaaaaaatcaaaattgtcaaacattggcggatgcacgatgcgtgcctaccgtgtttacccttgaaaacgtaagataaggtggggcgcatgaatcgaaagttagaaggagtctaggccgagcacgcgaattagcctgggaggaatgctgggtctttccttacagcagcacataggcatctaatacatgaaacaactctctcaacagtttacagtaatgccattgtttcaagggaaaatggtcgattgatgattagttcgcttgtcatatttagactgtttttttttccttgtaggtaatgactcttttcaacgccagtagccaacgttctgttccatcatttttggaaatgttggctgaacctttagtaattttatcgtctccttttctagaatgaatgtttgtagcctttacacccataggccaagcgacatttccaatgctgagctgaagatatgaggatgtcgcctgctggaaacttcccttttgtacgttatacatggtggtggttaatgtgattaataggttctctggaagagtaccatttcgtaatagagtcaacaagattgccatatcttgtttcaactgatcaaactctatatctgtcagttgtattgatggatcattgttcatttctttcaaagtatcaaacaagtattgcctcagctgcaaacgaatcttcgtttggtcgttatggaggtctgatggtttgatttcagtgtcctcacattgtgatggaactgatttaatactctgtttgagtcggtcttttttaaatgaaacaagtgttttgacttgatcaattgcggacatttgatcggtagatattgcgtttgcttccaagtctgctttaattctgtctctgataacagttaacctaggaattgttttcaagtcttgttcagaaagctgcactcgggtgccagaggatgccaagtttgatgatgaagcttcattttgagggcttgtatttattgatttgttagaaaaacccaagcgctccaggggcttagagttcttggtagttgccatttgggctagagcatcacccatgtagttgaaaatatttggactttgcgatagaagcaagaacgcgaaggagaatttaagcttatgcttcgaacggtagaaccaccgcctagatttcactagtatcgcgagtttaacatctgactctggttccctcttcttctaccaccattatgtcggtcaaagaggaacaaacacaggaagtaaaattggaatcaccagaaaactcagacggctatgacagcgatttagaagacgccactgaaagagatacaaggctcagaaaactgttgaatttggacttggaagaagcggataaaaaagtttggttggttagattgccgaagttcctagccgacaaatggaaggacccgaaaaacttgaatggacaagagttggggaagttgcgcattactcaagctcctgccagtgtgaatgtgaaagaaagaccttcacctcaggttcagattatattgaatgactcttctgagaataaagaacttcccttacgatacgatgtcaatattcataagagagtagtcgataatgaatacatttttagtgaacggaatttgaaagagtacaaaacagaggccaatgagatagctagtatgcctgaacagcctgaattgaagcctgttgagacggagattgacccagaaccccctagaggattcaaacggtacagagatgaatcgaagagttatgtttcctacgtcaagacaatccctaaagacacagctattgtgggtactgtaattcatgagtgtcaagcgattccagtcagaaatgatagaaattactctaaagttgtggaatctcgtaaaaacttgcgatacgttaaacccaaaagtaaagtcacattgctggataacctacctggagttatccagagtaacataacaccgaacttgatgcgtaataagaattcgaccttcttacgttcagaaaagaaagatcgtcgggcggaaggtagagccatcagaatgcctcagaaccagctactggatgtattatttggactatttgaccagtatgaatactggactttgaaagggttgagagagaagacctcgcagccagaggcttatttgaaggaggttttggagagtgtagcagagttaaacaagaagggaccttacgctttgcggtactccttgaaacctgaatacaagaaactgcgagacgccgaacgacgggcccgtcttctggctagtggacaagctgctccagataagaatgactacgatgatgatgaagaggagaatgttgagatggttgagatagcttgatagtagtttaagtatagcgtaacaggtaggagggttcaattccctcgcgacatctcgtatgggtgccaaatgtcccgcccatgcagtagaatctcgaagcgagcctttgttacaacttcagatatctaagagaacataacatctaatatcaattactatcaccgtgtaagtcaccagatatggcttccatcaattcgcagccagatcatgtagaatcggctgacattcgtgccaagttcaccaacagatcaaactttcccacggtgtcactttccgcagataatcaacttcaaaccaccccattgctctcatctactcctgtcactgtgagtaaggcattagtgagatcatacccttacctactgcttctgaacaaaacattgagtgtgttaacatggacgggatcagatcaatggctttccgtgttagtggcagtctcatatgctattttgatcctgtactttgagacccttcttacatactttggtcatgtattagccgtgggattattgggtcttttcgcctatatttccacccagattgagaaagagctccatcagaatatgactttggatgagattgtacagaccctgacatctgtaagtgttaaggctgacattttagcttctccgttggttgcgctggaattgacaccctatgacttgaagagattgctttttacaactgtgttcttgtctccgttttatattgtgattggaatgtttcttgttactccacgaacatggatactgttttcaggactattttggctgacttatcattcaagttggtctcgcgttaccagacgtattttatggaaatcaaaatctgtcaaacttttgtgtttctatgtcacagggttagatctcaatggcgcacattccaacaagaactctatctttaagattgctatgaacaagacgaagaagaagttaagtactttaggaagcggaggaaatggttcagacgtcccaattcgcttcacttatgttctttttgagaatcaacgaagatggctaggaatcgggtggacatccaatcttctcagttatgaaagagcgccttggactgatgaatttctaaacgaagctcaacccccagaatcttttgaacttccggagttcacagataaaagtggcatggtatggagatgggtcgataagacttggcgacttgatctaaccaacgacgggtcactgcaattgtcgtcatccaaaccaaggtctactactgaccctaaggcagatgatgggttcatctattacgataacacctggaaatccccgtctacagaggattcgttcgggaagtatacacgaaggagaagatgggttagaacagctgagctgtattctcctgaaggatactccagtagtgtttcaagtgagctcaacccagaaagaggtcctgtcagctcttctggcgcagatcctgtgtccaaacgatcagtatccacctcatcaagacgcaagagcatcagattcgacgatactcctacggtggtggaatcagtactctttggtccgcagggggtgaaggaggaggctccaaccacctcagctgataatattaagaaagaaaaggtagccgaggctaaagaggaaaaagagatcgatatagaaccagagcaagaaaaggagcaggtaaacgttgaagaaacgaaagatgccatagaaaaagataaaagtaaagccaaaactgactaaagtggacatctctcatctctcatctctcatcttgcatatcctcattatttttcccattttccccttccttgccctttcagtttatgtccgtgtgtatagtaaattaaatgatatttttttcaagttattgattaaattacactatccgaatctacaacttggtaaccttcaattgtggtggtaaagattgcaccaacttcttggccttgtcagcatcttcgacaatcagagtgtacagatatctagcacctctaaccttgaacttagtctgctggtatttctcacccttggagttgaatttagagttggtcttgacggtggcggacttgacgtctgctcttctagtcaactcaacaaacttcttgatatcagtgatttgtctaggcatttggtgtgtgtgttggtgtgcaaaattaatttggtcagactgaaaaaaaatcggtaatctcctcgcgaggaagaaggttcatggaggaaagtaggaggtaggagcggcagtagccctaaaaacaaccacgtgatcgtttcagcgaggggcaaggaccacagttgataaggtattcatattatccgctgcactactatcaaagcgattaggtcatctttcttgctccgtaggcatcattctatatgttcaagaaaagggtagtgaaaggaaagaaaaggcatataggcgagggagagttagctagcatacaagataatgaaggatcaatagcggtagttaaagtgcacaagaaaagagcacctgttgaggctgatgataaagctccaattacattgccacagagaaacacagtaacagaaataggaggggatgcaccacgagaagagcattcagtgaacaactttgccaaattcataaccccaagcgctaataagccaatgtcaaagtcggctactaacattaatagtacaacaactatcgattttcaaccagatgtttgcaaggactacaaacagacaggttactgcggatatggtgacacttgtaagtttttgcacctgagggatgatttcaaacagggatggaaattagatagggagtgggaaaatgtccaaaagaagaagcataatactctcaaaggggttaaggagatccaaatgtttaatgaagatgagctcaaagatatcccgtttaaatgcattatatgcaaaggagattacaaatcacccgtgaaaacttcttgcaatcattatttttgcgaacaatgtttcctgcaacggtcaagaagaaaaccaaattgtattatatgtggcagagacactttaggagttgctttaccagcaaagaagttgtcccaatttctggctaagatacataataatgaaagtaataaagtttagtaattgcattgcgttgactattgattgcattgatgtcgtgtgatactttcaccgaaaaaaaacacgaagcgcaataggagcggttgcatattagtccccaaagctatttaattgtgcctgaaactgttttttaagctcatcaagcataattgtatgcattgcgacgtaaccaacgtttaggcgcagtttaatcatagcccactgctaagccagaattctaatatgtaactacgtacctttccttttaataaatgatctgtattttccacctagtagcagatcaaattgttcaactttaagtctttggtccctcaagcgagagaacttgcgatgacactcaggagtgccataaaagccagaacctcaaaaggactgatcggagctgttattatagcctcaataatatttttcaccacagtaaccttctacgatgaaagcaaaattgtcggcataataagagtttctgatacttatacaggccatagcgctgtatcttcaactttcaatgcttcttccgttgttagtgacaacaagatcaacggatatggacttcctttgattgacacggaatcaaatagccgttatgaggatccagacgatatttccattgaaaacgaattgcgctatagaattgcccaatctaccaaagaggaagaaaacatgtggaaactcgataccactctcacggaagcaagcttgaaaatccccaacatacagtcgtttgagctgcagccgttcaaagaaagacttgataattcactttacaattctaagaacataggaaacttttacttctatgacccaaggcttacattctcagtttacttgaagtatatcaaggataaattggcctctggaagcacaacaaatcttacaatacccttcaactgggcacattttagagatttatcgtcactgaatccttatttggacataaaacaagaagataaggtcgcatgtgattacttttatgaatcaagtaataaagacaaacgaaaacccacgggtaactgtattgagtttaaagatgttcgtgatgagcacctgatacagtatgggatttcatcaaaagaccatctacctggtccttttattttaaagtcacttggaattcccatgcagcatacagccaagcgactggaatcaaatctttatctattaaccggtgcgccagttccactttcattaagtttcatgactaaaaagggattataccaagttggagttgaccaaacaggaaaacttgatccaaacattgctcgtactgaactatgggagttttacaaaaatgggaaagaaaaccttcaatttaatgcacaagaggagctatctcacctgatagagacagtcccttcatctagtaactcatccagtggagaaggctatttcactactgaattaaaggagaacaactttgagttgcccctgagtaagaatgattttacctttgatgattccgaggtcgagtcattgattaaaggtttatctgaacaggacttggaccttcatacccagagatacaaagaatctttgcagtactcttttgcgactcgagagaatgacgtgaagaaatacttttatgaggccagaatgattatcaatactgttaacaaagaaggtggagcgcattatgactggaggtttttcaatggagccatgaatcatgaaagttccggttttactgaggaagaaagacaactgagaaagagatctgttttgcatcgtttattgcgaaactggcttgtattcaattaccagcaaggatctcccacttggttggctcatggaactttactttcttggtattggaattcattgatgttcccttgggattatgatattgatgtgcaaatgccaatcaagagtttgaacaatctatgtgctaacttcaaccaatcattaataattgaggatcttactgaaggatattcttcttttttcttggattgcggatcaagtatcacgcatagaacaaaaggcaaaggattaaacttcattgatgcaagattcataaatgttgaaacaggcctttatatcgatatcactggattaagtaccagtcagtcagctcgaccgccaaggtttagtaacgcttcgaagaaagatcctatttacaattgcaggaataatcatttctactctcataacaatatagcacctctcaaatacacgttgatggagggggttcccagtttcattcctcaacagtatgaagaaatattgagagaggagtatacaactggtttgacttcgaaacactacaacggcaacttttttatgactcaattgaatttgtggcttgaaagagatccaatgctagcacttgtgccttcatccaaatacgaaattgaaggtggaggggtggaccataacaagattatcaagtctattcttgaactttccaacatcaaaaaattggaattgttggatgataatcccgatatattagaggaggtgatcaggacatacgaactgacttccattcaccataaagagatgcagtatctttccagtgtcaaaccagatggggacaggtccatgcagtcaaatgacataaccagttcttaccaggagtttctagcaagtctgaagaaattccagcctttacgcaaagatttgttccaatttgagcggatagacctttctaagcatagaaaacagtgagcagccgttttgcctaaaatgttccagaaactataggataaatatatacagtaatgaattaggtgatgttagcatttagtccccaaaaatacctcgaatctccagctccatagcgcaaaatctccaaatctacttcaagacgcactcatatgaaattcctgatgatctcgcgccaaaaggggaaaaatacattgtgtcgtgtgatcagactttgttttcctttggactctgtcagattttggttatcggcacacaaacagtagtttttttttgcctcaagctaaacttacagactcaaggatgaaagtatcaaagcggttgataccgaggagatctcgtctcctcattatgatgatgctactggttgtttaccagctggtggttttggtcctaggattggagagcgtctctgaaggaaaattagcaagcttgcttgacttgggcgattgggatctagctaactcctcgctatctatatccgatttcataaagctgaagctcaaaggccaaaagacttatcacaaatttgatgaacatgtcttcgccgcaatggcaagaattcaaagtaatgagaatggcaagttggcggattacgagtctacttcatcgaagactgacgtaaccattcaaaatgttgaactttggaagagattgagcgaagaagaatacacttacgaaccgcggataactttggctgtgtatctgagctacattcatcagaggacttatgacaggtacgcgactagttacgctccttataacttgcgggtgcctttttcgtgggctgactggatagatctgacggccctaaatcaatacttggataaaacgaaaggctgcgaggcagttttccctagagaaagtgaggcaactatgaagcttaacaatatcactgttgtggactggcttgagggcctttgcataactgataaatcacttcaaaattccgtaaactccacatatgcggaagagattaatagtcgggacatcttgtctcctaacttccatgtgtttggttattctgatgctaaagataatcctcagcaaaaaatctttcaatctaaatcttatatcaactcaaagctgccgctcccaaaaagtttgatatttttaacagatggaggtagttacgctttgacagtcgaccgaactcaaaataaaagaattctaaaatctggcctgctttcacactttttctcaaagaaaaagaaggaacacaatctgcctcaagaccaaaaaactttcacgtttgaccccgtatacgaattcaatagactgaaatctcaggtcaagccccgtccaatatcttcagaacctagtattgattctgctttgaaggaaaatgactacaagcttaaactgaaagagtcgtcgtttatttttaattacggaaggattctttcgaactatgaagagcggcttgagagtctaaatgacttcgagaaatcgcactacgagtccttagcttattcctccttgttagaggcaagaaagttgcccaagtattttggcgaagttatattgaagaacccacaagatggtggaattcattatgattacagattcttcagcggactcattgataaaactcagataaatcattttgaggatgagactgaaagaaagaaaataatcatgcatagacttcttcgaacttggcagtacttcacgtatcacaataacattatcaattggatctcgcacggttctttactgtcatggtattgggatggactttcttttccatgggacaatgacattgacgtacaaatgcccataatggagctgaataacttctgcaaacagttcaacaattctctggtcgtggaggatgtttctcaagggtttggcagatactacgttgattgcacgagcttcctggcccagagaacgcgaggtaatggtaacaacaacattgatgcccgttttattgatgtgtcgtctggtctcttcattgacattacgggtttggctttgactggatcaacaatgcccaaaagatactccaataagctgataaaacaaccgaaaaaatctaccgactcaacaggatcgactcctgagaacggactcactagaaacttgaggcaaaatttgaatgcacaagtttacaactgtagaaacggtcatttttaccaatactcggagctatctcctttgaagttgtcgatagtagaaggtgcactcaccctaatacccaacgattttgttactatattggaaactgagtaccaaaggagaggtcttgaaaagaacacatatgcgaagtatctctacgttccagagcttcgactttggatgtcatacaatgacatctatgatatcttgcaaggtactaatagtcatggccgtcctttatctgcaaagacaatggcgactatctttcctcggttaaactctgacattaatctaaaaaagtttttgcgcaatgatcatacttttaagaacatttattctactttcaacgtgacacgagtgcacgaggaggaactgaagcatttgatagtaaactatgaccaaaataaacggaagtcggctgagtacaggcagttcttggaaaacttgcggtttatgaatccaatcagaaaagatctggtgacttacgagagtaggttgaaggctcttgatggatacaatgaggtcgaagaattagaaaagaagcaagagaatagggaaaaagaaagaaaggagaagaaggaaaaggaggaaaaagagaagaaggaaaaggaggaaaaagagaagaaggaaaaggaagaaaaggaaaagaaggaaaaggaagaaaaggagaggaaagagaaggaagaaaaggaagaatatgaagaagacgataatgagggcgaacaaccaacagaacaaagagccagcaggaggctaaagaatagcggaggaatgcaaataataatctccttaattacccactgataagctcaagagacgcggtttgaaaacgatataatgaatcatttggattttataataaaccctgacagtttttccactgtattgttttaacactcattggaagctgtattgattctaagaagctagaaatcaatacggccatacaaaagatgacattgaataagcaccggcttttttgattagcatataccttaaagcatgcattcatggctacatagttgttaaagggcttcttccattatcagtataatgaattacataatcatgcacttatatttgcccatctctgttctctcactcttgcctgggtatattctatgaaattgcgtatagcgtgtctccagttgaaccccaagcttggcgagtttgaagagaatgctaaccttgcgtattccttgcttcaggaaacattcaaggagaaacaggtcaagaagccaaacattttgatccttcccgagttagcattgactggctacaattttcaaagccagcagcggatagagccttttttggaggaaacaaccaagggagctagtacccaatgggctcaaaaagtatccaagacgtgggattgctttactttaataggatacccagaaaaaagtttagagagccctccccgtatttacaacagtgcggtacttgtatcgcctcagggaaaagtaatgaacaactacagaaagtccttcttgtatgaagctgatgaacattggggatgttcggaatcttctgatgggtttcaaacagtagatttattaattgaaggaaagactgtaaagacatcatttggaatttgcatggatttgaatccttataaatttgaagctccattcacagacttcgagttcagtggccattgcttgaaaaccggtacaagactcattttgtgcccaatggcctggttgtcccctctatcgccttccattaaaaaggatcttagtgatatagagaaaagcagacttcaaaagttctaccttgaaaaaatagataccccggaatttgacgttaattacgaattgaaaaaagatgaagtattgcccacccgtatgaatgaaacgttggaaacaattgactttgagccttcaaaaccggactactctaatataaattattggatactaaggttttttccctttctgactcatgtctataaacgagatgtgctcaaagagaatgcagttgcagtcttatgcaaccgagttggcattgagagtgatgtcttgtacggaggatcaaccacgattctaaacttcaatggtaagttaccatcgacacaagaggagctggagttgtacgggcagactaatagtctcaaccccagtgtggaagtattgggggcccttggcatgggtcaacagggaattctagtacgagacattgaattaacataatatacaatatacaataaacacaaataaagaatacaagcctgacaaaaattcacaaattattgcctagacttgtcgttatcagcagcgacctttttccaatgctcaatttcacgatatgccttttctagctctgctttaagcttctcattggaattggctaactcgttgactgcttggtcagtgatgagtttctccaaggtccatttctcgatgttgttgttttcgttttcctttaatctcttgatataatcaacagccttctttaatatctgagccttgttcgagtcccctgttggcaacagagcggccagttcctttattccgtggtttatattttctcttctacgcctttctacttctttgtgattctctttacgcatcttatgccattcttcagaaccagtggctggcttaaccgaatagccagagcctgaagaagccgcactagaagaagcagtggcattgttgactatgggtcctccagatgtcaccgaatgctgctgagtgggagatcctgggtgattgttagaaggtgatccatcgtggtgctgacggaagatctgttgatacgctaacaaattggaagctgttggagcgtgttgagaggccgaggcatccacagaagcagcggcggcagcagcagcagcagtcgcagcatctacttgttgtctgatatcgcttagatggttttgagctcctttgttatctttgtcttgctctaacaatgcagagtcaattgctatgtcagaatgagagtgagattgttctctagagtttttctcatggtcaaatcctccagggccctgattaagcttgccgggggacttcttaaattttttcaacccgtgatctggagtctgggtgtgtcgtttgttaacttgcataatctgggataggggaggtcaggtggatatgttgtgatcaaaaaacgtgagcaggttggggggtgagagcgtaaatgggtggcgcacgcacgatatgtgaacaaccaaactatcattatgaatttggtgaagcttgcaagtcacctgatatactcttcgcgtttgatttttttcgaatccctatcagtctttatccggagagaggggccaaccgaatactcatctcttgctctagaatgttcaaaagattgtatcattcagttcattctcgtccattgctagatttggctaaaccggagatacgcatattatcacatgctttgagtaaatttgttccgaaatatgggttttcagaccgttccattcagaatgcccttttggatttgggctattctaacaacggctttgtcagtgttttcaagatgaatgggcattcagatcctgtcatgtcattgataaaccaccaccttttatcccaaagacagaatctcactctcgaactcgaacatctaagcactttgaaaagtgagacaagcaagttaaagcatctggtcaccaaaagactactaggtaatgctcccattatagaccatctacacgaagctctttcttatatgatacttccatcaaatatggtggcttcaatggccgaattgcacaacttgtctgacgatatttcattctacgccggtgaccgttcgaatgattttgcatggtattccaaaaggcttgccttgtcgacagtatacgtgcaaggcgagctgtgcatgctaaaagatacatctgaagggtttgctcacacaatagattttgtcacaaagcggttggacgaaattgagtcccttggctatgcttataactccgttgaagaatggggaggatttaccttgatgagtactgtcaacttgattaaaagtcagttggttcgtggataaggttgatagatacataaattaaaaagagggtatcatgattatgctaaatgttttataatttgtataaagcccaggttaagtttgggtttgctgagtcctcaatgttatcagttcgtctctcgtagtctccagattcttttggtgatcttgaatgtttccttccaccttttttatctcgttttcaataaattctatccgcttcttcacgttaatatcagcttcattaaaatcttgaggcactaacactgggcctattagcttgaagactgtggatgattcgtccaatttggcaaattcctccttgacaattttgttttcttgatactgagtctccaattgttgacgagctttaatcaaatcattgagctcattctgcagtttgctgaatctcaaactgatatcttctaggtttttttgagacatttctttgctgatcaaaaatgagtggtgaaacttgagatgtcaaacgtaggaaccaaatactttttatgggcgcgcgatttgccacggatagggaggatttccagttgtctctaaaagtaccgttccactgtttatccaagatgctcattaagccctgggctgagacaattccacgccatgagctggctgaagaactagaagatgaattgccaattgagcctgttttgagttactcccaaattgagactcccactcataatcaattcctgatcattggcaactctaacttcaacaccattctaaactccttcgacaaactgaccgaatatgcaacaattagtatcgattacaactcgtcaaattccaagaatgatgatgacgatttccatgaggacgagcaattgtaccaaatcaacaaacagtctgtttttgagcccaaaacaatcacagtctatcgaacagtcaacaataacaaccaaaacgttctgctggtatcagttccgctatttgccaacatttacacatacaacgtcctggccaaatttctcctagtccatttgaacagtaaacagatccttgtcttgggcagttcccagctagaaaacgaacttttagcaaagcttgccaccaaacaagactcagagttagatccaaaactgaagcagattgctcaattgaagccgcctagttttgttacaggaatagcagcaagtcttctttccactggaaagactctacacaaagatatggtcgccctactattagatggtgatggtcccattgattacgaaaggctcaatgagaatggattgaacgcttgtacctctttgctgggccaagtggtgcatgttgatttgaatcgtaagaaatccttgaatagaccagggttgtacctttaattgagtaagtatccagcagagaaacaagttgtacctcaaaaatatgaagccctacaaaaccagatgatcttcaatctggataacatatgacgctttttcttttccaaagagtaagtctctggagtccttctttcgtattctagctcgtatcgtcttatctcatcttacaaagctttactagtttcctctcgaaataatttttcatctgagttgcacacgctgaaaatttttttatttctcacacattagccattaccatctggtctgagattgacaactaaacatacaaagaatgggcggaatcgactatttgttgtttgaagaggctactggatacgctgtattcaaagtcaaactgcaacaggatgatattggagcaagattaaaggaagtccaggaggctgctaaaagctcaagtttgttcaagaagatggtagaacttgtttcttttgccccattcaaaggtgctgcccaggctttagagaatgctaacgacatctctgaaggtcttgtgtccgactacctgaaatctgtcttagagttaaaccttccaagtggcagttctaaggagaccattggcctcggtatttccgacaagaacttgggtccttccatcaaggaaattttccctcatgtggagtgtcactctaacgagattgttcaagacctcttgcgaggcattagaacttttggattcaaccttttgaaacagttgcaagagggtgatatcgagcgtgctcagcttggtcttggtcacgcttactccagagctaaggtgaagttctccgtacaaaagaacgacaaccacatcatccaggctattgctttattagaccaattggacaaggacataaatacatttgctatgagagttaaggagtggtatggatggcatttccctgagcttgcaaagattgtcccagacaactatgagtatgccagattagctttgtttatcaaagacaaggcttccttagacaatgattccttgcatgacgttgcacagtttgttaatgatgatgctggagttgctcaaaaggtcatcgatgctgcaagaatttcaatgggtcaagacatcagtgaccttgatatgctgaacatctccacttttgcccaaagagttgtttctatcactgaataccgcaaacagctgtacaagtatttgaccgataagatgcattcggttgctcctaatctttcagagctgatcggtgaggtcatcggagctagactgatttcacactctggatctctgaccaatttgtccaagcaagctgcttcgaccgttcaaattctaggtgccgagaaagcgcttttcagagccttaaagaccaagggtaatacgcctaagtacggattgatctaccattctagtttcatcggaaaggccagtgctaaaaacaagggacgtatctcccgatacttggccaacaaatgttccattgcctccagaatcgataactactctgatgagccatccaatgtgtttggtaccgttttgaagaagcaagttgaggacagattggcgttttacgacaccggagtgcctccaagaaagaacatcgatgctattgccgaggctttgcaattgctcggatctagcaaatctgacatcatcgaagaggaagactctgtccagccggttaaggagaagaaggacaagaaggaaaagaaggacaagaaagaaaagaaggacaaaaaggaaaagaaggaaaagaaggataagaagaggaaagccgatgaagataaagaggagaagaaaaagaagaagaagaaggcttgaacagattgcatgtttatgtatacttagttgttatgtagaattaattggtgacaagagttcagtcgtcgtagaattgagcagctctgtcttcgaaggcattctcattggagtatgttttcaactcacttgtgatatgacacacaacttgagtgcaatgccgcgacaatttgtgaatttacctaatctaatcaatccggcagtgcattctgagtaactcttgtgcaactatctcttaaagaccgcaattgctaaataagttcggaaaatgtcccataaagactccaaaatgaaagatgccgacaaacacaaacctggtgaaacgcacaccaaacttcgcagcaagtctttatcaatgagaagagaatcttgtgacatccccacagagagtgacttcaagtttaaacgtcgtccttcgttaccaacatccccgtggggtcgccggagatcgtttttgtcgacttcaatgatgtctaatgaaacgcactctgtatacgaagtgtcatattgctttaaccaacctcctacgtttataatgggacttcaagaaagccagggatttgtgtggaatcaagatctatttgcttctcagcatcagcaagccaaatctgtaagattgaacagaattttgcgtcgccattctagtacgggccataacgttgtcaattccagaatttccccatgcgtgccgttggatgaagatccttttgaagaaagtgatcatgaagggattagggtgtcagaggtcgtcataaacaacgaatctagcgactcggaaaacgaagcaacagctacttaaggatacaaagaacccacatgagtttccacaaatgtctcaaaatgaacagatcagactagggtctcgatgacccaatgctcaatttcccctttctcaaggtgcgttcgaatgccccacgcatgctgggccgtttctcctttttattggtttcgcgactttcccaaattctatctgcttttttggaagcctcctaatctaatctggtacaacatgctggtaactttccagttcaaagagaaaccgcaaaaggttaagaaaccttcgaaggcgtttgcaaaaacgcagaaaatggaagagcacttgttaatcgagaacgctgattctatttcgctgaaaaaacggtctaggaatggatgtgtaacctgcaaagttcgaaagaagagatgtgatgagtcgaaaccaatatgtggagattgtgccagactgaacaggccttgcaagtacctaaacgatactatgacacctgaggagaccaagcgcatcaaatcagaaatactagttatggaagaggaatacaaatgcagacggcgaaacaaaaaacgccccaagtcatcttcaaataaacagaacaaagttgtatttaaccctttgacaccgttggcacccgaaatgcccttatcagaagaattcaccggggtgcctttagctagcgcatcgcaaccatctcatattccacatacagatcatgttgactcaccaaattctctccacaagtcacactccatacatgatctattttctcaattcagcaaccaatttcccttttctccatttatgatgaaatctccaaatattgaaaacggagaagctgggacttcattgcacgacctgcctgatctacatctggatagcgagtttttgcccacttatcaacaagagttcgaagctgaaatgagcaaggacattgacttttcgaataatgttaatcatcatcatcatacccacaataataatcacaatgttgaaaacaacagccaatacagaccactatatgagagcaaccgagtcgagctactagaggaaaataaaaatcagtttgctaactccacacaaccacacaaccatttagaaatcatagacaatccgtccttgattgcgactactactttaagtgtcttgaactcacaggatatcatgtactatgattatttcaagcgtagactgtcgagaataatatcgattgttcctgagaacgagaatctttatttgaaaatcttcttacccatggcacattacgatttgggatgcctatatggaattttggcttggtcctcttttcacatgggaaatcaccaccaagctaggggtaacgtatatgtggacaaggctctaaagtacataagcgataccaagattaacgagaacaatacagaaccagagaacacggccaccaaatggctttcaaggcacaatcgtgtcaatatgcgactagctagcttgctgataatatgtggtgctgaaatatgtaaaggagacgtaaaaaactggggaagttatttggaacaagcggcgaggttggtgaaacgcaacggtggtttgagtagcttcaacgagtctcaaagtcagcattggttgatagcaaatatggcctatcacgacattctgactagcagtgcaagtgaaagaggattactcttttctttagaggaatacgccagggtcgtcaatttcagtaagttcggattagacccacttcatggaatatcaaaaccattatttcaaattattgccgaaatcagtagtttggccactgaagttaaacacttactgaaacgaaccaccaatactctaactaatcaatatttgggacacgcaaacagtttggattctccagaatttgattatgctacagacattcctggaacttcctcaacatccggaagtacatctgatgaaagtgttgcagctgagtttgaaagtcgccatgaggctctttcgtatatcaatacaaaggcaaatgatatactgaaacgcattgatgactgccaccctaatatggagtttttacggacattgccgtctaaagacttgaacttgcaactatcattgtttcaagtttttcagcttgctgctaaacttcatgtacagcagtcagtattgaaaaatcctgcgacttcattgcccattcagttactggtatgcgagatgtcccagtacttggaccatgttctcaattctcccgtagaaagttgtctctgtttcccattgttcatatgcggaatgaattgctgtactaaaaaggatcgtaaattggtcagagataagtttgacgaatacctggatcgatatcggtatgggaatgtggaacgaacaaagattatcatggaacaggtctggatgatgaatcccacaggaagcaagaatatcgactggtacgaaattgttaagaaattaggctggaacttgagttttgcttagaattgtcctaccatttcattttagtctgcagtttttgattaaccatatatatacataacttaaatattggacaaggttctattattcaacctgtacttgatgttctccatgacaaatttcaacccttgcctggacttactaatattctcatcaaatttactatgtgaccatttttcaatacgattcttgaccccaaatcctctgaatccgctggaaaacttaactttactcttgcatgtggtggtttgacattctttgtcatattggaaggttgtgtattcttcaatccgaatgatccttgtatggtccaaatttcgggtgtacgtattcattgtctgagacacagggtcgatctcagtcatttccaaaatgttagaatgagagatcttgcccagaaagggctttacccactgtggtagtcttccggtcttggtgataagtttcgtttggtgtagtttgccatctttgtcaatatgtctgttgagagtgtctatcgatagaacgtgagtggaatacggattaggataccggttcaggtaagcaagcgatacagtggtaaaatcatgattgaatatgtgctgattcttgtaccaaagaaccattttgtgatgatggcttttagtgtattagaaacttatcattttccattggtcatgtcatacgaagctttatctggtgttgggacgctaaaaatttcaatgtaatctggggtccggtcagggttggggccactgctcgattattatatagagggtattattaattatgtagggacgaaatggacgaagatgagatggccttattagatggatcgactgatgacatgccttgtagttagtttgtaaataacactttgttgtgaatgatggacagtttcatctctaagtcatccaaatcgtatgtagactggcctttcactggtacacctttaattccatgttgcgccaattcatcagcatcaaccaagatttctccttgctcaggatagaaaacatgagtgataaaatctctgtattttgtgcgttttgttttcgatagctttccgttctgtaacgacatactatagtccagcgcttcgtgtatatgcttcacgaaatctaacgcagtcatggtgaaagtttccctatcgtatgaaccattgagtaaaagaactttattaccccttttctttgatagaatagcttgtcccataccttgcaatattagcaccgggattatactggtaaataacgagccaattgagtaaacaacagtttcagccgaatcaactgccttaataactctggattgtgcaacagggaagacttcttccccgtaaggagaaatataaaacacccgtcggatgggagacgggagagggatggaatcatctttagtaaaatgcagttgagattttgtcagttcgggatgcgtataaacaggaacagcaaactcgttctcattatcacgttcatgattgtcaattagaagttttctgatcatctggtaatcgttgaacgacgatgcggtgtgagatgatggagtgggagtattttgaccgttagtggatgaaatttcaaaattttgatccttgacggttttgctgattgggtgggaaatttgagactggcccgtaattatggagccgtcttccagcacagcactgatatggtaggtaaagttggtgttgagacaaggcaaaatactggtattctgtggaatattacaaatcctcaacatcagttcaatagcagaatcaagggatcccacaaataatctagcgccgcttaaaaacatattgccaatactagccttagcaaagttaaagttgcgagccccaggccttgatttcttaagcaattccatatgaatatggatcaaaaatgaccttatcagctctttgataggcagttcaatattcttccatacttgatgtgttccactgactatttcattccattcaatttctgcttgttgctcttcttctggcagccgataggagaagaagtgcttgtagacaggattaggtattagccttgtgatgcgagatctgacatctccaattgccgggcctccaatgacacgaatcaattcagatgttgaaccaccattatcactaattggcagaatataagacacagagttggatatggattcgaaaagattaaccagctcgttcgttgaagttccgcctgatataaccgtgaacatcaattgtgtctttcttttttctcttgtagaagggttgaatgttagaggaactaacttagcaattgctcgaaacccattagtagttcaatcttttagtttctctttttagtccgtccaacaaatgctacatcgtctacctttcggacaggccataaggggccgcccgttacagagtggtgtcctgacttctatggctaggccactaagcccaaaaagtatccgcatgttctctttctccaacgctgctaggaatatcgatatcgaatcggttaaccccatcaaacacgagctgaaggccaaccaaatagtgaaagttcgaacccaaaactcatggtttgcagataagccattggacgagaagtttcgtaaaggtcattccccgctgtacgagtcgcctggtatgcaaatggttgctacagcgaagagagtaactctgggatttggtttagcagggctttacttcagcaagcttatgttggacacagggctatttgcgctccctgcatccacaactttagctgttgtcagtataataccgttccccttggtgctttaccttttaagcccttatgtgtctcgtatctatagactgtatgacgacaccaaaccacagactttggaaaaccttacacagaacgaaaccttggttatggagaaaattaactggtctggtagaaaagcattcaacgagttagttcaagtcaaagatttacgaattacaggaccatctacctggtttagctggccgaactggaaagccttagacccagagacaggaaaaccaaggtattactatgttactgaccatgttggagggctccgtatggaccgcatatgggggatcgctgaacggcaatccggagtggacaacggtaggtccttttaaagagttctttggactatgtactttatctgtatataataatattgcattcgcgactttctactttctgcagctggttccaccgcttaccttctctataactttaaacctcaagtgatgagagctgttatccagaaagtcaaatcagcctcggtaaccgttgagggcaaagtcgtttcccaaataggaaggggattggtggttttggtaggtatatgcaatgaagacacttttgatgatgttgacaaattggcaaatacagtgttaaagctgagactgtttgagtcagacgacggatcaaaaatgtggcaaaaatctgtgactgatttgccaaagggtcaacttttgtctgtctcccagttcactttgtacggaaacgtaaagaaggggtctaaaccagacttccacagagctgctaagggacacattgcactagagctctatcaacagtttttagaaaagttgaaaaatggaatgaaacatgtcgaagagcctgaaaatagcgtacaggatggagtatttggggcaatgatggatgtagctctaatcaatgacggcccagtaaccataaactatgatactaagaacccaaaagatagacaaatagaagacattcagaactgagttgaatattattatctgaatcgggaaacactggcttctcttgaagcattcctcgtttttgaccgggaactggctcgaggtagtcgtataacttccgtaaacttctccaaagatcttccaattctagactctctatggtgagccttgtagtttactttgacagtcttcaatctgttggcaaagtactgcttatggtactgtgtattagtctctaacatttgtaactcctctagtcgggattgtagatcgctaactgacggcgcggtggtcatggcaggtaacggcgaaccaaggttggaatggctggtactcagtgcttcatagtcagaattcactatgatcacaggaacaagtgcgtattccaaacaatatttgcacattgattgaggggcaattagttctttcagcccccaccgagcatggtaacgatcagttccaacaacaagcatttctggctcatactccgtggttgctttagtaatataataagaggccctgccaatagaaacttctagcacaatttcaatcttcttttgatgttcattgagagcagccatcctttctaatagtttcgcagcctcattcttataatggtcttcttctctatccattatccaaaggcatattaccatgtcaccgtcgttcattaactcatcgatgacccatttcaaagcggtcatggaccagctttcgtcatcataggcaaccaaaactgtcctgctggtacgggagtagttatattctgcatggctcactttcagggcgtatgtctgaacatttttgacaaaccgtggcgtgtgcatcgtatcaaaagacactttgttttcaaatgatgcgttagagctcaaagtaggcctaatgtgatgatagagaggcttatcaacgtctgcctcctgctcctgagtggtgctgtcatggtacaacatagaatttactcttgtgttgtataatgtgcttgtaatgtggtcaccatcctcttcagcagcaacgtttgcacccatggcagttaccgcacctcagtgtagctattaagcaggtaaaatttcagtcgaatgccacaccgatttgaagataatcctgacagatctcatcgtaaagattcgtgtcacgtgatatcgggaagttggtcaggtggcattacataatcagaactacaagtatgggctcattccttgggacacagattgcagttaaagttatcacctttcagtgtagtaatgtgtcgtttccttatattcaagggtgaagagcctatgctgcttgccaatttgctgactcgtccagcccactctattatcaaccaatcttttgattctagattgagagttgatatgagaagaccaatgaacggtgatgggtttggggtcggctactacaccgaagaagacgatgacaatgactgtgccgctcatgattcggacggtccttgtgttttcagggccatcacccctgcctggaataacttaaatttggaaagattagctgacaagaccagaagtcgtctaacgttcgcccatgttagagcttctacgtacggtgttctcagtgaaactaattgtcatccgttcacatatcataacattatgttcatgcacaacggtggaattggaaacttttcaaaagtgaagagaaaactaataaatcatatcgacgatgagtacttcttacatattcaaggatccacagattcagaatgttcctttgccttgtttttggacactttacacagaatgggacatgaccccaaaggaaaagatcttggccacaaaatattgagagaatgtttggtaaagactataggtttcattaaagactgggcacaggaggttgagctcgatgcatctgtgaaagaaccatcactactaaattttgctgtcactgatggttcatctattgtagtgtcacgctatgtgacctccaagacagacgctgctgcatctttgcattttagcacaggctcaagatttttggagtatgagccgggacaattccatatggaacgtttagatcgttcccagaacattatcatgatagcatcggagccattaacctttgagaggggagactggattacagtgccaacaaacagcactctttcggtcaagggacaaactgttttactgcatcctatagttgatgagtactaccagagtgaccccgccttcgaaagaaatgcgtcctttgcagaatcgaaaggacttatgggctccttgcctgtatcaggcactattgagtcctccctaccacctcttgacagggagggacgtaccagatcgtctatggtgtcagttaaacagtaaattttcaaccttgtattatgtaatcttatgtatatttttttttcatctcgcaatggatacctctctcctccatcaacaacccctagagccaccacatgaacaacgtaatattcacagggatacgacctgccgataataggccgtactccgaaatgacgcaggaggaacaagctgcagcaggagccgatgccatgataaatttcatgcaatcctgcccaggaaagaccataatgagtggagtatcaggttttgtgcttggtggttttttcggtctgttcatggcatccatggcttatgatgtcccagttggttcagaaggagttaagcacatttcagatcttcctttgaagcaacaaatgaaacttcagttctctgatatggggcgtcggtcctggtcgagtgccaaaaacttcggctacattggaatgatttattctgcagttgagtgctcagtggagagccttcgtgccaaaaacgatttgtacaatggtacggctgcagggtgcatcacaggagcgggattagctatcaagtcagggccccaagctgcccttctaggatgtgcaggttttgctgctttcagtacagctattgacatgtatatgagaggtgaagcctctagaccacctcctaatgattatgatgactaaagagaggtaaatggggagagtttttcattcttatttcaacactattgtacatatcattattaatttcacacagatgttctttctgaactgagaaagacaccactaatctgctagtaggaaggatcccagcaaggccagcattccgaagaccgctcctattaacatgtagaatgctctccaagagttacttggaggcaagctagttgaaggattgagctgagaggggggccaacgagatatcctatttagatggctactctgcaattcatatgctgtgtttaatggcctgtgatagtcctctatattttggggtgcttggcttttatgagtgccgagcttttcggcagtttccaaattttcctttatagacttaagttggttctctaatgagataaaagtttcttgaatatccaattccaaggataagatttccttttgaaatttgtgctctaattcatgtagtttagtctctatggagttgatatctgcgaaaagagaggagtcgacttcctgttccaatcgttccaattctaaagaggtcgaccttgaacctgatcttgaaccttgatttgactttggaaagttccacggagctgccgcagtttcaaccttaatggcagttttcttcggtaaatagtctaaaggcaaaggatctccaagtatgctattttgtctttggctgacagatcgatgcctggccactctggaagggtctatggttggaggcaactgcggattttgaaagagatatttgtctctataaagttgctggattcttgagacctgatctcccccatcctttgggttcgaagccattgactgatagttccctggtgtgtgtattccttgggagacgcgaccgtgttcagcgacaagattgaaatatacagaaaaaagatggtagatgtctgatacagcaattacattgcaattaattctatattaacccatgggctgaggtctatttgcttataagatcagaaatccgggggggagtatgtggcttgtgtggcttgtgcgacttgaggaatctctgtggtaaaggttcgttttttgtggaattgtcaagaggaggaggaggaggagttgacgggtttgaagattcggatgcattctgggggtggtcgttgagcagtgaattcacacttatcgcattcatattgctgaaaaaggctttcctggatgtgtcaatatggttggtataatcaacggctaaaggaggtaagatattgcctgtaagctgccgtatagaaggcagtatcgtcctctcgacgttgtttgcaggagactcatctcggcttaaatttttagcatgtcccggttcctttgcgatggctcgtttccttctttttatcattgtccttttcaagttgactggtctatgggatccatgtagccggtagtataaaccgcaggcattgcaaatagtattaccaatgttatctcgtctccatagtggagtaactgtggtgccacaattggtgcaagctatagccacggattgcaagccagagctttcctcttcatcgttggatgaagtatcgggagatttaactgtggaatttgattgtttgtgtttgaatgtagaggaaatcactctattattgaatgctggacagcctttgcaagcctgagccccgccggtaccattacacctaccgtcacctttacaagttccattttcgaggtcactccttgatacagtgaccacttttggcggtcgtttcaagttcactggacggtgagagtttttcgcccggtagtaaaggccacaagcgttgcagactaacgagccatcagcagcacgtctccataacggagtcttcgcagttccacagttggaacaaacatggctactatcatctgaaacagtagaaggtgacgttgacgatgttgagtagctttgggacggctggggattatctatgactggggaagtatcggcgctagtagagctggttggtttcgcactcattgttgttgatgatgtctttgtaagtattctctgtggatgtgattattggatgggcttattgatacatagtccttgctgggggaagcaacaaaatgggacagctgagtagagtggtgatggcggtgtaagttttcttcactcttaacgagacgcggcataaaagtctaaatcctatctccttcatctatagccaataagaggtgaataattacaaatccactactgagaacactacaacgaggtcgtgtgctgacagagagtatttatatgacacccgaagacgaacagaaagccgagctggcacgttagtcggagatatagtgcccaaaacggaactattgggtagtgcacttaaatagcaaggagaaatttcacaactcaaaaaatcgtatgggagcgtggggaggtcggatgtgatcgactacgaaatcttggcaaggtttggaattgaacacatcatcaaacacatagtaccgaataatagggagaaatcgatgataccgaaagattgatcagattgatcaaaattgaggttttactatctttttcgggtaaaaagatccgatatcatgagagattcaattacggtgggtttggtgggcagaaaaccgttgaaaagggctcaaaaaaatcactcccttagattcggctaacattgagaaatctatcctatttttaaagttgagttgctatgatttactagactcttctcataaacattcgataattccccctatttttcaatgaggttgagattttctcctaacctttgctatgtggatactgttatcagatgcatgacgctgcatattatccgacttatctggtaattgataaataaagactcacctagtgaggagtaggtttcttcacctcaatgtgtacaacttccagtcgttggggttccagttcacttactctttagtttattggcctttttgcccaaatatcactaaaaacctcccccttttttttaggtttttggtatttaggctactccccagtatttaccataaacggtaagaatacccttctaaacggatctcttgacgagccgcatgaaactgttatcttcattatcaaacacataaattggccatacacaatccagtttccaagatatcaatcgttcctaagaaattcctctgttttgctctactgggccaataagatcgtagcccgcatatcgtatcacattctatataaatacacagcaaaatccctcctctctagccaattcaatcattcgattaataacgtctttattcgacaatgtctgaagaaactcctctcccttctggatactacgactcaggaaccggaggaaactcccttgaggtcgacttgaatgttcgttttgacaaagctgacatggtatgggttgctgtcagtggttgtttagtcttcttgatggtccccggtgtcggtctgttatactccggtctggctagaaagaagcatgccctttctctattgtgggcgtctttaatggctgcgggtgtggtctcgtttcaatggtttttctggggttattccttggtcttcggccgtgactccagtaacttcttgggtaacatgacaaatttctgtctgatggatgtccttggtgctccttcaactgctagtaccgttcccgatattttgttttgtttctttcaaggtatgtttgctatggttaccggctgtttgatggttggtggtgcttgtgaaagagcagctttaggtcctatgatggttttcctgttttgttgggtaaccgttgtatactgcccaattgccgcttggacatggaacgccaacggatggttggctgacctcggtgccttggactttgccggaggaggacctgtccatatgaactctggtgctggtgccttggcttatgctttatggttaggtaagagacacgatccagctgtggctaagggagttcccaagtacaaacctcactctgtgacctccgtcgtcttgggaactgttttcctgtggtttggatggtttggattcaatggtggttctactggtaacgcctccatgcgttcttggtacgcatgtgtcagcaccaacttagctgctggtactggtgctttagcttggttgttcgttgattatttcagatttggtcgtaagtggactaccactggtatgtgctgtggtgccatttccggtttggttgccattactcctgctgctggttacacgccagtttattttgccgttgcctttggtattgttgcaggtactctatgtaactttgccgttgagcttaagttcttgatgaagattgatgacggtatggatgtcttcgctcttcatggagttggaggatttattggatctgtgatgactggtctctttgcagccgactacgttgctgctcttgacggaaccgaaattgacggtggttggattaaccagcattacgtacaactgggataccaattggccgcttgttgtgccaccttactttggtctttcggtgttacctcaattttgcttaatatccaagacagaattccattcttaaagttgagattgtccgaggaccaagagattattggtactgatgctgctgttatcggagagttcacctacaatgaggatcaacaggacaacatgttcattcctcaacctgagccaactccattgtccccaatcaaatcaatcagatctgtgttgggcaacaacaagagccaaaaccctccagctaacggtgagaccctaggatccgagaccagctctggcaagccagagtaaacgggctcaaaataattaatatgcgataacaaataatgacttgtattgtatttagttaaattaattactgtatgaacaaagttattacgaaaacaaatggccaaacttcttggtcaacacccgcaacttggacatgtaggtgtccttattgaggtaacatcctttcaagaatctctcttcaccctctttcagtacaaactcatttctggaatgcaaaattcttctgttgtcaaagattacgcaagtattttctgggattttaatagcatattggttaactggatcgtgtacaaactcttcaaacattgctaaaccccgcaggaaatctttgaaaagatatgagtcaccgatttccttggcattgttaacattggaggagatactatgcgaagacaccaggtcgtccttatcctggggagagaatggcttcgtgataccaaattcgaatggcgcttgaaatgagggggaataattgcattctttgatcgtgtgttggcccgttgcaaaatctgttgaggcctcatcttcgacaactagtggccttgcatagtaatagtattgctcgtcattttcgtaatggtacgaaatgggtacattcgttaaagcaaagtaggcttgcggttcagtttgggcgacatatttagcagcaaaaaaagaatcggcaaatatcgactctccaccctccacggagttcttaatggaatgaagcaattgcaaacctgggggcgattggtagtacaacagatccatatgaagtggcaaagaatgagatgtgtaagcaatgttcttggcgttgtccaccgatttgacatcaaataacttgccatagaaagtctccctgatataaccaattctcgtcgcaatatcctcaataaaccatttgttagtgttttctttttgtttaggaatgttgtttataaatacaattccataggtgttaatctttttcagaacgtcaaacaaaactaagtcatccttgatataagaatcgtattcgaagtctattttccccttattcctagctgtgaccaatttactccgatcccattgaataacatcattctcaaaaaatttaccgattctacgagcttcaatgttggaatattgagtcaggaactgtttggaataggacgacttatgaactttaccatcgccttcgtcccattcaatctccaacattgaagcacctgttcttggatcttccaccactttaggtgtggaagctggaattgatttgggtacaatctctgacgtcttgaacaacttctgtttcgagtctttatgaattgacttgtctgccattgtacacgagtctctaagaaacacgttgtggtaagttaccaacatcttgttgtctaactttatagtcgtcgaggtatcggagctatcaaccagctccaggccggtattcgaagctacggatgccaatcgacggatcccttgcacttgcaacctaaagttcttatacaccaaactctttaacattatgtcgaaatgtgagggaagaatctcagaattctgtctttgtaaactgaagaaagaacaagactgaaataaatatcatacgacggggtcggcagtatggggaaaaaagagatgatcggttgggtcacgcgcagggttggaaacgccgaattagtgctatttgcgttcggacaatagaggcgagacaaagaaggcttacaaggatacgatgatcaaggcaagaggtagttgatggatgaactgatactagcgtcagggtcatcgcctggtaccccatgtttctactcggcgttaccatgacatctatcatccaggggggtgtagccctaatcgcgaaggagaaactgacgacccactagcaaatctgaaggtgactacgtctgaaaggaactaaattttgtttagttgatgacagaaagtgagaacatacatccaaagagtgctcttcattcaaagtcaaacattggtttagtaaatggttttatcgtaagtatatcattcaccttcatatatagattgataacttttgaccttgtaatcctctcagtggccaagctggctaaggcgcgagactgtaaacgtattttcagctaatcttgagatcgggtgttcgactcacccctgggagacttattttttgaacaacttagtttctacttttccctcataatgccctaccataagtctaaatcttgtttggactatatttcattcactgcgtaatatacgttatttaccatccacgagtagaaagcttctctgaagatttcaagctatcaacagttattccaaacatgcacttacccaaatcttttgagtattccagcaatttagctgggtcattgtaatgggtgacagcgtgcacaatggcagcagctatcttttcaggatattcactcttgaagattccagatccaacaaagacaccgtcacaccctaactgcatacataatgctgcatcagctggtgttgcaacacctccagcagcaaagtttaccacagggaactttccaccagcttccttgaattctctgagaacctcaattggtaccctcagctcctcagcaaaggcgttcaaatctttttcagtcttgatggctagcaattggttgatttgttcttttaccaaagcaatgtgactgacagcctcggagatgtcaccggtacctgcctcccccttggttcttagcatagcagctccttcaacgtaggttcttcttagagcttctccaagatccctacagccacaaacaaatggcaccttgaagtcgttcttggtaatgtgcaacttcttgtctgctggggtcaaaacttcagattcatcaatgtagtcaacgcctagagactccaatatctgggcttcgacaaaatgtccgatacgacattttgccatgacaggaatggagacagcttccatgatttccttgatgaattgcggatcactcattcgtgacactccaccttccttacgaatatcagatggaactctctctagggccatgacagcacatgcgcctgccttctcagcgatgatggcctgttcaacgtttaccacatccatgatgactccacctttcagcatttgagccagtccggcctttaatttgaagtcgtcgtttgtcattatcttaatctagctattgctttgaaaatgaacagcagattgagggccattgccctatttatatgttcgtatcacggtggcctgtagactggaaacttgtcatatcggatattccatcaaaaaaacggcaaaattgaccgatttggagattatcagtggcattaaagtgacaagccaaaatcatatccaataaaaacagtacgcgaacaacaatatcggatatgcttgacctcgatatataagattgacaggctccaagtaagaagaccgatgattaaatgactcagtcaactcaaattgtaatcggggtgttagccatccaaggtgcttttagggaacatatacaacatctggtaaaagcaattgacgagttaggcctgcaagaaaaactcgagatctcagtttttgaagttcgtgatgaagagacgctggtccgatgtgatgctcttgtcatccccggtggagaaagtacaacaatgtcattggttgcccagagactgaatttgcttgaacccctgagacagttcatagcttccggaaaaccagcttggggaacttgtgctggactcatcatgctgtcttcatccttgcagaataaatcatgtgatcaacagttacttggaggactggatatagagaccaccagaaatgcatttgggcgtcaactagattcttttattgccgacttggattattctaagtttatacccggacttacagcctttcaaaccgtttttataagaggtcctgtaatttctaagatccttccaccgtcgccaggtaaacccaaagtagaggttctggccagcttaccagaagaacgtgggtctcagattatagccgttcgtcaaggagatattctgggaacttcttttcaccctgaattgtctgaagacgtctcttttcataaatggtgggttcaagactttgtactgagcaagatcacgataacttagccataatcattatctaattactaattaatttcgagcctaaactaaaatcagtgtgaactatatagcttagttagtattcttcttccttctcactataggtgactgaaaatgcctatagagcaatgatagacgacgatgaattgaagaggccattattaaaccctttgaacgacgaaaactctctgctagaaccgtttgtcagtaactatcagagcctaaatgatgtccaatctcacttttcatttgataaggatgatcttcaagatatacccataactgtgcaagaaacattgcaattggcggatcgcactctagaatcggagttagaagtagatccaaaggtttcatgtattaccttccgatatatcgtattgagcatactatttattgtacctggtgctattattgatacagtgaattcatacagaacaacatcggcagattttagtattttgttggtacagttgttatcaaatgagcttggaaaattaatggctaaaactcttcccaacaggagagtcaatctaagatggttttctttcagcctcaacccaggaccgtggtccaccagggaggctgtcctggtgactataacagcagcttcaggagcaaccggaaaccaaggcacagaatgtatctcattggcaaaaattttctacgatgaggatacttctccaataatagcgatactgttcatgtattgtattgtttgggttgggtattcatatgctgcaattgcgaagtcttttgttctatacaatcccaaatttatatggcccaaagctctgatgcaaacagctttgttcaaaagtcagagcaagactggaaacacaggtgtgatgagggtctttgtcatcgcattgtctgctatgactctatggcaatttttgcctgagtatctgttccccatgacatcctctctggctgtcttatgttggatagcaccgtacaatgagacggcaaacttcattggaagcggattgggtggaatgggagttttaaatttttctttggattggagtaatataacatcgaccgtaatgttgagtccctattggacaatagtgattcaattcttagggtttgctgcttcctgttgggttctggtccccttcttcaagtggtataaaggtgggatatggtctctaggtatcatgtctaatcacctacttacttccactggagaggtctatccaactgataaactaatctctaagaacttgactcttaacgaaactgcttttaacttgtacggccccgtttatatgggagctcaaagagtttggggcatattttttgattacgcagcatattctagtgcaattgcgtggatagccatttttgcatataaagatgtcaaatatcttctaattcgcttgaaggaaaagctgacgcaacaagaaaagtcagcatcagcagatgatgaaccgttgtaccatgcagggtttccacgtattcataaatcttcatctaaatttcatgatatcatcaataagagatattctgtttatgaggacattccgaactcgtggttcttagctctatttggtttgagttttgttattttatcttccattttccttaccaactccttttatttgccttggattccattcataatagcactatttttgggcagcataattattactccattggcctacctctacgctttgtccaactttcaactaccaataggcacagtgaatgcactgttatatggatcgatggttcatgtttccaatgcccaagtacacccaatcagcggatcagtatatactgcaatcgcaggcaacgcatggtaccgagctcagtttatgctacttgactggaaattgggaatgtacaataatattcctcccaaatgtgtatttttctctcagttgtttggcaacttgatgggcgttccttttaattatctagctttgagatgggtcgtagacacaaagcttgattatcttaggggcactatcaaggaccctttaaaccaatggacaggtcaagagctggtgaatttgaataccaatgttatacagtacgttcttctggggccccaacgcttgtttcagaactacaaaattcttcccttcgggtttttgttgggtctattagctcccctggcaatttacaaactttacatttgggataccaaacgtcggcttaaatttgatttatggaatagcaccattttgttttctacgatgtcacatttttacggcaatataagtactggttacttgagcaagtttttactaggaaccttttccatgttttacctcttcagattcaaacatcgattattttccaagttcaactacattttagccgcagcatttgataccggatacaacatcaacgtcataatactacttatcttatctactgtgactgcgaagttgatgaatgatgagggtcattttgttcattggtggggaaacaacagtcagagtgtagagaggtgttttgcgttgtaggtatgcattatctattaacgtgaaaactattctaataactcacatgaaagaaacttcacatttttttgatgttctgcgtcaagagctgactggtcgacaagtcctaattgaatccaatcaccataagccatggcaactttttgataagtatactgcaaataatcaaagtcatcattagattctggtgcttcctcaataaccgtcccgtcaccaacgtcgtgttcattatcaatagtaatttcatataattcaccattagggccgattcctgtagtcttggtaatgcttttatctaattcggtaggggttgactgccttgatttgtatttcttgaaatcctctccactttgaactactccccaaagagcccaaaatacggagctagctgctctccagtaaatacattgattgtataattttttaattttcgattcaacctccttgatgttctcctgtgaaacttcaacaaatgaattttttctcttgttcttctctattccattataattgacgtaagtagcaatcaagtttaatttctcatctctggtaggatacctctttacttccaataaatgtggggccgttgtattgtgatagtcagtcatccattcacaaaaatggttggagatgtcatacgcaggaacgttggctgctgcgtattcgaaatcgataacaactagtttcttatccatcttggtagagtctttggttaaagagtggattgactgagtagaaatatttcttcctgaatcgtacagtttgggggtctccactggagaacttgcagtagtatccgagatggtcaattcggataattcagactctagtggattgtagaataacaaattgccgtattgagtatcattgtgacaaaatactagttctggagggtaagaaagtcctccattgtaaatgccatccacccatttcttgtacttttcataatgtgtcctaaaggttttgatgtcaaccataaaaatactcttttgaacttgaacgtccactccttccagcaggttctccacaattccaagccatttttcaatcatataccaacaggttgggcccctagtcacttcgtacttgtctaattggacaccagtgtggagttctttcattcttctagcaatcattcgactgatcttaggctccctgagttgctctttaaccagggtaacggagtggttcaaaaattcctcaaatctaccatttgtaaaacaacctaacagtttggcaccgatattattcttggctagcttgaagagaatcttcaactctgtatctctatctatcaaagactcaacattaggaccataaatcctaagtaacaaaggatagtagtgcttataggtgactttgtaaattgaattagtcaacgctccgctgattctagtaagtttcagttcttttataacgttttcagtaggaactagtctgtgccacttggagatcctcaaactttgtaagagagcaatgacatcctgtttaaggtactcagtaggtaaagtgtgatccaagacagccttaacaaacggcacttctatgtcttgttcgccattgaatgacccatccaaggaatcattgcctaaatcagacgtcaaagacttgatagatccggacgaagtggttcgatgcattgagggccttctgatggagtgaaactccctggtcctagagccagatcgagaccttgtccgtgttctcgtgctagcactggaacccttctgtttcaagtgtttctccatttgctagaggtattggtcacaagagcaccttaggaataattgttgagttcgcccgcagttttctcgatcgttctctaatcacatgaaagcgctggggcacaggtttttttttttctctctctgggaacccttgataagaagaggcgcgtgggtaggctcaccaactagttaaagtgcgcgcagattcattacccaaaatctgctttcccaaaatggccaaacataaacatatatttatctactatggtctatcaaattcagagaaagggaacccaggggattttcaaagatcacaagtcctttcactttataccccagacgcaaagaaacccaatataagaaaagtatgtctcaaacagttgccgggtgcacaatactcaaaatcccactgaagtactcgtactttaccatatctggacctgaccatgaaaatttcatttttgattacgtccctagcaagttggagtataggatattgaccgaagatgtcaagcaaaagatcaattcgtctatgttgggttcttttcaaggatcaaatacccttttgttggacaatgagatggtcctcacgagaaaagttgctgaacttaatgttgaatataaccatggtcagcaaatttttgtatctcttgatcgtgatattgacaaacagctgatggtggtttcatttattggaggattagaaaactccaaaaacctagcattggtcaaaaacaaacttctaagttcctattttgagtataaaagggatcgaatagagctgtctgctgatacccacaggtttctgttttcaaatggggaagttcaaagtgtcaggaacactttcagaacaatcttgatggagcttgcagactactgtaatgtctacatctcaatcctatacaaaaacaccaaaacgtgttccttaaatgtaattgggaattctgatgctgtggatttagcacttaataagatcagaatagccatagacggtatcaatcccgacaaggtgatagactacgtttccctggaacatgcctcacttactcctcttttaggagggctagatttttttcatttcaaaaagatcatgcaggagacaatgtgtaccatctaccttccaaacctgctaccacagttattcaacttcaaaagcccttcggaggccaaaatttacattacaggaaatgaattgtacgttagtatggcaaagaatgccataaaaaaacttctggatcaagtgaaagggtttatatacctgaaagaggttatgatcaaatcggttaaacgtgatctactgatcttggacaacaataaactgtttcttgaaaatttgattcgaaagactggatgtttcattcaaattcctactttgggtgtttcagaaaactaccatgattcgttggttgacattataagaattcaaggctcttcagctaaaatggtagaagaatgtgggaaattattgatggagtttattacctcctactatcactgtaattatacagttaccacccaacttcccacaggggaaaatgatgtagttgagaaggtcttccactgcctacagaaaatagcagtttcccaggacgctgttgtcagtgcaactgtaaaccctgatattgccaataatttgatccatttgaagttccaggtgaactccaaagctgcaaaaatcagaaagacaattccaatattacagagccttcctttgttactagataccaagttcttgaaacaacaagttcaattccaccttgagctatctaatgaagaaagggttttcatagagggaaagaaaaatggaaaattgatgaagattatgcaaaagtctaatgttgcaattaaattatccccattcaacgagcataacttgattctccaggtcatttgtgaaaacatcagtgagtctttgataggattgaaacttctagaagatgaacttccgaaaatagtgaccttcaatgtccctgaatgcttccacagacaaattattggagttggaggatcaacagttcagactatcatgagaaagcataatgtgtttatcaagtttttcaacagtgtggagcatggaaaatcgccgccatcgttccccagtgcatttgtaagaaaagataatgttgtcattaaatgtccctcaaagaataaggctggaattccagaggctaaggttgagcttcagaatttggttgaaaaattcagcaaatgcacatacctcagaacttacttgaagctgacaagatcccattggaggttgctgactgatgtcacagatcctttccataagacattggaaactactgacatgatttcagatttggaaaaaaagactaatacgtttgtgaatttccccattgacgaacccagccccatttttgatctggaaatagcgggcttggaaaacaactcagagttgagtgccaattccttgtccacgattctcccagttgatcatgaatttaaaattcaacctcatcaatcttggagtcaattacaaaatgctgaccagcgggagctaccttcccctggatctattggatattggtatttagagagtgttgttttaccactaaaactcttgaatgttgaagtgcaaatattcccgtctgaaattcaagacgagaatgcagacgctcaaatgggggcaaactcaatcgtattgagttactttaaaacggttgatgattcaacaagctctaaagtaagcaaagcacttgaaatcttagagaatttcttaacgaagtatggcttcgaaatcatggctcgacttataagagatccagcaagctatattatccataaatcgaaaggacaagtggattacaaagaagttaaaagtaatgttttatacgatcataacgtgccgtttgacatggagtttaaggagaaagtaaaagctttccctagttattaattaagtattattaataacttgcaattaatgacatgcttattggtctaatcagaagacaagctcgagctagaatttgaacttgagcttgaacttgaacttgaacttgaactagaacttgaactagaacttgaactagaactaaaatgtgcagttgagttaaatttaatgccagatttctttgctctcaactttgatttcgtgcttgatcgaatgctctcttgaggtttgctttcaggtttcatatcagaaaagcctggaccggaagatgattctgaaacgtccttgtcctcagagtcagagtcatcaatgctatcatcagaactgttcgaagtggtggaagagcttctagaggaattgatatcactgtcgtcttcatctaaatgataaatcttatcgaagtctctcaaccgccgcagtttcaacgatgaaggacttcctcggaatacaattgggacatcaatgttatctaatgtggaatggtgtttatgggtgaaaaatacggatagctctccagattcagggttcattgatacttctagcttcgactcacactcgaagaatttaacacgttcgttttttattcggtaagctgcctctaatcttctgtaggcacgtttcactgatgaaagtttataagggtcaaaagctggtatagagttgataagatcggaaaatttgtttttcttgtctcttcttccctgttttccttccactgccgatgactggttccttatcatctgctttttcaagtacttgtttaacttaggacgttctcttttgatcctattgcctctaggaaggtcattgaaacagcgtaactggagttccaaacggggaccattgaaacgagaactcctcaaagtaaatacgtaaccaattgatctcaacacaagaagtattctgtctatataatgaatgaggatggcctgcttcagattattccgaaacttttgtatctctggtcccgccagctctatttttctcttcgcatctttatcatcattttccgaaactagtttcattagcttcatcacttttatatcgtccatgcaaggagccaaatgaatgggtaccatgatactaactctcagtttgatgacatcctgttctttattgcagtaaagcagttctagaagcctatcgagacttgatatttcttcgttatgtttgatactttcgtgtaaatacgttcttcttatcgcttgggatttcgttgtccgctttgtacgggctgatacagccgtgacgtcagaatcctcactatcggaaaaaacgaactctttacttctataattcccacgcaccctgtcatcatatttctgtgggttgggattggcagtcttttcatcttcgtacattctgtttatgtaaaaggagttcagtctatacactttgtttttagccctgcacttatcacatgttttgaaatcatacattgtgatctccttttcatctgtaactttgagagctcggggacggcgacatgcagagcaatgggtgtacttttcggctcggcctagcctcgtattagtactggtactcttcattaaggagatcagttgcttagggtcagtcatccccgggcagactggttcaagtgattagctccgctgatattggagttttttttttcttctgatgttgaaatctcgaacctagctttcatctgatatcatactccaacacatgggctctaagtacttgcctaatccatgtttactaggcattctacttacagtcgcaactcatgatgggccacagttagtatttcactacccgcctgttccgaaagagtatgggtttcatgcgacccctctgggcaaagatctcggagatgataacgtcaaagaatattattcttcgtcttccagtggtgaagacgacggagatatttatgatcagagtgatgtagatgatgacacagacagccatgattttactaacacttcctcaatgagttcgaatcggtggagcggagtaagtggaagtgatatgactagctctgtttctcctaacaataattacatttccggaaaggcacttttggacattctggatgctaaggacagaagacggaaaagaaaagaaaagaagcggagggttttaatgaagcatttattagctggtgggaatgacagcagtagtgtaagcgttgacgatcggagcgttaaaacaggcaataatagtgtcgtcaattcaggaaaaagcgttctgcaggaagaatcgtcatcatatggcgtcggaagcggtttcttgactcatccagatcaaaccaacaaagtttttgggtttgatatcaatttcttgagtgagattgtaacacctccgaagaaactatgcaatacccgatttgaattaactgttgatgagatggtcttccttggtttaccgattcatgttctggataatggtaaatggaggaactcccctaagccgaagagcagtcgatataagaaaagtgacagaaacagtcattctcaccattctcattcacatcattctagagccacttcgctggacgaggacgagttcgaagtgaaaccgctgttagattccttaaatgaccttcattttatagagtcagagaaatgcccaatgcacatgttcaatcttgtttttgtcatgaaccctccagttgttgagtacaaccatcgtgtagatgagatgtttcattacgtgattagtagattgtgtttactactgagatatgagcaagataaacacaattttgtttggaaagaagcgctgaatataatgaaactaaaagaggaaacagcaggattggatattgttagtcagtggcgtgacatcattcctcagtcagatttggcaaaactgatgagagacacgtttgaatccgtttccaatgccaggattgttaatttgaccataaacaacaagttgaggtcttttcaaattcccataaagactgagtttcacactctgcccaaagagaaagtgattccaggttcaacattatcttcaatctcaccgtttaccaaggatgattcggatgaagtggatttcaagaacatcgtgaatagtgacgagaatttagcattctttacaatcttactccttgatgaccctgaagtcatcattcgggatattcaagttgcaaaggaaagtgttattgctagattcatcagattgattagacccaccaaaagtatgagtagattggcgactaccagtggattggaccttgctcagatcaaagcatttgcctgtcatctagtttattggagacgtgctaagataatccctgcgataaatactaggaacatatacgtgatatcagcattggcacctttggatcgattggaagttcacagcatggaatttcgaaccaagtttccatctctacccgttctgtcgaagttcctatcactgctatcaacatcttcaaacaagccaaaacaaataagccgttttattcctagtaaggaccatcgagatctttacctggatgcagtctcgtggctgctaaaaaagggatacattcttcaacttcatacctttcttttccttattatcagcaaagagatcaagatgagcgtggaggaagaattggagcgagaaggttacaaaggttttggcaataatacacaatcaatagcaaggccaaagacaaccgaaacggacgagaaacttgaaaatgccagcgtgacgactgacaaagtaagcacgacctctaatgataaagaaacgactgataacacatttaaaaaggatgccagcaagacatcctccagtcttaaggttgattcgcagccctccagcaaacaaatcagaattatcctagaagatgacgataatgaagacacaatactaacagatcctcttcgaaccaccttcattgaaagacgttggatccataaatgcgttgagggaaaatcgccagaagtcataacacttttttacaagctcctacgttacatggacggaaaaaacgccctcgagattttcatgcaaaaagctaaggtatcaagacaagatcttaaaagtctgttgacagaagttggggaacacatagtggtagttagacattggtaagtagagaagttcattccctttctagtgacaggtaaagtgctcacttttcggccataacctctcgaattgttagggccataatagttccataatgcgtgcaccacccaatgctccaatccaacccgttttccataaacgttccttatgaggtagctagggctgggaccgcctaaactagaaaaaatatccagatacaacaaaaagcttttggacaggtaccggcactatctaaagacatatcattaatactggattccaggacggtttacagtcgtctgtatcaattatattagcctgctgcaaagtgtggattgttcccttgtattttgaactgttcaatttattcctatagaatatgggaaataccaacaataattcagaaccacaaccccatggcagaccccgaaagtcgacattttctaagataggaaagattctaggagttgtgcacgacaatgacaaggacaattcaacagcggctgttaaagattccaaggaaacgacaccagtggaaagaattagtcccaagttcactagagctagttcgatatcttcaaatagtggttcttccaggtctgaaagcagacacactacgcccacagcatcaccttcagtgactccagtgctcaggggaactctaccttccaggcaatcttctttaagattgccaaaggattcaagtatcaacaagagcgtatcacatttacagctatcagcattgggaaatgaacccaacggtaatggccatgacattaaacaatctcctttgttaccaaggtttaagatgttagaaggcgggaatcatgaacatcatctcagaagttccaagcggcaggagaaactgagtagcatgttaaaaggtttactgggcgcaaaaaaacttcgaaatgagtctatatccgcagttccaaatatcctccagtcggttgttcctgagataaatcaattgacgaatactgatggcaagccgccaactttactctctggattattaaaccaggttcaaaaaggcgaaatcaccgcgttctcttcccatggccagcttaaccaacctatcacagcaaaatcagttcacattttagaacaggctgatagcaagtcatttgtggagaagtatggaacctgccaggaagttgtaggaagaggaacatttggagtagttcgtgtttctcataagaaactcaatggcgaaaagaaggagaggttacacgcggtcaaggagtttaaacgcaaacctcaagagagtgactcaaaatattcaaaaagacttacctcggaattctgcatagcatcgtcgttacagcatattaacattattcacaccctggatctactgcaggatgccaaaggcgattactgcgaagtcatggagtactgctctggaggtgatttgtacagtttgatcattacagctggaaaattggagtatctagaagcagattgttttttcaaacagctcatcagaggtatggagtatatgcatcagatgggtgtagctcacagagacctcaaaccggaaaatctacttattacttcggaaggaaacttaaaaattaccgattttggaaatgccgaatgtttccgcatggcctgggaagatgaaatccaactaagcagtggtgtctgtggatcatctccgtatattgcacccgaagaatttgtcgaagaggaatttgacccaagaccagtagatgtttgggcatgtggtctaatttacatggcaatgaggacggggagacaaatgtggaagattgctaactcagatgatgaattctatgctacatatgtcgagaagcgtaaggagaccaaaggctatgagccgttggaattgatcaaacgtgcccgatgtagaaacgtgatctattcaattcttgaccctgttgcctcacgacgaataacaggtgctcaagttttgaatagtgaatgggtaagggaaatcaaagtctgtgacgccggcgaacatggaggagaagttttgggatagagtggtagcatagcatgcataacctgtatcagtacagcattaagtagtcaatgaaggaactgtatttatttgtaacattcggcatccatacttgtggccttggtagtttttcgcgggttattctcaataggggcgcgggggacgtcatcaagaacttggtctctcggtttgtaatcagtgtgtaccttttgactcgtttagacaatgtcctgggaaggattcaaaaaggctgtgaatagagcaggttcctctgtaagtaaaccatcaagccgttgggaaaacgaagcattgaaagtattttgtgtttactaacactgttccaaggttctggttaaaagtgcagacaaaatcaatgaccgagactatgactcggaagaaagacggttcaaaacgtaagtgtaatttggttggtcattatgtgttccttagaagctaacgttcaataggctggaaacggcagcaaccaatttgcagaaagaaaccaagggatacctggattccctgagagctgtaacagcttctcaagttgcgatcgctgagattattagtaatttgtatgaagataccaagttttcaggacagtacaattctgttggctcctattaccttcaatgtgtgcaagagtttgaccaagaaactgtcaaacagttagatggtcccttccgtgagaccgttttggaacccatttccaaattttgctcttatttcccagaagtttctgaagccataaagaaacgttcccacaagaagactgattatgagcaatcaaaatccaaagttcgtagactgatcgacaagccagccaaagatgccaccaaacttcctcgagcagaacgtgagttacagcttgctaaggaaatctatgacgatctgaacgctcaattaaaggaagaattgcctcaattggtgggcctccgtgttccatactttgaccctacgtttgaagctcttgtcaaaattcaattgagattctgtaccgagggatatactcgtttggcacaagtgcagcaatacctggaccaaacatccagagacgactatgcgaacggattacttgacggaaggatcgatggactgatccaggaaatgaaccagttgaacatctgtgccctcggtaccaaataggctactaatgtgtgtaagtttacctccgagtactactaactaatatcatctttttgtcgtatcctagcttctgtcccctctctgtctccggaccgttccgagcctccttgtagtgcctgggaaggcatattctctcccctcccgccacctcccctgggtctgagtgatgcgcgaattttacacaaaattaggaaaagatgaaaaaatggcttaggcaattacagtccaacgttcctgaattattcaatagatttgagtatcaagcaagatacagcttctgtccgaagacttctccatcaagccaaatttctctcatcctctaattgagtattttagtaccctgctttccatcgcatctaaatgtgtttggtcacgtataaaggatgaaagaaattatacatttgatacagactattgttggaataatacacagctggtggatccaaaaactgtacagggcatataagaagcttgctaagaaaatactttcctttccaaagaagtttattttatggccggtatcattggtcttcatgctttcttacccagcattgtacagtttgcatacatccccaagttttgtattccattcgcatattgctaatttcaagagtataaacgtagattattcccagagtactgaacatcccttttttgctgtcaagcaggtctgggtacaacgaaacttagaccacaacggtcatggcttggaaccagatggtgttgctctagacagagagtttctcttagacacattggatttacaagataatttacttaccaacatatcttatgatcttagaactgattcgaattatagtacacctgatatgttatttttcttgcattcaccgttacagtgtttcgataacaatgccgacagcattgaccaggacgaaaagggcattttgaagacaataagatctagagtgaatcgattatcacctgcaggtatacatctatcgtcagatagtttgttctccggagttgtcaaggtggatggtgttctcaaatccgctaacgtgttaaagatctcgttgttgtatattccatcaactgatggctctgtcgatgctggaaccatatgggatgataatctaaggaagttaatagatggatcaacaccatcgaactttaccattttttctcatactgaatctccttcagaaagacacaaatttggcatacacttcctcccaatgtcatggacagatcatctcattttatttctagcatacgcttctattgccacttacttctttatctctttgttcaacctgcactcggtgaaatccaggttggggctgtttgtcgcttttattgtggaaatgtcgttttcccttttatcggcagctaccatttcatcttacctttttaagggaattgatctatttcacttcccactccaagctctgccgtttgtagtagttgctgttggaacggagaacatgttcaggctgatcaatgcagtttttaggacgaatgactctttatcgacacaagcaaggttaactagaagtattgtttgcagtggaatagtttcgaccaatattgtcgtcgttgatctgataattttgttgttcattgtgcccagatttgttagtactgaaacgaggcaattctgtatatttgcaggaattgcattgatcatccaacatattttacattcaacattttttacagcagtgctattgattgatattcgaaggacagaactgggagacctgttacttgaagagcatgataccgacaattgggaccaaagaagaattgccagaggctccatgtcgaattcagttctagcagctaccaccgccaaaatattcggtgagcgagttcaattggttctctatcaatatattctgaaaatcaggctcccattgacaactacagtgactggctccatcattatggttttgttccttattgctgcaaacatccgatggatggatggtcacaccggattactttcagcatctacagttgtacctcagtcaatcgagtcttttaatcagttgaatttttccaccccttccattccttctctctcgctagagttaactggcgtgaatagacggttcttgttctttttgggaagcaaagctcttggtgcagagttggtaaaagtgatggaacagtttgcttcgtccaactcaattggagatactctactcattgaggttgaagaacccaaaattgctctttccaaaagtgtcttggaacaatattcatcgagcaatggtattttcaatatgggcttgagccttagtactgtttacaaatttgatggttattatttgctggaattcctgacatctcttttgtttatcttgtgcatttcaggactcgtactcaacttcaccatcaattcagagaatgtcattttcagcagttctcagcaatataaacaggcaagttccttaatgaaatcagattcaagttccaaaagcgcaacgagtctttttacagagaaagagagtggcacccccttatttcaatccagagagttaatcaacgggcattttctggacatcataaagataagcacttctgcatgtcctttcattataagtgttggtatcgatcacaaactgttagtttggtcgccacttaccgatcctttaccttttccaactcaattgccaatttcatcaagtttatggccgatcaccaacgttgtaatgtcaaacaatggtagtttgattgcagttttcagtaagtcgggtgttgtcaaatgttggtcgaggttaacgatgtcttggatttggagagtcagatttacctgtttacaaaactcagaagtacttgaatctttttttcgcaagaagacccccattgcacataggaagggagtctcaaacatcaagaaatccttgggttcaagtccaatgtcgagtccccttaccaagaagaatagtaacctttctactaagtctaccaattcaccccgttcaatgtctattgactctacctacaacagaactaacaacctccaatcactatccgaatgtaaaaataatgaatttgttattactgtgtcggaaggtatcatgtatactattgattgtatgtatggtggagttcaagagattcgactttcaaagcttccattagtctgtgcgaggaaactatcttctcctcgtgtgaacatgagattgatagcaatcgacattgaaggaaagcttcttattgctactgtggtaaataataagtggaaagtaagatcgcttcctatccagcctgaagcctctaattccaataaagggactatggaattgttgtctggtccaaattcattggtttataatcaaccacatgtgtccgctgtttcatcaccattagcgtcagcaccagttcaatccggcgatacgaagctttcaaatgaatctacgagaaagcatattggaaaggaaatttctaacgttccgtccgatttcaaagaagttgtgattgatatggtaccttttgttggaatgtttgttcaggctaaaggcctggtagcagagctggtcgacgtccaaacaggtactattgtaaagtcgttttctatcggccagtttaagaaagacaccttcagggtgtttcattcgactccagcacactgcaagttttgtggatgtgcttcgatatcttccttctccatcgcttacacagaaaaagattcagacgtgttgatattacacaccttcagcatagacaacagagccaagaacaatatctgtttgcgtgtagaaagagatgttagagaaacaagatgtttaggtttttcttcagttactgagcaccagcattggcttgatggtgttgagagatgggtcacgactgatctaaacatgttgattggtgtacgaaagaaaggagagggtgagacggaaaacatcaaagatacagaaggctattcgacatcattagatttcgtagaaggctcttcgggactaattaaaagagtagggtcccctatatccagagaaccgtcccccaccatgcctcacctgagtgacatttgggaaggttggaccatgtcatcaaatggtcaggttcattatttcgagattccgaatggggtagacgaaggccttttgataaaaaagattggacccgttgccaaatttgggcacaaatctattgttgtggcttttggtaatgtcatgaaaattctttatctaggtaacgataaccttattgaggaggatagtgaaggaaacataggcactgaggattcgtcacctggtggaacaaattctgccctttcatttatcaacagaagacgaaatatgagaatgaagaagtatgaacttactcactctaccaactttacagagaactctgtttcgtctttggactaatgcccagctgattatctaattttatatttatatactccatacattcgcgaatgagtgggtgcatctcacattatcagtataaacacatatcttctaaccaccatgccttcagtaaaaagaaggagaggaagacctcctacccgaaaccaaccacctgttggggtttcctcgtccaatactaaccgtactcctcaaacagaaccagtggcgaccaaacacgatgagtcggtgggagcacatgatgaagctgatatattttcttttcgcactagtgctatcagcaagtttatctcaaacaacgagcttttggataatctaattaccaagtatattcctattgatagtattattccgccggcttcatttcctggtgctaaaattggtgggaagaagttcgaactgaaaaacttaaaggaagacgaaaaggttgccttgacgtctaggttggccactaattcaatcgacgcagatgacgttctgttgggtgatatcaacttgatcaggttgaagtctgaacttctacaaaagcaactgcatgacgaagaagaggagttaaaaaatgctcagaacatagacaacttaattgatgacgagtttattttcatggagaaagcttacaataagctagccttattacacacacgattgagcagcaacgaggactttcaatcacaaaaagactcgttgagtttgcttcagtctgaattaaaagacaaatttaacaagaggatagatgacgaccagattgtgagacaactgagtactagcaagttaaacgcaggacgtatttcagttacggccgatgaggccaaagaagcattggagatgcttaatcagaagaaacaagaagcatataggcttcaaatgcaagagcaacaacaaaagcaacagcaggaagctcaatcacagacagatatacaggatatgtttcaaccaccagtaccaagtttcatgccgccgcaatctcaggagtctgctattattccccaatttaatggatcgtctggcaatacaaactctcaaggcttaatgttccaaatgccagcagatcctctagaaaatggatctgagtttagtaaccctccagagagtgaattgatgaaccaaaatctatttgtcaatgacgagatgattggcaacgatttcttaggagatcagatgttttttgacgacagataataacactgaagtcgtaatagtatacggcctctcttctctataaggctatacgttttatttatttcccgaagatgttgttaatcttcctaactattcgacccagtgcaatgtaaaatccaaccccaaacactacaacatttagtaggatggccaatattccattgagcataaacctgggagcaaaaattttccaaaccatcaaatggcgacggaaatttgctgtcataatcaacgtcgacaatgttaaacatgtttggtatgctgataaagcagtacaattctccgccactttcccaattagagaaatcggtttattagttggtgggatcttccatagtaccaaaagcggtacgctcaaatacactataataaaagggcctagtgtgttaaatataatcccaatgtgagtaaaggggaaagtaatcttctcggtcatcataaatccagtctcccaatggatggcctgtaatgtagcttgatgaccagttgtgaaaaagtgcaagtatgacaacagtatcaacacaactatggatatcaagtttgttctaattctcagcaaattagccagctccagtaatgttaagatttgatgcaccagaacgcatatggataaggctccaagcggtttgttgaaaagtagaattgcacaggtaaagttggcaattagtaaaaagtatgaagatccataaacattaccgtatcccaaaatcttaacttctttaggaccctgttccttgttctgttcattcatgacattaatcttgacacataaaggacccattagccatccaatgttggcagctaccattgtaattccaaatatcagtcttgatatagtgaatttgatagaggcaagtattggaaatgggatatccaatgctttgttcaagtagtcattgttttctatgtaatccaaagcccaataaactccgataacaaaaattgaatacctcattcccttatcaatccacaatggagctgcaccttggtaggaagatgaaatattataaaagcctttgattgttgcaggcacaaaatatgaggctaggaacaacatgaaaatggcccacaaactttttccaaacgttgtactacattttggttgttgctcctcacggcataaggtaatgacagaaaccatgcgtgttgatatgatgaaagatagagcgtggtaactggttataagtcttttcagtgcagtgttcagtctgaaagatgcgaataacgcacaaacaccgaaagtaagcaggaagaatgagcaaatcttatcttcccaaatgatgaaagaattggaagtgaatatcaaagtatgcaacgtaatcaacagtaatcctaagtatgtccaaaaatcccaatgtaataattctatcaattttccaattagccattgcagagaatacctatccattataggagccaaggtgccgttaattattccgatcgcaacaccaagcgcaagggccattgttagagacaagttttcaggcttcagtattaagtgaatggatgccataacaaccaaatagacgaatatcaaagcaaggctcgaggtaaacatttgctcgttcaactgaggtatgacaactgaaggtaccagtttcgaataaaccacagtaatgaccaatgatgctgctatgattccaataccgatgccaatcccgagcatatcaaatcttgcccaaagatctttacatctttccaaggatatcttttgatactcgacgcatttttcgtttaatgctgaggtattcgaatctagtgtaattgagttccacatcgattgaatatcttgaaacaagtcattcacttggctatcatctttcaacgtttcagaattttgtctataattgttaatctgattagctgtgtaatagttagcggaagctaaatccaatggtgtgtgactaggtccagtaaaacattcctctattggttgtcctaggttgttgaaagggataggaataccagtaagcattgatatagacggcacaaggtctatttggttcacccaacgatagttagaacccttatcctgaatatcataagcattcggggtctgaaatcttccaaaaaagggtttcttcgagtacataaaaagagtgctttcgacttcatctgtagattcccctccatgatttcctgtttcatccataccgtggtcaccgataataatcaaaagagtttcatcatctatgctatccatcacctggttgatcacttggtccatttgtattagtttttcagccatcgcaaaatgatgaggaccatgtctatgaccacaatgatcaacgcccaagaaatggccaattagaaagtcccagtcgttatattcgttgattatagggaataaatgctcaatgactccattatccaccgtgtgcaaatcccatacgtttaaagactcgtaagggtaagaaaggttctgataaatgaaaggattaaacatagccgtccatgtatcatcaccaacgaatgctacatttctattgtgagatttcagctgactcacccagttgtcttcgtctatcgtgtcaccgtcaaagttagagccagcatcaacaaaagtaggtaaggatccagtagtgagtcccttaagtcgctgtaaagtagttgtcgggggatctgcaatgaacttcaaaagtaatgagttctctggttcatttatggacaaatcatatagagttgtcaatttgttatgatacatcattgaggactcttccactggtataacaaaatcgaatcttaaggcgtcaataactaacagcacagttctattgaaactagaagccttgaaacagtcgccattttcacaacttgcaatgttgggcaaaaccgtccttgaaagaaggaagcctttagtaaagaaaatgattccaatcacttgaaggatccccaacaatagcagtacacgggaatagacattatggagataacccaattttcggcttttgaactgaaacttttcgtaggcctgtttcatcagccgtcgttgccgtaacagattgctaccgatatctgaactttcttctatttgactgggactgttgcttatcgaccgtgcatcatagccgtttgacattggggttcaacagttggaggaaaccggtaagctcaatttcgtttccaagttttattatagtcgttcccaaaattatcagaaccaaaggcccatgaaaaatcttaagaaaaaagtggaaagaggagaacaaactaggatcagagaatgatgcagatgaaaggtgatttctaaaggcaggaaaactggtagtagaaagttactaaaaaaaaacccgcgaaaacagttgggatgttcagggccttagtctctctggcaggttttactatgtaatattcagctatagataccttgggtaagaagttggaactgatcgtatagtttcgtatagatacttccaatactctttccaataaggaaattttctacaaaataatcggaatcttcctcagaaaggtgtagttgaagtcgttgtcttagttgaacacttgtgttctcaccagccttgaaacatggcaaagttgaatctcgttgcatcaattctaccatagtaatcaaagactccgcgtttcttcgcagtgacttgaaagcctccttagttgattgtttgaaaacttggaaatattcgccatctaggccccctagaacatccacatactccagagtcagtttaaatggggcggcttcgaagcctactgaccctggggagttcgatagcaagaagccaaaatcaatgtgaatgatgtgtccttcgttatccagcataatattaccgttgtgtcggtctttgatttgaagaatatagcaaattactgagtaggctgctaacgatatagcgaagttgttttgagcttttctatatctggcagagttaggatcaccaaaggtcatcctgaaatgatccagcaacgttgcaattgctcccctgtgatcctcattattctcaatcaaatattctgtgagggatttcttaatcgaatggatggagactgcatcagtaattgtttcgactaatcctgtcgagttgctggtaactaaaattcgcattctctttacccatatgttaactccatggttatgccatacagtagccatagattgaatcaattgacatgcaaacgcttcctgggttagatcgtctccagttttagcaataacagagcataaattccaatgctccaaatgtccataagggctctgcttacggattctctctttcttactattccaatcctctccgaggtagtaatcattcttgttcttcaaattagactttacacctgcaacctttaagtcgttggaaaatttccgctctcctgcttctgtgttaatatcctgaagatcttttacaccaaattcatgttgtaaagattgcattgaactaactattcgggctttgattgctccagcttgatccatgggcaaatgactagtggacgaatccaattgggaaagcatgacggctgcaattctcatttgagtggcaaagtcacttttgtctgttaatgaatctgtctcataatgcgattgaaagttcagtacatcttgtctaaggggagaatcaccttccaatataggtacttcgctcgctgcttgaacgaactgttctcttttcaggaactcagattctttcctgtttgataagttgacaattgaaagatctgctaagtcggcctccaatggcatctcgccattttgtaatgttgacatgctcttgccataatcattggtccttcttgaatcggaagctctcatgattccagccaaatcaaagacatatctctttgagtcaccattcacatcggagctattgtcattcagcctctctaacagctgtttattctctttgctttctggtgaaaagtcaacttcattactaacgtattcaatcagtaatagatagggtactctttctgctgagtttaaaactgctgcttcgttggcaggaatgttgacaattttgtgtaattttcctgatttagcgttgggaagaagtagagggacatcaatttcgcagggtaaatctttattcattaaagtaagctcagctcttaggcaagctagcctagtttcctttggaacgtttgataacttaatgctaatgttctgtaaagcaataacaaactgagtctcacacttgaagtaattgttcttcaaaactttgatcttttggggaacactcaactttatgggctgtcttttgtagcttccgttgaggctgatagtaggagaacgttcgttaccagagtcatatagactttccacttcgctcacagccgtagaattagtgtgtgtaggatgtagttccggcattgaagctgtgatcgagtcgttgtttaattggctctcagacctgagcctctgtaaattttttaaagtcaagttatcgtagcccttttcgggggacattggatagaggtcactcattacagattgtttgacatccaaagcttgggacaaccttttatttttgaaacgtttcatgtttggatttgatatagctctgttcaggtgaggtaaatttgtttcggcatatttgtcgattatggaaaaatcaaggttttctgaatgctcgttatgtttagggtgctggtcttgctggccttgacgcttcccttgaagagatgtaagagacaatgattttgcacggcgatatggtttctcggcttgactagcatccagttcagctgcatttacaacggtatgagaagatagttctgcattaagccttgtgttcttcatagtaagattttcgttcatttgctgttgaagtccttttgcaatttgaaacacgaaagagcgtgatagttttccctgcgttctaaccagatgctcagcactcttacctaactgaggaaaagcagcgctacttagaactgatgatatcagcactgcagatggtgacacgttctctcgaaactgtttcattgcgtgctgactattcttgtagacaataccagaagagccaaccctggaagatacagtagcatttggaggactcaaactgaaaagctggaattgaacatcattcagtattcgtttgcaaacttgaaatccggtagagtttggttgggtgctgagttcttgcagtgacgattgcaagtgccaaaacgttatcaaactgaaatggacatctctagtgcatagatctttaatcatctcctccaaagccatcgaatcggtttcgactgtgatgatcagttgtaagaattggggtatgaagaactttaactcttcaattggataagtctttaccttttcgcacagataatggtggactcctatattgtcggaatacctttgtagataggaaatgcaatagtacaaattgaaatgttgtgagtttataaagcgtagtaacaacgcatttccagattgatccattatgatatgacctttgtgaaagggttcagacacaaagattctaaaaactgggactatgagcaggaagcaaaggtatcactagaagaagttatgtgttatagttagagagtctggttcaatttccattcaagtgtagaattgagtgccaggtctattattctatgaacttgtgagttagttcggtaggcagacaggaacgattcgaaaagtcgagactcagtgggtgaacaatggtgcttatgtaatagaaactgctggtcggtgcaggataataggatttctattggacttttatcaggaaagcatttatgaacaagatacgagattcagtggtgatgatataacgtttgaacttggtgacttgcagtgataaacaatgaaaattgataattttactgaaacttggtttcattgaaacggaggatggctcattgtcagaactagatgaagagcccatcttcacaatcaaccaaccactgagatgtttgtgggtgatcttccgttcataccaaaagttgaaagtttacgaatttgagactgagtagcgcttgcagagcaatcccactgttatttccctactagtagtctaatctagatcgtgtgacacagagtccaatctgatactttggaggttttctcctcggatgccataaaatgatcaacaattccgccagcttgctatcattcttgacaatatttagctctctgtagtgtgtacgttgtgcttatcattttcaatcgagattactagtcaaagtgtttgaatatactcgataaggtaataatttttgcaaattagtagcaggtctcttatgcagatacttttaccttaacattattcacgactcccacgcattgaacgatccctaattaacatagtgtctctttacgacaaactccagaaaaggaagaaagttgaatgaaacatatatagtgagaagagaaaattttctgatgtgaaacatgcctgcgtagcgtaatggttaacgcgtttgacttctaatcaaaagattctgggttcgactcccagcgtgggtggcttgtttacaccttatttttttgtcattttttgactactactgttagtttacaatctctctgtgatgaggatattgacgtctcgttaattactcatttaagactaaatatttcctctataaagttatggaacggaaagacagccactcctgtcccttttgactcgaattttttgaaactgtccgtgattcttagtaaccataccatgctttctatgaaactgtcgaacctcatatcagatccagagttgctggagtgttttcgaaaaatgaattccactgttgaacttggaagactgtatcctgtgtctttgatcaatgccttgaattcgttgaaggaaatagaataagaatgatctctatcataaataaaaaaaacctcctcccaatagtcaatatattccaataaacgaccaaatcctgtgacatcaatggtcttggtatcattttcgtcaaataaattaatcattaggctcactgttgaaggccggaaggtagtttggtcactatttctgaggactccagctagctcagattctgttaggaagccctttcttctataatcggcctccttgaatctattcatcatgatcgcttttctttcttctttggattgtggtcttttctgagtgttgttagggattattggtggaggttttctctgaaacgctcttggctggtggtacgttggagattcaactgctgtgggtgtgtgaacttctggatacgacgctgatcttaattgatgcgaatatttatccaccattggagggggatctgagatttcattcctgattgcatttctttggaactctagttgttgcgcatttctttccagaattgtgttcctcggtgaagatgaatagctattcacggttgaatttgatccatgcctctggctctgtacttggggtgggactggagagaattgttgctgatgactgctggaagcgtaagggcgataatcaactttttgtggtggaaattggggtgatgacgttcccggtccgttgttggaggggaccgctatgggagacggtcggttctgtcgcataattgcttcctgcggagttggatatatacgttccccgttgccgctgaatataggtttttggggcatttgattcgaatgtgatctgtggtctgtttgttgttgtaggagctgttcgtctggatggagagcttctctgggagtagggtagacctttaaaaagttagaagctgccagctaaaaaataacatttgaattatgcttacattcagttgatcatccactgttgaatattccttcttctttgccatcttcaagttctacttccttatatctccgtctaagaacttgtttgtcggacggaaactataatggatatggttgttaacgcgcgcttttttgctgatgaataagcgatgcatggaccgttcaccaggaattgagtaatgaacaaggtagataatacccaaaaatacccaaacaaacaaccttcccatgggaaaaagccgtaagaacaaagattgagagaaaagaaaccatttcagtctatctatcaatagtactttcttcgtggtcaaaaaaagcttgtttcttccagatatttttagaccttgattagatagtgctaattttgtctaacggttctcgagagtttcaatatgaaaccgtggagaactttccaaaataattctagatgtgtaaactttatgacaggttacattgtctcatagtagaaaataagcttctgtcatcgtgaaacatcgaagcctctttgcattacagtaataactcctcatcccatactttcctgtatgtttcgaatgatgttaccaatgttctggccggaacatcatcagatgtacctgtttctgtaacagctttaggttttagggctatcgatctatgtctaacattcgtcaaacaataggacctcgccatagcgactggcgcgccgcactattgtcatttcaaaccatctgtaggtttcatagcttgtgctgttgagtgattgacgcatctctctgctggttcatcacttaaagatctgaactcttgaaacattcaggtttctctcatgtagtatatttaagtagtcatggaagcttgggtttacaactccagtcaacaacgacctccgaccctttactatcgcttatttcaaaatgcagtttaacatcctgcttctatcaactattgttggacttttcagcgctgctaacagttacaagactgttgtgaaagaattggagacttgtgacggcggttcatgttaccttactcctcagacagtgttagctattcccataactgtcacccttggaaaaacaacgactgtttacacctcgtattgccctgacagtatcacgccaattgaagaggaaacaaccacagaggaagagatagtcagtacagaagtagtcgttattaccacatgtggtccaacaggatgcacgaaggttactagtacatcaggagtcacttcatcatcaacagaagagacatccacgaaaataactagttctgaggatactattactccaacatcatccttcgcagatgtaaccacagagactccatcgcccgatacaacaagttcgcagacaccaacaagttctgagacaccgccagtggaaacttcaagtgaagaaccgccaacttcagaaacatcttctgaagaaagtaccacaagtgaagttccgacgacagagacatcttgtgaagagtcttccacatcggatcttccatctagcaaagattcaagtactatttcgtccaccgagactcctgaaccgactacaagtacaacaactgaaagtagttctaaaatcaagacaacttcaagcaaaagctattccagtaaaactaagactagctccagtattgaaacaacttcaagtgacagcagttccagcgaaagtagttccactcgtaagaaaacttccagtaaaactagttccagtcataagaccacttcaaccgacagcagttctagtgaaagtagttccactcataagacaacttcaagcgacagcagctcgagtgaaagtagttccattagtaagacaacttcaagcgacagcagctccagtgaaagtagttccactagtaagacaacttcaagcgacagcagctcgagtgaaagtagttccactagtaagacaacatccagtaaaagcagctccattgaaactagttctagtattgagacaacttcctatgagagcagttccagtattgagacttcaagcgaaagttattccagtgagacaagttccattattgagacaacttcaagcgacagcagttctagtgaaagtagttcgactcatgagacaacttccagtgaaagcagttccagtggaagtacttctgaaagctctagtgttaaaaccagctcttttgctgattacacttcaagtacgagttcgcctgctccagaaactaccacgagcatcagtaccataaaggaatatcacactgataatatcacaataacaaccacctcaactattaccacttgtgataaaaaacgttgcacaacatacacaattgttagtacgttctgtagtacacctccacaagagacttcggtagctgattatacttccagcttttctgatagttctgacattgttcccagttccacagaacctgaacaaccagttccggaaacttctagaccaggggaatcaactccaacgccagaagtgccaactccaacaccggaagagccaaaacccaaagagccaactccatctccagaagaatcaactctaacaccgggagtgtcaactccaacaccggaaaagccaaagcccgaggagccaactccaacgctagaaaagtcaacctcaaaaccagaggtatcaactccggcaacggaaaggccgactccaacgccagagaagtcatctcccacaccagagaagtcatctgcaacgccagaggaatccacttcaacatcgaaagagccaactccaacatcaaaagagccaaccccaaccccaaccccagaacagccagtacaggaagaaggaacgtcaaaaagtcatgaccattctttgacaataacttcctccttagtcataaccaaaactttaaagagtgacacacctgtacctacggaatgctcacccagtgagacattcattggtggaatttgtgagccattgacacaaacatctggagaatcttctgttctaccgtcgatcagttcatacattgacgacgccaatagaatcccgatgaggctgggagggattgtcttaattcatctgttaatgatactagtgtgaaaatagatcacttctctttttaccagtttcgtcatcataattagaaaatgtttgctttcaatctgagaattctagtacattgatctgtttattttcaagttttgcaagaattgtttggcctcatcaggagaggcgcttctccgccttggtcctaatggctgatcttgccttgagttattagaaacagcttctctaaacctttcatttctaacctgcttactgtgatcagctttactgatattacgtatgtccgcttcaacagaagtcttatcaacttcttgcaataatgatgatctcagtgcgtcaactctcttatcaatctcagagtcgctcagatcttcgtcattgtcctctagttgctctctcaaatccatgcacttgacttcgacttgacgcttcttatcgtgggcaagaatcgccttgtctgctgtgaatctcgttttcctttctgtaatctcataagctctcttgtagttttcctgttgttgttttcttctcaaaaattcaccaccacgttttccggagcgatctgcaatgcttctttgcacatacccgctagtgctagaccctttagcgctttgcaagcctataccgttgtacgacatatctttttgtggggagtaaagtagtgaaagtatagaaggaggctcaggctgatagcgaaaaaaaaaaagtcaggtagccatatcttaaatggcttagaacaaaaaacacaagaaacgatcacctgtgacgaaacgagagtcgttcttgtttttgttccaaacaagaaagagacaatttaaccggcttgacttgctgaaggatcttgtctccgtaccgaagtctttcacttctatgcttagataatcatcttcaacatgaactaacttcgcgagaaatcagatattactatgattactagtggtctggctaatctctatggcccaaccaactatcagtaatttcttcaagagaaaaccaataggacaacttgaagaaggcagtaaaaggcaaaaggctgagattatttcagtggatatcgaagaaccaaaagaaacgtctaatcagcaatcgaatactagcccatcgaccacgtctctgtcttcttttaagtatgaagtttcagatcgaacagtacctgttaactttgatgcaagatcagttactccagaatcagcaaaaaagattgaaaagccaaagaaacgtgctaaatcttcaacttcctcaaacttgactcctctagaacaacaattcatttcattaaaggctaatcataaagataaaatattggccatccaagtcggctacaagtacaaattcttcggcgaagatgcaaaagtggcatcgggtattcttgacattatgtttattccaggaaaagtatctttggaccccaacaattcagaggagacagattacgacagatatgcctactgctctgttcctgatacgcgccttcatatccatctaaagagactcttgaacaaaggactgaaagttggagtggtgaaacaaatggagactgctgcaataaagagcaattctgcaaacaagagcacactctttgagcggaaattgaccaatgtctatacgtctgcgacctatattgacgatacaaatgaacaagatttggagtcaaataaggctggaagcttcattttttccatatgtgagaagaagaatagactctcggtgatggctgtaaacttaattaatagcgagatagtatatgattcttttgaagatactcagataagaactaatttgagaacacggttacaatacttagatcctgcagaatacgtgacgattggcgagctatcaaaggaaacagagcagtgcattagttcctttattatggagaaaagcattgggcgaaattcaatgacgattcgtagaatcccctaccagctagatgctcaatacttggataaactaacagaatttgtttctgcctcgtcgaatcctgtagattctgcattattattggagttcatcactgaactaccgtctcatctgcaaatgtgcacatacggtttggttgaatatctcactgaatttggtctttcctccgtatttttactaaaaagaaactatcatcgatttagtgactccaacaagtatatgatactagactctaatactttgaaaagcattgagattttgaacaacaataccaatggagaggaggttggatccctgttatggctactagaccatacgagaacgaaatttggttacagattgcttcgaaaatggatcactaaaccgcttattgatcgggaacagattctgaatcgctctgcagccattagagatctcagccttcatttcaaatccattttggtggaaaaactctgtttttttctgtccaatacaaatgatctggagagaagtctaagtagagtctactttggtaagacaactcgtaaagaaatgtatttggtgctcaaaaaattcaacgaaattttagctttcatgcaaaactactccaaagctgaaattgatcagcttcagctggaatcctcattgttgcgggaagaattcctcacactgcatcaattggcaacttctgagttgaaaagttttaccgcctacctggggatgattaacagtgctgctgctatggatgagtcggacgaaaaaacacatgtaaccaattatttctcttcagatttttttgattatgacaagattgctgttgaaaagagaaaagtccaagagttggaaacccttctagaaaaagagttgatcaacatacgtcaaatcttaaaacgcccctccatggaatacattagcaacaacaaagaaccatatttgatagaagttcgaaactccactgtcaaaagtttacccaaaaactggataaagatcaatggaacaaaaacggtatccagattccgaactccagaaacaaccaaactttacaaacagttacaataccttgaagacctagtcgtcattgcgaacgaatcgtgtttttcatcttttttgcattcaatcaaaagccagagaccttatctcagcagagttgtttccgctttggcaactttagactgcttaatctctttaacagcttcatctttcaatggagtaaataattgccaaccagaactagttgactctcctatgatccagttggaaggctcaagaaatccagtcattgaaagccttacgaaaactggatatattgataacgattttagcatgtcccagaaagagaatagagtgagcattattacgggtcccaatatgggaggaaaaagctcatttatcagacaaattgcattaatagttataatggcgcaaatcggatgttctgttcctgccactaatgctaaacttggcgtctttgactcaatatatatcagaatgggtgcacacgacgatataataggcggccaatctacgtttcaagtcgaacttagtgaatgctcaacaattatcaataactgtacacccaagtccctggtcttattggacgaaataggtagaggcacttctacggtagatggatattccatagcttattccatcctggactatctcatttcagagccgtcaaaaagtccattcgtactgtttattacacattttccgacgttgcatgttatcgagcaaaaatatggtactatagtaaagaacttccatatgggatacatggtggaaaaaaaagagggagatttgcaggatcctgtgttagtttttctctataagctagtggaaggtgtttgcgagaattcttatgggcttaatgtggccaggatggctttgattccagaggaggttatctccaaagccttcgagatttccagggaacttcaagctaagatggaattcagtcggagaagagatctgatcagaaaatctttggcttgcataagtactttacttcaagaagatgataaagactcggtagaaaaactaaaagagttgagagctcaactgggctgatataataatattgtactcgctagactaacgtttcaggaagctcatgcctccatattttgaagatgtatgtgatccagaggattcagtagcagcgtatgagatatcccccaattcgtcaacatcgtacataactgccccgtcttcaccattctgatattcatggtgcagagtgatggagttgaaatgctcaaataaatcaggggcattaggatcagttttttcatctcctgctccactcccggcctcgtcttcctcttcatcttgttgcaattcagacttctcttcttttgaaggagaagaactcttggaaaaaacaggaatcaaggggggcttttggtttcttagtaacgcccatcttgttgctttgaaccagggatgagctttgatttcagaagcaccactcttagatccaagcctcaaattttcatccttaatcaacaatttcttgattatggatttgcattggtgtgatacaggatggttgtcagggaagctcggttcatatttcaggatattggaaaatgttttctttctggtgttccccttaaaaggtgtagttccaactagcatttcgtagatgaatatgcctaaagtccaccaatccacggcactggtatggccatttccatgaataacttcaggtgcaatatactcttcagttccaacaaaggagttggttctaaacccatctacacaagcctttgtatccaatgttggcgtattcctgtttccaacaatcactgggtctttggttgttgatatctgcttggatagatcgaagtctgacaacataatgtgacccgattgatgcaagagaatgttctccggttttaaatccctatatatgaaacccatcagatgtagatactccaaagcagccgtcacttccgcagcatagaagcgagcatcatcttcagatatgcatttcatctttcttgttttcaacgctctgaaaaattctccacccatacaatactcggtacataggtataagtattcttcagattgaaatgaatggtaaagggttactatgaaaggatgattgcttgttgctaggatctcttgttcagctagagctctattgattttgtttcgccgaatcatttccttcttctttagtactttcattgcgtacaatttatgagtagcatgttccctcaccaagtacactttacccacatcaccacgacccaaaagcttgatcttttcgaaggacttttcattaacctgagcatcacatattttgcgagcgttactagagtaagttcgccctactgatctgtttctaggtctcgtcttgagctccccaatgtgagtatctagctcgttaatcggcagtttgggtttgagaaacgttgttgaatttatgtctaagttattttgctgtgaatgtgaatgctggtactcctcttgtgccatagctttgaggcccaggggagccgatgcaactcttcggagtcttttctgaatggcaaataggttggaagtactgttgcgtgcgcttgaaattgaaggatgcgaatctcttccgctgggcgtggaactatttggtttggaaagggaaaccgtggaattgttagcactttgatggtgcttcaacttaatgctaaggtccccattttccaaaccgtacaatggtttcagcttgttggagtgaggtggtagtccctgatgttgaaagtatggattggaagaaactacattatctgtttcagcttttttactttggaaatttggattcaactgggaatgtgaattgggattgggcattgatggtgacctcagtctcgtcttgatccgtttgacaaaagaggaagatgctgattgtattggagaagaggtaggtttggctatcactgaatgttcgtcgttgggctgttcttgaatggtgcagatatctgaatcgggtttggttgtaagtgaggtgctattgaatggattgggctgttctaactcaggagtgatagctaagttgatttgcgatgaactcacagaagaagcaaacttgaacattcctttcagcttggataatcgtgtgctggaatggtcttcatcagtgtcggagggttcaacaacatcaaagtttggaaccggactcatttgatgatcagatccaccattagtatcgtttccaaaggagaacagcctagtcactgacaatttccgggagttagacctagaccgggattcttgcctcgatttgggtagagagagggagatacccttggaatttgaagtcgattcctggtccatctcttccgtactcttgaccatgctaaatgtgtgggtagaaaatgtgtgcctgggggaaaatcgacaaatcactggagaacgaggatagatagagttcgagaagttgggccaagtgagagaacggccacagaagttgacgaaatgcaccgacctgtaggaaaaatgcaagccggttcacccaagaaaatattacgtaatatatcgacttatgtaagtcagaatgattcttaggaaagtatgttactatggtacaactaaattaatgtggggagacaagggggcggacagattctgaccatcaattagccaaatgtggcggcagcaggaaatttggaatggaatctttgatgtggtaaacgtggttgcagttttcgcagatcattttaccttgcaccagttgggtttcgatcagaagggtgtggagatctttcaaaaggatctcattggaaggatcgttgatgtctatttctggtagctgagagggaagcgaggtgttccctagatctgcggcaacctttagtatagctggccaatccaacctgggaagaatacccagaatgaactctggttgaaagtcttgttcctcttgaacaagctcgatttccgaatacttcagtggaaaagagtttacagcaccatcgcaagattttatcgcacaacgaacgaagttagtggtaagaaatttcatcggtgaatgggggtatgggaacagttggtcagtggggatgctaaattctttttttctccctgcccttccttactagactgttgaaaaatttcgcgtattcgtctatcgctataaaaactttctctcgaccacggtttttcttcttcacattcaaatgattaaaacttctgtcaatcccctgagtcattggctttcaagagccggtgttcgcgtgacgacaaacttttagtgtcttttatgatgaatgtacatgtatttttttttccacttattgggaaaggctatgtagaaagattggttatatattgcatgtcaaagtaaaggttaagatcgtggtaaactgtgttatccattgaaaagaccttggatatttcatatatcctttgaatgacgtagttatcaaaaacctctgctttcagtgactccttgaatatgttcatgttgctcaaataggaatctttaaagacggtccagcaccactcaaacaccttctcatctttggtcaggagagcaaaatccagaatcatcttcaagacagtcttgtcaaaaattaggttgatatcttggacagttttggcattataaactgccttcattgtatctggaatctcttgatcgctgacacagattttcaattcagatatctgagtctcagaatctgtgtagatcacactgttgaagatgaggttttgaaggagtaatttgaaaatgtcaaattgtctgaacctgatgcaaccccttagtgccacccgatacaggtctctgtcacaaaaaagggcctttggatccatcagcgtcatcgtttcttcttgaaagggagcattattcagaagatagctcatattaattgacttggaccgttgatggaagatgatttttgtgactagatttaattgatattcagacatgggataaggatgtaatttagaaggagggtcaacttcggagggcatgaaccaagggtggctgttgtatttctggtagttattcttcagtggtttcagatagtttagtagttgtagggtgtgcaagtacgttcgtttatatttgttattgatgcaaaatagtaggtacttgcttatgagatcatcattgggccggatagcaaaattttgagcgtaaagaagtgaatctatttgacggtggttgtagaagatgctttgaatagtggccctatagtatttgtaccttgaaatttgaaaaaatctgtccatcaaatagatgtacaaatcagaattcggttcgcttttgatgttgtgaagatatgatatgattccttcaaagttgcgctcttcaaataaaggatccagggctaatttgtgtgtttctataggggtactggaaggcaattcagtgtcgtatgatactttttcgtaaagaaaatcatgatacctggataactttggactgctttctgaatatacagataggaggttgttgatcagtatcctgtagtctgttctgcacttgtagatcggggttcctattgtttctatcaactgtggggcagttttaggtaaatcgataggtacagggctccatgtggaggggaatagggcattgatatcaaagttctttacggtattttgctgctgtccatttgatagtaactgtagacgtgttttgaactctgtggtgataggaaactgtttccttttcggcaatgtgaccggtttgggtttcatatcagagatgagagttcgggaagtatttttcaaaggcagggtaggccctcctacgaagatagtgaggtccaggagcagagcggttaatgaaggttagacggaaatgagagacaaagtgaacggtaaataccaggagaagatggagaaggtgttaaatcaaggctgtttaaccttggtcagctatcggaagcccgaattagctcttgtaccacccaacacgcagctttccggacttcattcatactaatattctcaagttcaaaattcgagcctgcaaactgtcagactatttcaccaccctatgaagttacaagtacaggcagaacttaatgggatatctgaattttttcctctagataccccggagtccccctttgaatacgtcttcaagattcaatgcacctcttgtagagagatccatgaaaaagaagtctcaatcaacacaatagaaaaacatgaaatttctggaagcagaggtgaggcaagtttcgttttcaaatgcaagatctgcaaaagagaatcttctactacgatacaacgtaccaaaaacaacctcacctcagaagacgaatccaagtttgtcgatatcttagacatcgatagcagagggcttcagctcgtggagttcatcccagtaggggaattcgtcggccttggtgaatcggggaccaagttttccgtcgaactagaagatggcgaatggtacgactacgatgataatgccggaactgaagtcagtgttactaatgtgacatggaacctagtctaaccaggtaaataatagctgttttttctatatgcaaggcgttcttaaattaaaattcgattggcgtccaaattgcttagccaagcattcaattctgattcttttgttagaggcgcggcaccgcggctcctgcaagtttgttaacccgtttttgtctttcctttttttgtttggaaaactcaggaaccttatcactttcatcaacacaccctcccttgcgcccaagttagccatggaaaggaccaagaaacggcgcagaacccccttttcttgccttatgtgccgtaagcgcaagatcaagtgcgaccgtcggaaacctgcatgctctaactgcatcaaaagtaactgttccccaaaatgtttgtacgaaccaactgtgtggatctcagggaatgaaacggttccaaagtcggaaaattcactgaaccctgtcataccaagcactcctaattctttggttatgtcgcaagagtattatgtccccacgattaccgagttctatgggaaaagagactacattaataccggaagttcgagagaggaagcgttgtgtgaagagatcagtttattgaaagaaagcctgcgaaaattgcaaaaaaatactgccgttagaagaggagctacgatctgtttttttaacaaggtagtcgacccatttgctacttggaagatgaaacgcaagtttcgaaatgttggcgttttctcatggttgagtttgatgaaaaaagacagactaatgtcgatagtggccaacagggctacaaaagtaggcaagactgaacaatctaagttttacgacgaacgccaacaactaaattccaaactattacggattttcgacaatggatctcccaggtattttgtaaaacaggttcctcacccaatttgcttatctggagacatagcatcggtaaggccagttattgagaggatcagcagcactctacctccgatggatatagtggatatgctggtggataggtttttcacgtccatatatccttttctccctatatttgatgagatcatcctgaaagaaaccgttgctcacatcgttaggcccgttgagagtgagggaacggaaactagttcgttaaaagttagtctgcattacaaaaacaaaaaggaattggttaatgtagccttggtgttattggttctaagattggcctaccttacggtggaagttaaatcaaagacaacagccacacttaccgaaaaagaaacacagattttgaacttccctattgggttgagttatattacacattccaggagtattttggactactgcaactatttgaggaaaccagaattagaaaccattcaagctctcctattgttgaaatcctactacacatggtgtccagcagaaactgaaggtatcgctgattccgaatcaaatatcctgatggctgttattgttcaaagtgcttttgatgttggactgaatgtaaattcgaatgctttgttcatccacaccgacaatgagtctcatctgagagtgctccagttatggaaaaagatctgggcatccatcttgaatattgagcatcgcagggcattcactcaaggtgttagtatcagaattgacgaaaaagattatgattctctgttacccaattttgattctacgttatccaacaactcagacataaacgtagagagatgcaccattgatcacatatgggatcgtcagaaattcaatccaatgatcagagacctgatcgatctttctgtgaatatcaaaaaggatccattggtatccgatattgtagattggtgtgaaaaatgggaggctagtgtgcacaaatttaattctagaacttctcatagaagccagcctctagccaaggttgataataccattttacagttggaagcggcgactctgctcttcgtgctgttgcatcatcttttataccatgctcaaaatgccaatgatccagagaattacctgatttatacaaagaagctgttcgagctggttcaaaagatgtaccaactggtggtcgattttttaaagtcgttaacagacaatcctccagactgttttttccttgtaattacttcagttgaaagggcagttatagcgtcattgtatttctatcggcatgtgtcactgaaccttcttttctatttggatttggtaaacgatgcccagtacaggtcgtctgcaaatgcattatatgaaaaagtggacaagaattttcagtgtctagtaactttgagtgctgacttgagccgtgtctcatatacatcttttcggttttggggcatgaccaaatttgtctcgatagttcagaacgatcctatagaaagaagccatatctacgatcaaacggacaacatttctgcgctcatccagttctccaagtcgctggaagctcattttgacgacattgccgtctgggcggacaacaatggatttgatccagactaccaaccggttttcaaaactggagacgacaggaaacccgtgacaaaacaaactgcttcgccttcaagtaaggaaccgtcttttgacctttttacggatttctttaactttgaagggcaggaggagagtttcttgtggtctgcggacacctagaaatgttcagctgcaacagtgaataaataaataatttaataagtacaaatctatgtatttggtctcttatattgacttaaaccacctatagtttcttgccaaaataagtccactggtcatctagtggtttttcttccaactcttcccacgctttccattcagccatcttgtcaatcaaatcatactcttcattagcttggacaatcaactcctcaactaaacctgagccaatttttttttcgatgtcttcaattatctcgttgttttccacgatgctcaatctttctttggtgaaggcttcaacagcagttctgtacactgattcctttggaatcttctcttccaagttctttaatgtggccttgtaaagagttatcagcgttggacgaggacttggatgctgaaacagacccgtcaaaccagtggggtttcccttattggccttgatcagaatctcctgggcttgtctcaaataggtgaaggctctcatggcggggtgtatgtagggctcgttagtttttaatgatgatgccaattatgagatcgctattggccctggtgcgcgaaagaactttgcaaagatatgatgtttggaggcaagaatatcatgtgaaactggagatgcgagggaactcaaagttggagggaggtataaatactcgtgtgtctgtccctgcccagaacataaaccaaatcaaacaagatcaaccatggtatcccaagaatttaacgataaagtaggtatagtcttccggtgtatggtgaaatgcgaacactaacaaactcaggccgaagctgtgaagaacctcaagaccaagcccaacaacgatgagctcctcaagttgtacggactgttcaaacaagccacagttggtgacaacaccactgaaaagccaggagtctttgacttcaaaggaaaggctaaatgggaagcttgggacaagctgaagggcacttcccaggaggaagctgaacaggagtacattgcttacgttggcgatttagaagacaagtacaactaatttacatttttctcttttcttctatttgactttactcagtagagacacacactttaggtagtactgtacggacatgacggcaggaatgataaatgttggtaggtagaccaagaaaaggggccaattgaatcggactagtcccgaccccacctcgcgttgggtgatgtatacgagacatgtgtatgtcgtcagcgccgcgttgaatccgtaaattgtaatcaatgggtaccacctcggagagaatctggagttacgccaataatcgaccacaaggaccacgaacgctggtaattgcaggatcaattccaggtaaacaaaagatctgaaccaaagcggcttcgaatctagcaggaaatcaccgttggcctgttgatggaattctaccagcttttcttgccactggaaccatggggggataaccacggtggcatcaatcactacagtgattgggatgtgcaacaagaagtagataaaatagaaatattccattagacgtcgttaagagtagcttaattatcaattataaaagggtctgggccaagggccaagggccagtgcacgggaggggtgtgggagtgcgcgggcggcagcgttgaggtcagataacttttcttccgttgggcacgaatagccgggtaagcgtgtgggctccactagtctcagtacttcacgattacgtaaagggcgtggatgatacctggaatatatcccagacacgtgagcacaacgttcaacagtaaggtgcagttacatcctacttccaaaaagacacccaacgggggtagaataatagcaaaaatagctttgatgggatctgtgcaagtgagggccatttttgaatcggttttcttttagttaagggtggaatatttcaaaaatagtaggaattccggtgttatttatagtgatcaaacagggcaactaaatacaggagcaattcgcggtgcctaatgcacatacattctggttctaaattaggaaaaggggcattgtaagtgagcgcaagttcactgcgattttgacatgacgaggcagagaagaatagcagtgagagcacaccacccaattattaagagagatctgctattgtaccatcgaacctccaggagaggaatcaggacgactcgtgaaaatgttcagcagaaacaaaaaggcaatttgtttcaggccgcaaattcttcacaccgggaagcatgttgcatctgcgaggaaacccttatctgctcgattgcttgcttttttggccaaagctttgctcttcttgtgggcctagtttgctttttcaagacacaattgaaaaacaggaaaaaaaaagaaagaacactcagccgaggggtgacgatttattgtttccgacgtcatcttgcttctattacacccccatgagatcagtctctattttccggtcttacgtaaactaagtcaatgaggggagattcacgggttaacttgccatgtttcaagttctttccttccccattttcttctttttccgtctatatcctgttttgacttactctcttctcagtccagaatgaaactcaatagggattcgttgaggattgaaaggaaagaacgcttaaggatggagaaggtggccaaaggtatgtaaagatcgtttttttttcttggttgctgtgttctcaatagaaatcggaatgcaatttggggtgagcagacctaccaaaagcactaggcgtgatacagagtgaggagtatgtccagctgtccctataatttctacatgtcctctggtactttcttttcttaccatatttatgtgcccttcctcccctgccaatcgtccccatacgcattcaaatcatccctccacgtttagtgcgccacccaatgtagggcaggaaaaatgatgacggagaaagatccaaacaccaaagtacccagttgttttggctgatcattcatttccctctcatccatttctaacacccaactaggcggacgcaccccactaatacattccttttcactagagatatgctccagaacggtctaggacccggtgacactaacacccataaaggcactatcaccaaagttgtactcaacagagattcagacgctccaatcgaaattcaatacaccgatacagttaaagtcggtcatggttcattcggtaatgtttaccagacgttacttttaccctccaaagaacaggttgccatcaagaaggtacttcaggataaacgattcaagaatagagagttgcaaattatgaaattattgcgtcatcaaaacgttgtctccatgaaatactacttctatgacacggaggagaaagatgaatacctcaatttgattttagagtacattccagaaactctttataaatcttccagttactacctacagtcgaaacgggtgatgccagagctggaaatcaaactatactcttatcaacttctgaggtcacttaactacattcattcattgggaatatgccatcgtgatataaagccacagaatttgctgattgacccgtaccatgggatactaaaattatgtgattttggctctgcaaagattcttaatccggcagagccaaatgtctcttacatttgctccagattctacagagcgcccgagctcatctttggtgccaccaactatacgactaagatagatatatggtcagcaggttgtgtcatagcggagttgatactaggagagcctcttttccctggagaaagtggaatagatcagcttgtggagataatcaaggtccttggtacgcccaacaaggaacagatccgtgctatgaatcccaactatatggaccacaaattcccattgatcaaaccaatcgagttaactaaagttttcaacaattgcggcatggattgcattcaattattagagttagttcttagttattcaccattggaaagactcagcgcagtcgaagctatgattcttccctactttgatgacatgagggcgtcagaggctgtatccttaccggactaccgtcattttgattctggacctcgtcccgtatcgtctctcctcaacttttcattgcgagaactaagcgtccgtcctgatctagtcaataatttgattcctgaatggaaaagaaagaaatgggcctccgagacaggctgggacctggacaacttggttccatatactccagaacaactacagaatccacagatcaattaacgaaacagtactttagatcggctgaccttcaagatataatgaataatgatcaatcattaaaatacgagactacgtcacgttccactacaattctaaccctaaaatatccttgccttcatatttaccgcatagactaatgttctttatgtctttataactaaaatgttctcttttctttatttttttgtttttgttttgtttttcccttcgacttcactgttgatagaaccacaactatgtgcttttaagtttttcctcagttccatactcacggaaatcttcttttccctctaagtcttctcttatcgaatcggcctgcttgacttgtgaacgccatgtctttacatctttcttcttgttcttatcaaagagttccttgtctggcattctgtatgatccaccaagacggtcccaaagtgttgtgaactggccgtaattgtagttgaagtataggtgatgcactgtatgacaagcagctccattgactatagggtctctggacaggtattctccatcatggatcataacagtccaaaagttcacaagcccaaataagatcagatagctcaccttgtgtagtggaaacaacattccatacaaatggtaaggtagtgattgtgcataaccatcaactggatggaaggcatgactagcaaaaggtgtacaaacaatccacttgtggtgaggcttgtgcaaacgcttatacacggatggccagtgcaaccaacgatgaataaagtagatacaacaatcggtaaacataatgaagcaaggaatttgccaaataatagccttccatcctccagtagactcatttacatcaaagtataatttagagtatccacgcaactcaatcaaaaaccatggaactgtaagcaaaaccatcgtaggtatagcagtcaacgcttgatggatctccagagacatctggtttttgaggtatcttgggtgattgaaaatggctttatcaaaaacaaagtagtatgaaaatgaagccacagataaatacaaaccccagccaaaaagaatcatcagaatcatcaaagttgtgaattgtcgaatgatattggagcgtcccaagatcgatgcgtatgtatacgctgtttcgtcaaaaaagtgtaaaggagcgttgacaccgtagaccagacgctcaccgggacgggctaaggcaatagagtcattcactgttctcagccagtggttcttagacgcttggtcaacgtttggagctattccgaacagtgattccatggtgttgttggcaccagtcaaatgtcccaaagtcttcaaatagccatctggcaaatgttgcaccagagaaatgggcagtagttttgcatagactttgtcaaagacaaaagtgtctagaatctccaaagcaatgtccatttgtatacgtgaactctcctgatgcttgcaaactcctcagcttgtgaagaagtggtctgcttataaggagagaaaacgctcgtatatctcgtttatatcgcgagttatacgagcaaaggggtattgttttttttttcttatataaaaccctgtgtcaatcctgcccccagtttggacggaggcggaacaaaagctggaacgagcaaccaggtgaatggttcctcccaataagatcgaatgatcgcgcccctcactaataagtggtacgacatcgtgcacctcgaggcagtatggtagcaaaaagtaatcacaccacaagaattaccgtacggttcttgtcgtcttgaagtaagatgttatactttcggagtcacggtagtatacgttttcgtcatgctgggactggtcattccacctcggtcttgtcttatcttcggaacgttccccacgatccttgagatccttagttagccaatgtaatgccaatgggtgtaggctgtttgttcttggaattcgtacttgattgcctgcaaccgttggatccgttttgaatgactctgtaggctcggtgaactggatttgtgacatttcaaagtggtccaccaattgacctcctcgcaaatgcaccaccctagtgggccaattggccaatccgtcaaatatgtgagtggcataaacaaccgtagcctttcttgtttctgtctcctgagtcaagaactccaataaacgacttcgcaccagcacatccaaatcaatggttacttcgtccaacagcagcaggtcccaaggtttgagtaaccccatgcacagctgaacccggcgacgttctccatcactgcattgattcatacgccatttcacatcaatatctaaaatgtcgaccagatggtcccttctctccgcatagtcatctccaccaacgctagcaactaggacagtaactggaacgtctctcttgactatttcattattagcccattctgtacctaagtacgtaacgactccaggaatactggttgcgccaagttcaaatggatcatgcccattgaccagaacggaaccctcctttaccaatttctgacctgataacacctttaaaagagtgctctttccagcaccattgggtcccaccaacagtactttggactggtgaggtatctgaaggttaatatggctgagaccaactttcttattagggaatgcatagctgaggttcttgatatccaatgagaacggtgattggggatttgacatgatacctgattttggttgtgggcagagtgaaaaagggtgacaggaataaacccaggaggagaatcggccacttcgagaaaagcttcggccaaaggcctttccttccagcgatttcccactttgctccagtatcaaatctccttcgagcatccaagctattcgtctgtagaagcatattttcaactagtccgcgtgccatatgacactctcccaggggactacagacaatgacacttcatcacaagaggctcccaaagagtcttctccaatggatgttgactcctctgtgaaggtatcaaaagagccttctcaagagccctccaatgaagcgttcaagaataatggtcctaccccatcagccgattcgttggcttcgataagaaggtctcttcgtaaaagtgcattcgaagctgtgaattttgatatagcgccatatgccgcaattccttattcatgtgcaatccactcgatagctctcacaagcggacctcgttggctattcactggaggtgatgatggattcgttcgaaaatttgattttttagcttccattgagggaaaattgccgttgactgtagcacagaagcatagtttggtggattcagtgacacatgcaggagttttgaattcttactgggaaaatgaacaacctgtattacaagacgaactggatttactacccaatacagaggttaaaagaaaggaagacaacttaggtagttatgaaccaaaaataaatcccgtttactcattggcagtacaaaaagacggtttgtggcttctgagcggtcttgaatccggtggaatctctctacaatctgccaaatatcaagaaggatcaattgtacattattttccacatggaacaaaacacaatcataaagaaaggcatacgacaaccgttagttgcttgactctaaatagttcagaaactggttttttaagtggttcttgggataataaagtacttcaatgggatttaaatactggatcttgtgtcacagagtactcgccaaccactagccaaatttcaactttacattacagaccgatcaccgggtgtgaaattaatgtggacacacccatagaagataatgatgatgtcgactctctgttcggggacagtgacgatgaaaacgtgaagactgattttcagaacgatttaaaagacagggattaccaaattgtcaaatccgaccacgtttttatgactagttcaatggacggatcactcaacatctgggatgctcgtgcatctgcttccaatgtacttcgaatctctgtccctcctactactcccccatgggctatgtctgctgtatggtctgtatcaggagattctatttttgtaggaaggaggaacgctactgtggaggaaattgatctaaagatgccttctaaacgaagctctaacacaaatcctgtgacaaaccctattagaacactcagattcccatcagtatcaggaccagttagttgtgtccgcactctttttaacggccgacatgttttatgtggctctcatgataacattagattatacgatatacgattgcatcaagaggaagctcaagcttctaagaaatcaagatcgaaaactccattcttaatcattgcaggtcaccacggtggtgttatcagtgacatgtatattgacccgacattcagattcatgatcagtgccagcggtaatagaggttggcagggaactagcacagaaacagtgatgatctacgaaatcagtatcaaatgataaatgcataagattttttaaaatctccaaattgtattacacatatcacgccatgtgcgatgatgaaagggaagacccacatattggttatgttccagacagcgaccaagtacaagggataaaataccaaccgtcaccgatactttgagcaacagcttgaggttgttgctgttcctatgaagaagcttcttacaattcttgacaactgataggtttctctttctcgctaccagatacttggtatgcaggcgtacggtataatcaatgttactagaagaaggttgcttgatagcagaacctgagaaaatgtccttggaggttggtaaatctgataacttgaccacgctaatgagatactgagtttcgttcttccagcgagtgagaagatcttggttggagctgccattggttccaaaacacttggtcaggttagaaagtgtgaagtggaatgcatctgtattctccaaaacaaactggcgacttaatgttggcgcagacgttacgcttgtatcaatttgacatcctgacatttccactacctgatctataatttgctgtttattgataagtatcaacacagcatataagtagattaatgcctgggttacatttcccatagcaaatgcaaaatcccatagtaccacaacgtcttgaacgtctagatcatggctaaacatggtaatgattgaagcaagggaataaaatggagggattagctccaaaaggtctccaaatcgtttatcagcgacttttacaagatcaactaccaggggtaagagatctgtagttcccgtcatatctgcaagcatgaagtccctgaggtgatgcaaacataatgtctctgcaatgtcgtatgtaagtgtttcatcatagtcaagggtgacaagcaatactgataccacatcatggaatccttgatagtaatgtaaatatggatgatttctaagaagcttgacaatgacattttgcagcagatggtgcttatctgacggaaggtagctccgatcaacatccaatctcacttggccctcttccagatgtggttttagagaacttgcgtcctgcgacaattcatgttgaacattcagtagtaatggccaagctgtggctctcaatgaactgaccagcagcccagatgggttatttatggcattttgtcgcaacccatccacattatcggtgaggagacatctttcaatcgatttcttctcttttatgtggggattttcctgaacatggaattgggcatcttccagttcagattttgtcaattcctcccatctcgtgtgagatgtggataatagttgcattggacacaggggaagttaaaacggccgtcgccctggaagatgatgccacttgggttatttgcggaacaaactcgatcctacttttcgagaaaaagtgccaaactataagcactagtgctttagccaaatctcacatcttccatgagagtcattggtcaagggtttacgtcaacggtgtatctgaacgaagagggtaacgtgcagaagaaagtcgacttggattacgttgtagctcctcatgatccaagacgtgagttggaattgctgaaaaagttggaccatcccaacattatcaagctactggaatggggcacaaatagtgatgagttggtgttgactttctgttattacgagaaggatttgtacggagtaatgaaaagcaatacacggactagatttgatatacattccttgcaaaaaactgaccggaatcagttaccttcagaaagcgccctaaccatcgtgactggtttgtgtcaagcattacgatatttacacacagaaatgaacattatccacagagacatcaacccaagaaatataatgtttaaaaaagactcgcctgagcctgtgttgatagattttggtatatcgattgaggaaagccgattagatggaatctgcgatattggaaccagttgttatagagctcctgagacattactaggccttccgtactcatatggagtagatctgtggtgtctggccgttgtcatgatgctaatatattcaccagattccggtgaattgttgttgaaactgcataatgagagagatggtaaccgcgtgggagatcgattgggcgatctcgctctgctagccaatatttttgaaacatttgggaccccatcggtggagcaatggcctgattcttcccagagcgaggcatttgtacacatgaactttgtacaacacccaggacgacccgtggaacagttacttcctcgatgtgacgatgcaagggtgaaaacaatatttgagcacctaactgtctatcagagtaccagccgatgggatataaatactgttgtgaatgagctagagaagaaagcatgaaatagaagattttgaaagatcatattattcagccctcaatcttgattctagctgttgaaactcaaccaatccttgtaatcgactcaattcttgacctttcatccaattttgtttttccaattctattaatttcaattgcatagttgtcatcttatctgaagcgtccaagacggggcttttttggttgacaggttgaacctttctctttgattttgagatggagtccttcaacacaggggtgagaggcgtggttggacccctctttaaaccgttgtaaaggttctctttagaaggggtagtgagtatagacatgttgttctatatgctaggcgagttggttagttcaatgggtggttggttggatggtatgcggatatgtttttttttgtttacttcaagttgttcggttagatccctgagatgcactcgcgcgctttgcctgacatgaaattccaggcttaccgatcttctctctgccttccatcgattcagctctcaggcagcgtcaaaaccatgagcaaaattcattttttcaacctcccaaaggagccagttcattcccccgtattcattttgcatggtcaagttacatctactcaaaggaatggtgttttaagtgtggttcctacaaacaggaaagtcttcccagttcagcacttcgaggttaacgagtcctatttcaaagcgattttacatctggaagagggtgaaaatgaattgattattgactacaatgaaggaaaaatgtacggagaacttccttcactatctggcaaaatttatgccagttccacagtcaagttgggttatgaaatcaatgaagaagccactcccattcacttgtgtgttctcgttgccaaggattctcctctagtttttgacaccacagctgtaaagcttcgggaagaaggtaatggtttggatctggcgatccaaaagctcagaatgggaggccgcctaatgcaagcgttcacacaggaagccatgatgaggaatggattcggtcctagatgctttcgtttcgtagaagaagaaacaacatctacaattagtaggattgaacagcaatacggtgttcgtagaaaggacataaaggttcacgttttgaggagtgaaaaatcgttacgagaactccgagatccaaatctagcccaacagaataaggatgctagcgacgctggagggttatttgggattgccatttcagagttgtgcaggcatggaatcaacaaagggcaagccgctgtgatgttcttagatacgcattatgaccgtgatcgagacctaattttgacacatgctgccttaggaggaggaaacaatgatataaagttagcaatttttgggtcgcatggcttatattcttggcccacctgttttgagactgtagttcccagttttcaagacacacgccgtcctgcacatagagaagtggccaacgattgtggccagtgctcatcttattgggaatgccttacagtcactcttggtgccttcatgcatgagattggtcacttgctgggatgccctcaccaagaaaatggagtgatgctaagagattacattaccatgaatagaagtttcataactagagaaactgcctgcataagaacacatcaaacacacgatagaatcgttttggccagagatgaacctagctggcacagactggacatactaaggtttctgtaccatcgttctttttccgtaaaaacggatgattattataatatgactgcatctgactccaatacggacattacaggcgttggggaggacaagttgttgattgcaaacacctctggagtttatttgatcgaatttcacgtaggagaatggagcaaattgcattacgagaatctcccgaaaaaatatgggggcacgggagctctgcaaaagttggtgctggagggcaaccaaatacggaagcaattgtccttatcgagaggccaccccaagattacagtaagaatactaagcgttaacaggaaagagcgatctctggatgattttgaaaggtcgctaaaagaactaaactcaaccaccaaggttaataacatcacggtacaccgttcggcgaagcttgggagtaataggagtaacacaccagagcaatctatagctcaatcggtcattaccagcatcaggatttatcatggagcagcactagatgggttggaggtgaacggtggaaaggcattactaggcaggaagaccgcttcgtactccgatttcgtaatcgctgcaggggactctatttgccaggtgaatgtacgtaatggagtttggatagattcgatacagttcattaccaagaatggacagcagtcccccatatacgggaatgcaaccggaggatcattgaaccagattagcattgtcgctccatacaaccttaaagggttctttggtaattgttcgaattggatggacagtcttggagtgttgtacgggtaattggagcctgtttgaagcgtttgtttccctttggagcggtttccgtgtcatcaagatgtcggggtccgtcaaaaaaaatttagcgggcactccggggtccgtggggtccgtgtggtagggtgtgccagacccggtactctaaatccatcccaaagagcaaagaaagggttgcatgaataatggacccttgttgcgagcagttactgttgcaagcagttactgttgatagagatggtgttcgctagtatacaggtcaaatacttaaggttatcctttgtgtgggaggattttagattaccgagtcttttttttagtggagtgcagtgggatgagaaaagttggcccgacctcggagaatttctcgtaatatgttgctcaatctattaaaaaaaaactcggatacttcgaaagcaccccgtgtggttatcccatgcgcgtaaaattcaccctctgcgaatcgagggcgccccttcagaaacgggataaccgggtgttttagcccagggcaatatccaatagggctaacctagtcgctttccgagcccaatttgttagtcttggcgcaccccgattgcttgacacggagtccgtcaatacctataaaattgggatttagaggttaattattttttaggaatctgtaaccacacccctcttcggaccccgcctagtattttcttctcatgcccgaaataaataaaaggacaattctcccccagaatattactacttgttcattgttttaaaattccaaccaggcttcgttactcctaaaaaattttcgaaccacgtacaccttcagcaatgtctttgattccagagaagaagcttttcgacgacaagctcttgatcaaaccttggctacagtctcagttgatagtgaagggaatcaacatagtcatcgagaggtctgatgactctaagattgttttcaaatgcaaaaacagcggcgtttgtggaactgatgaagatcatgtgcactttgccatcaagcaacgcaaacgtgctaaccgagtgaaaggcttgtctgtctcagagaaggaagacaacgagcgatttattagcagtgaaaaaaagaaacttaaagatttaagaaagaagcacaactgcccatttaggatacgggcaaacttctccttgaggtcgaagaaatggtctattgtggtggtaaatgatgagcataaccacccattgtaccctattattgatgcaaaagagatcggaagaaggaactcagagaaggacattggtcatcaccatcttcctcaacacacagatgaccgagacgattttcagcaaacacagcaacaacaacaacaacaacagcaccaccagaatacgtcgtcctcttcctcttcaacatctccaacccctttcgataaaccatatcagtcttacttggctctgccaagtattagcaaggaggcatccaacatttcatctcctctgaacaacaacaacaccagtaacaataataataattctacgatggctaataataccaatactgctgacttgaacatcagtaatatccaaagaatcaacaatttacagttagagctgaataacttattgattcagctgaataacagtaactattcgttactcaattcatccactaagctttcccataaggaggatatctatttgaaactgatttccattctgaaagactctttgatgcaggaaagtttaaactacagctacacggtttcgacctcacctggtgtggggtctggcgctactccaacgaaccagaataatattcttcttccatctttacaaccaattagatccacttcaaaccaatcctataattcgtcttctgctcctcagaatcacatattttctaactatattgcgggaactcatgacaacgcctttatgaagttctagtgggtgcttaagatctgtcttttttatttataatcggcccttttatcactttattttttagtttatttattacatctttcgtctgtatactagtttgggtcaaagaagtcaaaaatcgcacaatttgggtgtagaacgtaaacgtagttaacaccttgcgcagcctctgcatcagcgtcttcgagatcttgaacatcttgttcgttgggtgcaactttcatcaagatcttgtcatgtaccaatttactgagaaccttgtgcaccaactttctttcagcccaatattcttcctctgtatgaagctcatcctccttttgtaaaacataccaatcagtgatttcctctttgttcaatcctgcaccttgattctctacatcagcttccaattcggcttctcccccaagatttgtgttttcttgggagcctatttttctgactatcaaattcatcatggaaatgtatttgtcgtatgaaattgtttggtgacgtttcttggcagcgtctgcgtcaatttgagatagagaacgggggtcttgctgactgggtgattctcctcccattggctcgtcgtcgtcatcgtcgtcgtcatcgtcgtcatcctcatccacattaatatcatctttgtcaactttaatgatggattgccgcagcaagtcataggcttcggcaacaaatcttggggtgatttcatcagtacagtttgctttagcaatcgcttcggatagacgtatcatagattccaattgtctgacagtgatcctataacttgatcttcccaatccttgagaatcgtcggcacgcaattctttgtatctgctaaccagaaaatctctagcttctttattcatctttggcttgaatgtctgaccatatctgatgtatcgtagtacttgttgctttgaaaatggagggttaattgcttcatctctcttcatgtgtaaattaacaatatggtcagccaactgggtatctatattaacgttgacttcgtccaaaatcacaaaaaataaatcaaaacgggacataataggtgcagtcatggccaagtttctcctcaacccatgtctaacattgtatcgaccaccgataggatttgctgctgccagaatagaggttctggcattcagagtggcgtgaataccagctttggctatggaaatagtctgctgctccatagcttcgtgaatggcaacctgatcacctatatccatcttatcaaattcatcaatggcacaaattccattatccgccagcataagagcaccggcttcgatggtaaactcgcctgtttcttcatcccttactacggctgccgtcagaccagcagcagaggaggcctttcctgaagtatagattgcacgtggagcaaaactgcatacgtatttcaaaaactgagatttggaagtggatggatctccaacgatacaaatgttaatatctcctctaaggtttataccatcaatagtttgtttgtggacaccgccaagtagttgtaacaaaatacctttctttacggcttcatgaccgaaaactgcgggtgcaatagactgaattagttttgcatatatatgctcatcttgaaccatttgtttcaattcttccaattcctctttggacaatgtattaaggaagtcttcttggtcctgggtatcatctaactcatcgtcattgccagcataatctttattggtgtgaaccaaagagttaacgtgacaagccaagaaggcaatcttgtatgtcaaatcacgagaacctaaagcttttaatcctctaactccagagtttagtccttctgttcctcttccaccactagtctgtttagttgaagtaggtttcacccctggcaaacccaactgggatacatcaggaacgacgatttcagttcccgtaaaacgacatttatcaccaggtttggctcgttcaacaatatcaccacggaggataacatcgagagttcttggcatggaaccggttggtatttcattggagttttcttgaatccgtaccttttgccaatccatgaaaatggatcgggtgacgtccagcgtccaaagagactgattctcacagttcaaagtgggacaacttgtcggctccgtaaacttgaaaacttgttcgattccagtcactgatgctttacaaacatcacatgtaaagcctccaagatacaattcaggacgcacttcggaagtacgcgtaacggtcccggagattgatataagagaaccaattctatcggcacgaatctctctaattcgactgatttgaggcaagttgtagaaggcaatctggaaaattcgttcttcagcaaagttatcactatcaaagccagtaacaaagtttaataaaagtccgggaacgttttttttgatcactctgcgaagagctttcaataaatggggaagaaatctgtaatactgttctgtaatagcactagctaacactccattttcacgagtcaacaaatgctggtaatccacatataatgtgttcagatcgtgctgtcgcatgacttccaattgggacaaatatatacgggctccccatttattctcttcttgaacctcttgatcaatggaatcatcagaaaacaactctaagaactgttcaaaagcctctgcaactttttcagcagtcacatctactactttaggaatcgattgtaggtctcttctccgcagtgcttctaaaggagcagggatctctccattttcacggtgaagtccattttgggacgcctgttggcgttgttgttccctttggcgtatatctgaaaaatcactgaatccagtagacccccctaccggtcccaaagacgatgggggttgtgacgaatgaaatgcgttaggggaggaagcaatttctgtcatctgaagtgaattgttgggaacaaagagaagtagttaacgctagaaagagaacagttgagaataagtttcaggtgttcaagtaattacatttcctaatagggtaataatcaatgaaaaactgatgtggtgctaaggtgtgagaatatctacgagatgaaatattcgtatcgtctaataattggttatagtagtacattgatgctcagttatggaaagactgttgtagtaaataaactttttgatacttgctaatgatactttgctctttttctatttcccgttctttttttgtcactatttttatttcctttctccgacttgtcgttagagagttcattcagatactgcaacacttaatgatcacatctcttgtgattggagccttttttctatatcggcaacttgaatttctgcccattttttattcatctattctgattcatcccggaaagtctttttacaattaagacacacatagaacagtgtcatgttagtatctttacgtcgttgttgcgattggaaaaacacgcaatcacgagaatgacattctgggcattctttgtctgatcttggtagagtaggatcctggccaatatcatccacaataccagccgtttctccaatattggtaatcagctcgtgtctgtaaaccttcggatcttcagcgagttccgtgtagtcacagtttcgacatgagtacaacagcctttggttctccttgtcctctttgggatacaacatattgttgctaagagaattaacgttagtcatatcgttcaaaggaaaagaaaatatagtggaaaaagaaaatttaaattgtatccacgacaaagcaaatcccggagcttaaccggtttatccactttctttctttgtcataatatgtcaacttaccactcaagacaaaatcggaaagaagccatttctgttcagttgtcttcagtctgatcacagctagtttggataaactctcgataattcaccattgcaagaaaaacaatatgggtttcacactaccctcgatttattggtgaaaaatttagagaaacacccatcgtcaaccaaactcaatacttgggtcaaccaaatcaaagctcagaacaacttgaaaatgttagccattttacgtcaatctactcgagcaggggttagaatgtcctcaaagaggtatgtagtgaagcaatacactcctaatgtatacgattatgtcaaatactaacattaccagactggcagtagccccaactctgcttcgtttcaattccacagctccagatgctaaaatcaccaatattgttgatcaaatagctcagctgaacttgcttgaaacttctgctttgataagtgagctcaaaactagacttaatatcgctgacattgccttccctgctgctggcgccgctcctgctcaacaggctgctgctcctgtagaagaagaagtcaaagaggaagtcgaagagaagaccatattcgctgtcaaattggaatcatttgatactaaatccaaggctaaagtcatcaaagaagtgaagtccttgttgggcctgtctttggtggaagccaagaagtttgttgagtcagcaccaaaggttttgaaggagaacgttccaaaggaagatgctgaaaagattaaaggagttttggaaggtctaggagcaaaggttactcttgaataggttaactgaggattacaaaatcaacaatgatagaaagataggggaaatcaagagacataggcgcttgtatataagaggtatttgaaagaaagtgtgttttctctgagaaataaaacgattatttaaggagaaccagagtagaaaaggcaaaactgaagatactgcggtttggttttaacttttggcattttcatttcgattttagtactaattctaatcatgtttctctgtaacttacaaagagcattaaaagtcttgaaaatgctgtgcgtatggatcctctccagcaaccccatagtctagctgctcttcagggtaatgatcaaacaacgaagtgtcgccaactcccgcggtaatcggaggttcgtaaggagtctcaatgtcctttagcaaaagcttctcccaaacaacttctccaaaccatggatggtttcggatatcgtgggcaccatttcgtaagttacccaatcttctggtaaggtctgccgtaatcaggcttcccaacaagtccacagcatctgggtggaagtgagatgggtaatgaaccttacctgccaggatcttctcataagtcttgatgggagtctgatcataaaatggagtacatccagccaacatttcgtagattagaattcctaaagaccaccaatctactgatttattgtagggttttgtggtaatcacttcaggggcgatgtaatctggagtaccacacaatgtccatgtcacagtctcaacctgcttggcaaatccaaaatcggtaatctttatgtgaccatgacggtccaataaaatattctcaggtttaagatctctgtagatgatattgtgcaagtgcaaatagtctatagctaaagtgacttccgcagcataaaatttagccactgaattgggaaaacgttgagacttgcgcagcaatgaaaacagttctccaccttcgatatagtccatcaccataaataagttcttagcatcctgaaaggttccccacattcgaatcaggaaagggtgctctaccagtttcaacatgcgtctctcatcattggtatgttcaacttgtttgagacgaacaacttgagctttcttgagaaccttgatggcataaaatcgcccattatgaaccgacctcaccaaatgaaccctaccaaaagatccagtaccgagagtccgcatgatatggaagtcagtcagagagtacttccctttggacaccgcagacttaagatgaaggctctgactcgggagtactacctgtggttgctgtggctgagtttccacttctccttgggcttgctgttgttctattggaatagattgttcatgttgctgtggttgtggctgttgagcaagttgccgctgttgttgctcctgctgtaattgaacttgttctggtgtctgttccagagtgtgtgaatgattggagctagaagcagctaatcctccctgggcggaaacctgtgatggcaattgagcttgttcatcttgcgaataatactcttgggcgtagtaatccatttgcttgggttgttgaattggcttagatctaccgggaatatgtagtctattcaaaaagggcatcaaaaatggcaggcccttcgaattattaaagtaatgtaagggttggtatcaggattttggtctatacatgatggccaaagtggaattttggcagcatggcgcgaatcgcgaacagaagtcagtagtccctctttataggaatggagagagcgagagagtcttcttccccttccctggaagattagatctatttactatgacgattagttagggggactattttgaaatgcatactatctacggcctccacggcttcctccacggcctcctccacggcctcctccacggcctcctccacggcctccaccgcggcctccaccgcggcctccaccacggccgcctctcctggcaaagttcccgtatcgagcttcgttcttctcatcaatcacacgcttatgtctgatttgctctgtgttacgcagttcattaacccctgatccagatccaactggtttgaatccttttattctcatacccgctccaagtgcaccctccaccttcttcttttgcttgtagtagtcatctctacccttcagtgggatctttggtgccttggtctgcttatgtctaatctttccgttagccaacctgctagaagcatttcctgcaaaagagttgctgttcacaccagcttcttccttagcaccaacgcggtgtttggaaccaccattggcatgactccaagcttcgaatttaccagctttgtaactggcagggatacgagctccactttcgccaacaataaacttcttgtctgtagactttgcattgacatatttacctttctttttgtcccattgcatagtctgtctatgcacttgcacaccatcatcatctgcaaggtcaaacgcagctctttgtgcttcctgggcgaagtaagatccagaattggcttctccatcttcctccatctgcttatcctgcaatgaagataccggagcataatgtgacatgaaaacagactcatctttgaaacttttcttgccaagtaacctatcaccgtcttcaaacgcagaactcagttcttgctcgttcacggtgctatagccgatctcattagcgtcacctttaataagatcgtcgtggagtgagtttgcgagcccagcctctttttcctgttgcaacaaagcacgacgttccgctgctcttttttgaactggtgccacctgtctacgacgttttgccatcatcagggcaaggtgatcgtcattgtgtccaaattcaaagactgtttcacggtccttacggtctcggagctttgccaaaaataattctttttcatactcctcgtttgctccaaaaaggatattttgctcatcccactttccagatgccttcaactctttggttcgtctgacagagtcactagaagcagcacctctagttctaaagtatagcttttcagcttttgtggcaactccactttgcaactgtaaatcatacgagtctttcatgatggtattgaacatttccagatacccttctaagggattacgtgggcacgatccaaggaccaatctttgggtgaacgacacggctggaggttcaaacccttctaaagatccattgtgctcttttttatatctctcttgcaaaaggtgaacctttccgttttgcatctcagttaaaagaactttacgtcccaaaaacagttccaaatccaataagtacggaagctctcggtcttgtacaatcgaatatgcccatcctctatgacctgcacgagcagtacgaccaaccctgtggacgaaaatcttggaacttgctggtaaagagaaattgatgacatttgccaaaacagggatgtcaataccacgagcagcaacatctgtgaccaccaacacggtagcaataccggcacggaaatttagaagttgctggcgacgagcatgctgatccagagaaccataagtgtatgccacagcatatccaatcttcttcaaaagtgtagtgatgaactcaacatgatgtttggtaggaacgaaaacaatagttgaatgtggtgtgggcaagtctgttgcacgaggaagcctgagagaacggttaaaacgtggggctttacggctcccatttcctgacttatttctgttgttataatcattttcctgtgtttcttcatcttcatcatcttcatcaccttcagcgatttgcttcaattgatctgatgaagctagaggcatcttgatgacctcttgcaataggtaaagaagatttccctcacgctcgttatccttagaggatatgaatgccatttccaactgatcggaaatcgtggattcggcgtctaatcgtactagtactggatttattaatccagctttggcaaaattaatcaaagagcttggcaaagtagcagaaaacaaaagagattgtcttcgatgtggcaatgcagctagcagttcgtttaattgttcagcaaaacccatctcaaataatctatctgcttcatcatataccacatactcaatactcttgagatccaaactcatttcaaccttcaagtgtaagaatctaccaggagtggcaatcaccacatcaggattcgacatcatagcaccaaactggtcttccattgaatcaccaccgatcagcaacattgctctcaagttggtacctctactgaactctttgaactgtctaaaggtttgcacagccaattcacgtgaaggcgaaagaatgatagccctaataccaaccttagcagaatggactttcagtttctcaactaaaggtagtaggaaagcagctgttttacccgatcctgttctagccataccaacaacatccctgttggacataattaaaggcatcgtttttctttgaataggagtaggttgtctgtaaccctttcttgcaatattccctaaaaggaatttagatagaccgaacgaggcaaatgaacctgctttggctttcttcccttttaggtccgttggattactctgtagaaaatactctgaaatgtcattattgttgtctttttggcttctaccttcatcatctgattgttccaaactaggaaaatccgccacattaggtcttttctttaccggcttctgaaccttattcgttttgtcattgttcccttcagtggcttcatcgtctgaagaaacaatctcgtcttgaagctctccgtcagagttttcggaatccgaagcggaagagtcactgtcagaatccactacgatatttcctgcaatgtcagcatcttcttcttcgtctatgaggtcgaattctcttttcatttcttcgaagtctaagggcaagaaagaaaaggagaaatgttaaggcaaaaaaatattctagtgaaaaaaaaaaaatattcgagagctggatgttagatgctcagatgttcatctcatcaaaaccattattaccataccagtggaatcatgatgaaagggccgactatagacctcttttccatatagaattttctagtctcgcatgctgatgctcccaagttaacaatgacccatagtataataagaaaactcgtggaatcctgtaaaatcacgtattccgctagatatattaaaatctcatcgaagtaatgggcacatacgacgtatctgaataacccgaagcttggagcggtgtactttttcaagtttgccaagtgacaatggttgaaaaactggtctatagtacccattatgaatagggaggaggccaggaacagactccactgaggaacaacagtttcagaatcaccaggaacattggtaaaaatatggggaacaataacctgcagattagcaattgtatagaacacaattccagccaaatagtgtgacaaatgaatctttgaatactctgcaaacttgcttacatatgcacactcgtatattcttcttagtgactggagaaaattgaatataagtataattgatgacctggagctattcactccaacaaggagcagtccaataagtgcccacgtaaaatctagaatgtaaaaatgcaagaaccaactttttggtacgtataaccatttccatttagttacagaaccgacatccaacgtcttaccatatttcagcaagccgttcagttcagggataaacttagcagaaattacactgataatgccaatcagtaatgccacactgaataagctggcgtaataatcagccagcactaagacgaccttagatgagaaactcatttcagattgagttgtgatttttcgtattgggtgaagttgaatctgagtttttattgtactatttcgcttatctaatcaggaagcaggagaaagagatacatatacataaaatgaactactatactaacgactgtaggggtggaatcctcctcctcctgcaccgcctcttcttccacggcctcctccacgtcttccaccacggtcagaacgaggtccacgtggtgggggacgatttgaatgtttaggacctgaagggaattgaggtctctcctgttgcggattaggaacctggtcatcatcacgaggctggtctgaataagactcggaatcaccttcaccttctgcagcatcgctaccttgctgttgctgttgctgctgttgcatttgttgcatttgcatccaatactgttgcatctgttgataatactgttgcatcatctcctgagacataccattgtaatatgcctgctgtccaggcgctcccattccgggcattccaggcattcctcccatggctcccatagggttatacggatttgcattagtacgttggttttgttgctggtttctcggctcagctcttttaatttccatggaacgtcccttcagaggaacatacttattagcacagactcgatcaactgcgtctggggagtcataagtaacaaatccaaatccacgggatcttccagtatccttgtcgatcattaattgtgcgtcaataatagtaccgaactgggagaaatagtcagtgaagtcttcctctgttacctcagcagcaatacctcctacaaagatcttaccagttttatcctgctcttctcttggaatcgctctcttagggtcaataagttttccatccagtacatgctgctttttcaagacttcatccacggatgctgtcttagtaaaggtcaagaatccgaaacctcgagacctaccagtggcattgtcacgcatgatggttaaatccgtgatatcaccaaactgaccaaagtagttccgcaaggtttcttcggtggtctcccagttgagacctcctatgaacattttaccttgttcactcttgtaaatgtcagccttgacagagtctggggcgggctttgctggagggaaaggaactgcaggctgttggaactgctgctgttgtggctgttgttggtgctgttggtgctgttggtgctgctgttgctgtccatacgggggataggctggtgcgctattgtacgaaggtgtcgagttgcttataggaggaggggggagtggagtatcatcagattgactagtggatgtgttagataacacaggggcagagggcccctttgacgaagcttcagtagccgaagaatctggcttcttttggtcgtcatctttcagaggctggctggccccgtctgatgtagacttcgtctcgtccttagtttctttctctaccacttcctgagcatctttctgttgtggctcatcaccgtagatgtcatcaaataaagcttcatcatcttctaaggacattttgggtgtgtagggtttattaaactaaacttctattcacactataacaactatggctacaaaattcggcacgctttgttgtaattagggagagtaaggaatgcggcaatggagtgcttttatagtcggaaaatatgctctgttacccggtgcgatgctggtgtaacgatgtgaaaataatattttgcctattatttctccatacaacttgaaacatcttcaagtgtccctacaatggcaaaatggtacctggtctacttagctcagtctcacccaggatttcggaaggctgaacttgaatctatagcggacttgttggacattgaagccagttttgagtcacatgacatggatcatccattcatgactgtgctcttggaagatgacgagcaggctatgaaactggcccagagaagtatatttgtcagaggcgtttacgaattatggggcgaaggatctgacttagatagtctgcatgctgatgtaaagtccaaaagttctcactactggccagactatatgacatgttctttcaaatttgaccttgttggatatcaaggaaagaggaatagaaaggatcaagtccaactatttgaatcatttgcatacttggcctttgaaggtccaattaaaatgaaacagcctgatcaaattttcactatattggaagagtatcatgtggttggtagggagcctgcagctactccagatagaatgtggttgggaaggcaagtagcccttggccaacgagaattcaaacttctagagaattatcatttgaagaatcgctcttacacttcgaccacatcgtttgaagctgagctgtccctgattacttgtaatatcgcccaggcggcaccaggtaagctcttatacgacccttttacgggtacgggatctttcttagtggcagcagcatacttcggagccctttgctttggatctgatatcgacatccgtgttctcagaggtaaagacagtaaaagcatcaagacaaattttaaacaatatggtaagggctaccttttaggggacgtattgacaatggattttactcatgatgccttcagaaaatctcttcgtatggacacaattgtatgtgatcctccctatggaatcagagaaggagttaaggtctgtggagccaaaaatgaagacagattcgttggcaaagaatccgtcctggtggatggtcaactggcccacaccagacgagattatattcaacctaagaaaccttatgaattggacgctttactggatgatcttctacaatttgcatctgaaagattgccggtaggcggacggctgtgcttttggatgcccacagagaatgacgctcaacaagaatcccgcatccctcagcaccacaacttagaattacgttacaacttagtgcaaagctttgacaaatgggcccgtcgcctactgtgttacgtcaagagggatgatgattatgtagggactacattgaccaaagaccaaagaacagtgaagaacaacttcagagtccgatacttccaaggattcaacaaacaaccttcaacctaatagtactagtgtatattactcctatagacatatcaaccgcctattcatcgtcctcctcttgcaaagtatgagcagcaatacggtccaaatctctttgtccgttaggagtgattcttctacctccctttggagacaattcaacaactccgagcttctcaagagcttgaagagcctttctgttgacggaaccagaagcatcggtgtgtcttccagatctgcatccacggttcttggcaccaccatacttacggttcaagtttccaacaccaatgttttgtttcaggtaaatttgtctggcggcggaagcggctctcttgtagaaccaagtctcggcttcctgtggaggcaactcgttgtgggacgaggtcttgacaatgtcaacgtaaccaggaacatctagtttaccttgtctttgcaagaactgggcgtaggcgttaatgaagtcctgagctgggacgtctctaaaagatgttaataaactgtctacaaacatgcagaataaaagcactccaatggcaaaccgagcgtggtaaacaaaactaaccaaacaagctgatttgagtttttcatccagtttaagagagtttccagttgacttcaagatggagctctgaaggttgataaaatggtcatacacaggcttgtttcacttcctttgagggttttcattattctgttcaaacaacgctgagtcgttcattggctttttatattcttttaatggtacatacctgactgagtaacctggcatcttgtgtgtgtatctagacaaagaattcaaaaatttccagtttactttttctggagtgggtaccagaatctgtcgcgggctgacagtgggaagggacttgtctaaatggtgtttgggctcagtttgtaagttacgcgcggacctatttggaagtagcagtcacatcggtaaagaggtaccagcaaagtgcaagttctaaaccaactatggaccaaaacgagagaggggccttctttaggccttcagattgtatgtatctccatagagatgaaatctgtgtggttctgtagaaaagatggttcttctgtattacataaagtgaaaaactatcatccaacatctgacatctgacatctggtttaaatcatttaaggtaacatctacgaaccactgtaaatcccgacaacaacctacaagggttagtggtcactatcttcttcgacaaatgtcattattaatataaactatacaagtgaaactcgcttgtctacatttataccttgaaggctcttgattgccttctacctctagctttctcaaactttcttccggtggacaaaattcttggggccttcttctgatgaggaccgaaaccaaagtgtctgcaggcctctctggcggttctagaaccagccaaaagcaaggtgttctcaccttgaggagccttcaaagccaattggtctagggtcaaaatttcaccaccagccttcaagatcttagctctggcagtagcagtgactctcaaagcagcaatagtggcttgtgggaactccaacaaagtgatgtcatcggtgacggtaccgacaacgacaacgatctttccggcgttctcctccttcttgagagcttgggagatcttaccaacagaaacaggaggtctgttgatcttggagaagttcagagctcttctaaccttcttgttgaactcagcgtcagtacgacctagattggtgttagtatatcactcgttctttccactagggaaaaagagaagataactcttttgttctgctgtaaagtcgcatcttttgtaaacaaaagtactcgcagaactggtgattatgaaccacataatcacctacatcgatattagaaccacttttgtgatcgtttgcaaactttatgacagaaacaaaaaataataaattcccaactttagtgatacttacgagcaaggtagctgtacaactcaaccagggacttcaagtaggtgttctcagactttggagccttacggtgggaggttttaacgtgctgcttggatgtgtgaactttacccattttgaacgtgtatgattgtgttggatgacaaggattgaaaaaaaaatttcgacattcacccacttccgcgaatgttggagactgaagggttgtaaccctgagatcgtgtccttccacgaccgtcctggggaaagactagcagcttatctaagcgatgagcctactctcaagatgttcacgtgaatctggccggattacagtgaagccgagggcatccatgagtttcgctaggtgaaaccttccagtatccacgaccaactcttgagaataggattccatacaaactaatcattatggacagactcaagtaagtatcattgcgtcttgaaacgctggtatccgtttcataagtactttgctaacaagcttctttccttatagaaccgaacagtcgaatcctcgtggtattcctcaggccaagttcatagatcgtgtggaatctttattaaacccgtccacatgcactaatgaggatgtggaccagctgcttaaagaatgccagacacgtcttcagcagtacaagtttatggaagagaacaaacgcctagcactgaacggaaacaagtccaagattcccaacattacaaaaactctggaaatggttcaatatttaaaggagcgtaaagaagaggacgatgacgagcccttgcagactaactacgaattgaatgaaaccctgtatagcaaagccgaaattgatgttcagaatttggataacgtctatttgtggttaggagcagatgttatgatggagtacccactagatgaagccattgaactcctgactaccagactagctgtggcaaaagaagctgtgacagttgctgaagaagacctggagtttttgagagaacaaatcactaccatggaagttaatacagcccgtgtctacaattgggatataacgaggaggaaggggctagcacccaagtgaacagaaaaagaaagaaacatacggctttgaaaagctcaatcgaccatgaattattatgcccggaaggtatttaagatctgtgttcctaagggtctcactggtgtttcagcacgaccaggctcgtcactatcgtcgttgtggtcatgcagatcctcatgttcatcatcatcatcctcttcattgtttgaacctgccagcagtctgttaacttcctctgttgaccgtgttggttcacttttgagttttggtatcgatagtctcaagcataacccctttccgggcagtatatctctatgtagtagtattccaatcaaataccctgtagcacagggaataatgttgaatattgccaattgtaggatgagaaccttgatgaagaactggtctgttaggacgatcttcgaattaggcctagattcgttaactttcagattaagctggaatttgtatgccgagggtgtagattgaaaataaaaataaatcaacgatgtgatgattccaaatggaccggcagacacataaatgtccaatcccagcaaatgataagctacctccatcaatattgtggtagcaaccatgttgtagaagtaggatgcaactacaaccccgagaaacttattggagccataaattctttccagatgcttgatggcaaaatgaatcaatgcaacaccaatcatgacctctgattcgttctgaaagctcaattggtagatcaatatcctccagtattgtctccactgactgataaaggggtcgtagctaaggataaacacatacttgaggtcaaaaagtgatgcaaaaattgggagcaatatcagcaacactgtgaacgccttacatcgtggaacctggtggaatcctttgggtatcagggaagacattaaccagtgttttcttatctatttgtctttttacactaaagtgaagtacgaatccatgcgattgattcctcctcagatatcagctgaattcttgcttatgtaatacttgcgcgaactacatgtgaacttaggattcgataaggctggggggtcaaccaaccccacttcaaagagccgacccgtataaatagcctctgcgtcctcagatcaacaagacgaagcaattttttttacctatcttcaggtgcctgttaatgtatagattgggatctcagggaaggtcgatacaaagccagcttcagaatggcgactcaagttcgggacgaccactacagttgcaaggaactgggatgagagaagctcagaggattcctcagcagttggattatcttttggcggagattatctctcctaatgaagacaccaatgttattggatatctagcttattactatccgaaactgaagaatgaacagaacgtggcacttttgactgatttttttcttagatgcccaacctactttagtcattcaaatgtagtatctctgagaaacaattacccagtgatggaagccttcaattacattatgactacaaagttcaaagtctcccaaccaacggttcccttctatagattctatgctgctgtgctggcaagtctactgaactgcgaaaagaccgatccatcgcaccattggaagctgattccaatactaactggagtccttctcagcatcaaaggaagagatgacgttgagctatatcccgatcatagcaggtctatcaagggaagtgacactgcagtggcccaactgttacagagatgtttattaagattctaccaatccggtgatgcaagaagttatgatttgaatgccctcgtcataatatccatgagctgtgccttggattacgttgaagatgataccatcaagaaaatactgtattgtttcaattatacaagagctatcattgatcttatttattattctccttatggtctcaatgatagtgacataccgctattgtcggactcttccgttaactcacagtctttcgaccagctacttaacaacaaccccgcgctgaaacatctgaaccgattatcgttcctttttgaaaggactgtaaagttgaacgatggtagtattcaatcaaatcttaatgatattgatatttccttgaacaagatgcaaagcttcagcgagaaactttcaaagaaaatttccgttctagatgatgatagtagcaaaggggttggccagcttctcagacagtgtttatatgcttcaatcatcattcatcaagctatcctgacgacgtttttccagttggataatgcagactatacaaagtattttttgccgtcattttccagaaagattctttccattttatttaacttattcttcattgtggacagaattggaacgggtggattccagccctacaactttgtgtatttaacatgcttgcaagggataattcagtacgacatgaaaactgccgaatcacttgtgaagacatttaccactggcattaactactcatctttgaaagattctgaggttgcaagggctaaacttttgttcactctcaatttgatggaacagattgtgaatatttgcagcgatgatctaagattggaactaatcgtaccgttggtagaagatttggtgaacaacaaaaatgcatgtgttgatattcataatcatgtgttcaagagtatatttgaatctgctcattcagttatccttaagttttttactgtggtggactcttccgtaaagaatgttgactatgagacaaatgttacattagtatcagaaaagatcatcccttatttgacgcttgtcattgatcagtttccggaatttttatcaattaatcagctggatattgcaattgagactattagtcgtaccgtatttccagacagtcccatctacagttacgacaagaacatctcatctatgtttttgaacgtcttgtttaacaaatgtttaaccgttgacaacgatgagttagttgagttgcccgcaatcgaggcagtagttgcacctaagaacgacgaagaaaataatacgtctgacgcgcaagatggcggacctaaagaacttcagtcattgaatgatttaaaatccagaagatcggcattgatttctgctttaatctcagttttccctcttattcccgtgaaggactacactaaatggttgtcaattgctttctacgacttgattgtagctaccccagaaagaacggaacgtgcatttttgcaagaacgattgtgggactgcgttgttggaaccaacaaatatgaccctcaaaagggaaatttaggtataatgtggtggtatgagaatgtaaacgcccaatcaaccgcaaagttataagatttctgttggatacattgtgattagcccaaactccactgattccattactatatagttgtgtattttattattcgaggtgatgagatagagaaatcatcgcaagcgaaataaaaataaatttgaaaaaccctaattctttaaacgattctcatctataaaaccaacggccaaatcaaccatcaaatgtcagccctaaggtctattcatagctcgtttattaggctgaatatagaattgaatgtgggggttgaaggctttaacgagcaaactgaggccatctccttaataagcaaaggtcaatatcttaaagtcctgaatttgcctcttttcaaaaagatcttcactgataattccgaaatcaagcatataattgcaaagtatacccagcaatcatcggcatcggcactagtggttttggatttagtcaatcatatcattatgcaactatccaagaatctggagtcgttgagtccagaagtagtcaaaactactgtactgattttaggtgtgatctttttacaactatttctgcaagaaaacttcactggtccttcaataccttttgagaatgaaaaattaccgctggggatattaagagacttgctgaaattgaataaagaagcctctacgcatatattgtctgttggaggtgagacagcttatgaactcatggagtctcctattctactggttctttcagtgaaaatattagaagaagtgtcaggttctagtgtcagtgttctgtccaaagatttcattgatatggatagtgaaacgtttatttccaaatgtaatatcgttaccaatcccgatgttgtgcaatcctcgatacaatggtggaagtcaagagcttatatggtgtttgcatcggttctcactggagaagtatccctgttgaccttactgcccatcaaactgcttacaccaaacattgtttcaacattgatagatttacaaaataagaactcaccagaaaaccaggagattctggttctatatcaactggagtctgcatctgtaaatttttcagctggtgtcgacaattcggttaaggatgcgctggcaaaggcaaaaaccgcttctggattacagctgattctcactggctgtaaggcaaaaagaacgaagttccaacaaaccggaaaccatgctctgctagttcttgctaagagtcaagatgagttcttaagatcaactagtagcgatgaactttcttgtgaaagtcctgaggaattgcaacttaatgacgaggtcttgttagaaaggccttactacgagccattggaggaagagaatacactagaatcagaagaaaaagactctaaaagagtaaagatagatttttcttttgagccaattcttgggtccgaagaagattcagaggttaaactgttacctattgcattgaaagatgatgaaattcctccagtactgaagagtttggaccccaataatcaaccacaactagcatcactggatatggcacagcttttaatgagactaatcttcatcagagaaaatacaccctctaacagcgccatggttgaatctgaattgatggccttagttcagagaatcacgaactctaaaaatgtgaactggacaatattttcgaagagtttgtgggaaagatctttgctggaagctagtaaatcaaagactattgaaagaggcgtactgcaaatgcaggtactggttgaagatcttggaatgaatagtgtcaagaccagaatgttcagtcaatcgggagacgaacagaaatttcttaaagctctgattgatccagatgactttcaagttactcccaatgctgcgagattgaaatacatttttcagctgccgttgactccaaggtgggccctagactcacttttggctgaaaagttgatgtcaattggagtaattaagtcggctttacagatatatgaaaggctgaatctttcggtggatgctgctttgtgctatgctttaacaggtgatgaagctcaggctgaaaaaattcttgtagagcgtatagctgcccatccatccgatgcccgtgcactttcggtgttaggagatgtgaaacaatctcctgagctctggttaaagagttgggaggttggaaagtattctaaagccaaagtttctcttggaaaatactattatcaacctcctaaggattccggtttaacaaaggatttgccagctgctattggccacatttttgacgcattgacccgtaatccagttgattttgaaacttggtttttctatggttgcatgggaattgaagcatctaactggaacctcgctgctgaggcattcacaagatgtgtatccatagacaattcaagccctcaatcatggtcaaatcttgcttctgcgttaatcaaacttggtaagaataaagaagctttcagtgcattgaagagtgcaatccgaactagccaagacaagaaggtttcttcaaaaatctgggacaatttcttgatcgtggccgccaaattgagcgattggacttctgtcttactagcctcaagggaacttttaaccttgagaagcaattcgaaatccagtgaagaaattgtggatctccccgtagttgaaaagttggttcaagtactactggaatcaccctatccaggttcagaggattctatggattactttcaaaaatcgtgcgttgacttcatatgtactatgttgccacaagttatcaacaactctgacagatcttggagaattgtttctagagttgaactttggagaaagagaccttggatggcacttgagtgcaatgaaaaggcatacagggctgcggtgaacaatcctgaacttgagttcaatgaaactgcgtggaagactgctgttgatgcgtgtgctgacttggtagctgcttttgaatcattgggagagttacctggcaaacatggagccgacgatcttgtttgtaaagattggaagtataaagctaaaatgacagttcggtccctcatgtcaaagggaaaatctgcctgggaagattcagaaggctggaatgtgctacaagagctaaaaaacagtctaatgagttaaaatatagtctacacatcagttaatcttttgctgctgaactttcttctttaaaatggttctctttgaatggtggatctatattgacactaaggattcttatgggagttttttcttccagcactaccagatgattgataattgctaggacattattccagtaaagacggcataaaactggtattccatccagagagaagaacaaatcaatataatgaatccagccatataaagctcttctactcgcttctgaagtttccaaccttaatacaaagatgaacaagtgtaatgcaacagcgtacaaatgagatttgattttggactctttcaaaagtacccaaaataacagcatatccatatgagccgcaaatacgagtaaaggtgtttccatgtataccaccaggggcataaaggccgctgcaaatgaatagtcgcaaaatacctccgtacagaaaaagtagcacaagtttaataatgaataaacaccaaacggcaacagctttagtacattttcatttgtaaagaagtaaagtgcacctagacataataaaagtccattctcagacctcaaaagttccggcagggtcatcgatgattgtttttgactagagtcaagttcggcagaaatcccttcttggcttcttagatcttctgtgttctttgattcgtcactaacactgggaaatattctgcggtagacaactagagagtacgttaacatcgatcccaacaggcacattttatataagaaatagttagggatgaaaacgagaacagtcgtcaggttggcaaacagcaaaagcgaaaccccgccaagggttaccaaatgagagataatccagaatagatctagtgtgacctggatgttgacggttagaaatagttagaaaagaaaagaaaattcggacttactctgctgaaaatatagttgaacggcttactccaggaagctgtactgatggtgaacgagcgtttgaaattgcaactttgatagaaaaaagggttcattttaaagtaaagccaaatttagcaagatggtgtatttgattacggaacaaatgagtttgaggttagataatcagtagtgaatctcgtcatcacaaaaggatggacaggtgtgcggctcatctgcggctcaccatccaagatagtttagacgtccctgtcaacaaaactttgaatcaggccgatttcattctcagcgtattccttaacaacagcagtgtcatcttcgagtaacgtgttaccttggatatactgctttcttggtaaacgcttggctaagatagtgtccctaaactgtgcgatttcttcggtcactgttgtgatagagttgtatagtttagtcaaaccattgacatcagcagaacacttcagaatgtgaagctgttgtaaaaagtttccaattgctttctgtccaacggtggatatctttgactcatctaactctatacgcaaatccgaaaagtctcctcctttggtgtacttgagagtgacaaagtcctcaccagcatctaggaacgttctcagaatagcatatcttgcctgcatatgaggttgaccccatttccttgtcttgggatcccattgctccaaagcaaccagaccggcgcgagccatttgtaagaagctgatgtggatgatattatcctgttcttctttggttgaatagccaaaaatctccaaaagctcacggttagtaaccaaaaacatggctacagattcggccctacattcttcagctgaaccagcaatagatccaaatactgatccccaagtctcccccttcttgtaaaaagttgaaacaggttttccatccaggccaattggaggactattgatatcaaagttgtacgaattatcaccagtttcctgtagaagtttacctgtcccatggcctagaagctcatgaataccgacttgaacttcaaatgattcacttcgatatttgttgaaaacatcaaccaatgattcatcaatgaaggtaactggttcgctggcagatctagctgacaaaatgttacccaaggaaacgttcttaaaaccaatgttaatcctaacgtcatcataattgggaatattaattcctgcaggaattccagatccggcaaaagtgagtacctccaaggaggtgaagtcaggaggagtaaagacatctttctcaaaggctttgggccaaggcagcagctggatgaagtgtttggcactactgacaagcttttgaaatttttcggttctttctttattcaccattgcaacaagaccctcccattcacctctgacaccgcttggatctctgtacgtttcaatgaaaccaatgttggtctcgacagatggaccaatgtctcttacccattcaatttgagaatctttgtgagcgttcatagaaccagtggtgaaagactggatatagtgctctaacaacttcacttgagtttcattggcggcatactttttagcttcgacaaggttgctgacaatttgagagaattctgcagcatggtctccaaatttgaaagtgattgtatatgactttccatcagcatctttgtaatcaattgaatctggatagtaacctgtgttgttagaaatatcagcacttgcaacatgaaccctgtattctgagtcagacaacttttcaacacgtgtattctcaggcataatccccttagaagcaagtgctgcgttaacaacttcagcctctacctttgagactttgttcaagtagtaagaactgacatgaccatcagtattccatccaagaagtatgttcttctcatctaatgagtataagtcatcctttacaagttcaaacaattgaagaacagtctcactattggtccattcgactagggtctcaaaatcaggtctgggcaatcttggaataaacttgacatcgccaaaagatttataatttcctaagttcgacaaaaactgcgaagcaaattccagatattgctgtactgccacttcccccaaatgcttagttaagtcgctgtagtcactattgacatgtttatgaatactgatgattaagtcatatattacttcagattctggagaaactgatctaagaacaaccctagttccccaatgggaagccctggacatgtaatgggcgtactttctttcctgagaggtcaattcattgaaatgggatttggccgacaaagatactataggggccttggcatcagcgtagtaattctcaatcttgatggagctcattctgatatgattacgtataagcgttgagccaattgcagatctgtagtgttgtaaacgggagagcataggataggagcggcggagagcttttatataatttttggaattttgtatggggaacgaaaaggaagcaatcttgagtcgaaatcaatttggtgagtttcaactttgaacaaaagggccagaggacacgagaaggccaaatgaggcaatctggttttcattgttagccaattcagatttgggctggcattacacagcactgtctagccgttagaccataaattgttggagcatgaacttacataagcaagtgttttgttgtccttgtagaagtctgaatgacactaatagcgactcccaacagaccaatggacattcacaaaacaattcaatctcattttagcttttcattaggcatgagacgtaactcaacgcaatgctttcgttgaactgggcactggtccttcacttaaccacacattattttgtgatgacataatcagacgcgattactgtgaaaaaaggtaccctatcagcactaccttgtgattagaatattggttacccaattcatatggcatacgctttaagggatgcattggtgacgcctaaatctaaaggctatgatatcactaactatagtgagtcaccgcttgttctttcagctgcattgctgaagcatcccttagatataactgcggatttactgcttgaacaatctttggtgtcaacacctcttttgactttgtttggtctggtagttcacagaacgacaggtttactgttatatttggcacaaaataacacgtcctttgccattcgaaacgacaaattttctttgatagatatctttgaaagaagccccgtcgatagatcccagattagttatatctccaactacaatccgcataaagactctcttaaagatgatgattctttgagctttgagcatttggctggcgagctccagtttatctctaaagtattaaggaaagaaattccacgagaggttcaattcctcaatgacttaagaattaatgatggtactgacgaagataggtttggatccatccaacacttcagagacccaattccattcttacctatttatctcgggatcaatgaattttttggaaaactgatcacgcctgtatgttactcagatccagactataccacgattttaaaggagaatcaggacagattggttttctatcaaaagctctatagcacttttggcgaggctagaataattgtaaatgtgaaaggacctgatgataccgtggcatcaccctcagaattatacgatttagtaagggattctaatagtaattcgtcggtcagtatacctgagaggatggtccagaagtgggaaagtaaaatactgtccggtcttgcaagtagtgggtcctcagattcgtctatccatgatgctgattctatgaaagatggtgaatatgaagttgatgaagtagtacagctacctcgagtagattcagaaaccccggcacaaacacctgaagttcagcaaaggacacaagctcctgaactagcgccaacgcagaagcaagttgtagaaactcaagtctcagtgaattcaaatgggaaaaaaatagacgattctgatcaggaggcgggttctgcaagccggattgcaacccaaagagtacctgaagtaaacgtggactcacaaaatcctaacaacaaagcttttgatgaatcacctaatgaaagtgattcgcaggaggaggtggacacttttcaattttttggacccaacccagtttcagagtctaatctgaccaacgaaaacgaagattcgaatgtagattcaaacgatgactcaaatgaaggtgctgacgacgagcaaaaggtaagggtcaaagaggaacctaatcagaaaccatcacagtcgggctccgatagtctgcccactgttaatatttccctgagccaattatatggagcatcagagaacctacaacagttgcctgttactgtaggatgggaacctgatcttattcaagtggattcctcttctgattctgaatcgttcgagtcaatcgaaggtacttccagcaacagcaataactccaaaggacttgaaaaagttccatcaattgcggcgaatggcaaagctacgtccacttccagccccaaggcgcaagaggctagcagttctgttgagcaaacaatttctgatcctatacaggatacatctaactccactaacatcacaaaccatgactcacaacattcttcacagtcacccaagagccaatcaaaaacaaaaccttctcgattgaaagctttgctaggccatgtatttcctagtctaaaaacttcagaggatcagcttgaatctacccaggtggcccaagaaagtacagctgcaaccaatggtgagggtaacaaaccgcctctagatcaaaatgaagttgttttgactccagagactgattatatcgaatctctgagttccaaaaacgataactcggctggaaacgtttcatctggatctaaaccaaaagacaattcttttctggattcttcgactcaaaatgcagatttgcagccttatccaagtactgagccaataatagtgtcatcagacagaaatgattctgtccacagttctgcaacagctaacgaacatcaaacaatatcacattctcatattcatttgcaaactcaaacagactcacttgtaattatcgaaagatcacagccatttaaatataatgaagaatcccttcaacgaaagaaaagggctcaccagctactagatgcgggatggcagcgggccagcaagaagaaattatagtaatggtccatgcgcagtgaattttgacagatgcaactttttgtatctgattcaactcctctagaattacaatagcaaaaaatattgaattgcggacaagtacgttgatgagaaaggagatatacacagttttcagtacttggaggctgtcacctcaggtcatatcaagcatctatttacctgaactctgacatacgattagatgacaaaccccttaatgaactaatcatgtcaaattttttgcaatcgttgctttgatctctgtacccgtcgcctacaacattatttatcactttgttacctaataagtgaattaaaattgtaaacaattatgtaaccatattatacattttagacgctctctaagataagttaactggaggtagcatagacttgagcttaactcaatcagctttcaaatcatgatatatcgccttatcgaaaattgagaaccaagggctgatgattttttctagtactgcaaaaccccatttaactttcatcctccaatgcgtagttttactggcgctcttgagataactttattgccctttatgtatataaaagctccgccaaaccaattgtttgatctaattctttcatataagcatcactttcgtcatcagcggtgacataatcaacatatgtaaatttcactttgttttcctatttttgattgtaaactctaaatatttccccaaatcggtcatattcaggcatgtcaactgttgccataagggagtcatcatttgtatttctcatttcaaggtcacttatgtgcactccaatgaactcaaggccatcatccatcttttccttcttgcagaatgctaaacgtttagacttaaagtacgctacatcatccttcaacacgaactatacccacgataaggagcttcgcaattacaaagatagagcttgatttcctgttcgtcatcagcacgaacaaacgttaattgatcatagggattgctgtcaatatagccgctataaaattcgtctctctcaggaatatctagattcaccagacacactagacataacatctttagagaaagttggcccctttgagttggactattattgtaagcagaaatatgtaagtcttcacgtgacttggatgagattaaattttttattctttcttagacttaatttttctatcagatagataacataaactttccatcgatggttcttaaatcaacatccgctggaaacgtttccgtataccaggtttccggaagcaacgtgtctaggtctttacccgactggattgctaaaaagaggaagagaacgttgaagaatgacatagattatcagaacaggatagaactcttgcaagattttgagtttagtgaagcgtcaaacaagatcaaagtgacccccgacgggcaatatgccattgccaccgggacatacaagcctcaaattcacgtttatgagttcagcaatttgtctctgaagtttgacagacatacagattgcgagaacgtggatttcttggttttatcccacgattggtctaagtctgtacatctgcaaaatgatagatctatcgagtttcatacgaagggaggtatttactacaaatcccgggtgcccacttttggaagatgtcttacttataacgagcaaaactgtgacctgtacattggagcagcaggaaatgaagtttacagattgaacttggagcaaggaaggttcatgcaaccttttgaattagacacttcatccggtgttaactccactgatcttaacaaggtgcatggactattctctgctggattagaagatggaacagtagagttttgggatccaagagcaaagcagagagtagctaaactactgataaacgatgacttaaatgaaaacgtcaatgttggtatcaccagtgttaaattcagaaatgatggtcttaattttgcttgtggaactagcaatggatactctttgatttatgatcttcgtaacagcaaaccttctgtggtcaaggatcagggttacggctacgaagtcaagaagattatatggattgatgagaactctactgattcaaacaagatccttactacagacaagagaattgctaaaatttgggatcgatttgatggaaaagcgtatacatctatggagcctagcgttgatattaatgatgtggattacattccaaattcgggaatgttcttcatggctaatgagggtcaaccaatgcacacatattatattcccaatttgggtcctgcaccaaaatggtgttctttcctggacagtgtgacagaggaattggaggagaagccttccgactctgtgtatgccaactatagattcatcacgaaacaggacgttcaaagtttgaacttaagtcatctagttggaacaaatgttttaaggtcttatatgcatggtttttttattgacactgagttgtatgataaggtcaacctgatttctaaccctaacagttatagagaggagagagaacgtgaaatcaagaagagaattgagaaggaaagagaatctagaatcagaaccactggtgctgttaagaaaaccaaaatcacagtcaataaagagctggtcgaaaaactggaacagaagcaaggatcatctgttgctgaagaacttgtcaacgatgaacgtttcaaggaaatgtttgagaaccctgagttccagattgaccaaaatgcacacgattataaacaattgaacccatctgtcaaggtcaaggatgtggagtacaaacctaagggactgacagctgctgaggaatcagacgaagaacgtatcgaaatgaaccaaaacaaaactggatctgctaacttatgggattctgatgatgagaaatctgatgaagaagctgaagaagatgacgaagagagtgctaagaaaaaggcagaagaggaaaagttaaaggaagcaaggagaaaacaagctgagaaggttcaaaagcaattggagaagaaccgtagaaagcaacaacgtgaaaaggaaattgaagaggctatgtccactatgaaaccattggattccaaagatgaatctatttacacagccaacttagacaagtctcgtgtttctttcaagaaacaattagatgatctcaataaggtctctaaacccaaaagttctagtcgtattcataagaacatcagaggagaagccgagcttactttcattcctaagaagggaggttcacaaaagaaggtatcgtttgaagacgacgctagcgatgatgagaacaaaaaagacaatggtagaactaaacagagatttgacggccgcagaagggccagtaagaatgctttccgtggtatgtaaaattagttagtattaaattttcagtcttttagaattcgaaggtgatggcgacctgtgtcctaattcgatctcttggggtgtagtttgaagaattatcctcatctcttcagtgaggactcctaaccctatggatgtgaagaaattaatagaaaatctcaagtgctcctggtcactagtggggaaaatgcctctaatatagggttgaatgtaatcctcgtgcaacctttcttgaaccttcttgacacccaattcgccaaccaactcctggaagagaaatttcaggaagactctgctaaagggagtagtttcactttctgttagagtaacaatttcccaaatttcccatcccaatcgatcactcgcaaacagatgaccccaaaatttacctacatttctaatatgctttagttctaattctgaaagtgtgtggtaagagtttttaaatgcctctttgaaagatttatgccaaatattactgtatgaacaaagcttctcacctacaagaccataaaacttggagtaggttttctcttgagcacaccctttgactatgatgtttattaattgtagttctggggatttgtcgctgacagctggtaacttgagtaatttgtgaaccgcttcatcagcactcatacttgacatcattgtaagatacacgttcttctgaaattcaacgagatttgctgcagtaaggtcggttaattgatttttaatggtgttttgatcctttcgttcttcatcttgttcttgtttttgctctacttcttcttgttcctctccctcttcctcttcctcttcttcatcactgtcagatgaactatcaacctcgtcttcatcatcatcacccaagatttgtagttttatcaagttgtatttttcatccaactcatcgtagttacgttcatagtgaaagacattcaaattcaattcttcatcacatttgtcatccagcccaatggtgtgagttatctggtcttcatcctctactaaatctaattcctttagaattccagaatgcccttcaaatttgttccttctcaatttcaataatatctctattttatattgtgtctttttgcttactagcccctcttgcaagacatttcttatcctttcaaaaatagagtaagtagcagaaacagcgttctcttccaggtaagcaccaacttcagtcattagtgtgcatgcaatatccagagagtcgtccgtcgggttttctagcagaaggaacatcagctgtagtgcaatgatttcatgagcaacattctgaacgaccaagtgggcaataaatgtaacagcagcaaaacatttcgccttctcgttattcagaaaggaattttgaaattgaactatcaatctttctatcaagagtttgccaatctctgggattttggagtttagtaccgctatcaaactgctatagacattggtaaaagctggcgccgctgtctgtgactttaagacactcttgacaaggactccacggcctctcagcaaattcagctgaaatagttctattattattcccttaatattgtgtatgctgaccctgttgatggccccattaatggaccttacaagtttatcccattgaaccagctgatactcttcagacgttgagtctgcgctcaaattcttcagtagttcccgtttcctagcaggggttatatacttcccactgttcagaatctccgatacttggttgtgccgttcttttgacgtcattaagactaacaatcgaaaatatagttggaatactggagtttaatttgatacttgatgtcggatgtttcatcaattcgagaaatatctagtctaactaaaatatcaaaaaggagcacttcatcgattactttaactaccttcggacataatggacccaaacaacctcaaagtccaggtagaagtggatcctactgaggatactgagtggaatgatattttgagatctcatggaatcataccagaaaaagagccagacccaacggaggaattggagaaagcgctgtccgaagctgtggagaaacagcacgctaatagactagaacacaaagatttagatgaattagctgcactggaagacgaagaagacgaggagtttctggaggaatacaaaaagaaaagaatggcagaaatacaaaagttgaacgataagtctttgttcggttcagtatatcctatatctaaaccggaatatcaaaaggaagtcactgaaacctcaaaaacagcgtttgtattccttcacatgacacttcaaagtgccctacaatctcgtttgttgtcagcattaatggtcactttgtcatctaaatttaaagaaatcaaattctgcgaaatccctgccaacagagctgttgaaaattatccagacggtaactgtccaacaattttgatttatcataacggggatgtggtcaagcaattcataacgctaacgcagttgggaggaaatgatacaaaggttgaagacttggaaaggattttggtttctattggagctgtggatgaacatgatagacgattactgataaataatgaagacgaagaaagctctgaaaatagaaaaatcagatttcagggcaaatcaatcaaatctaaagcatacgatagcgaagaagatgatgatttctatgattaataaacttgaaatgagaagaagtaatgaacggtttggtgtgcctatttttgttttcatacttagttttcatcagtttacttatgcttggcataagatgtagtacagcaaataggcgttactttttgaaacgtagtcttgactcacaagagtaattcttgagtcgtcaaacttgaaccaatttccatctcgattcttgataatgcaaatgtaatgacctgtgttgacgcttccaatatgtattactattgcaaaaagctgatatgtcataagaccccaagatgcccttccttgctcattcgagttgagagtctctgaaacagtgtatggttccatgtctaggaataatgggaatcccacatgagtttcaatcttggtagatgaagatgctgaatgttcaaaccttttaagctggaatgccagaataggaggcagctttctcaccagcagctgctttgtccttgtagtttctttcttgcaatgactacatatagtcatcgaatccaatttctctttactggtgaacagatccaagcagtcattcaaggtaactttgtctttagaaatcttagcaatttcaagtgataggtccaacattggatcgacagtatttttgctatgaaggcatttttcgcatgtcactgtgctttgcagttggcctgcaaaagttttatgggtaatacaacgacaagttgaagtatcatcaagttcgggatgtagttcggtatcagatttatgaatttcgtctagcaaaaactgccaaaactcatgtgcgtcttgctcagaataacctgccagtgaattcttaactctccatgcagccgtcaagagagcagtaggaccatagcctttcgtttcatctgttccatagaacactttgaaaatttcgtcaatgcaacatgtgatgcatgtatccatttttttggtacatttggcatgatatccactcaaaaagtaatcacggacaaagggattatgaacaatagtttgcacaattgagctcataaaacaagttgcgcccatattaatgaagcctctcaagcctgtagatgctttcaaggaaggcggtctggaaccatcaattatcgtttctgtacccaaattgttcattattggttcagtcctttcaccttctgtctatcgttagtacatgtataatctagtctcaattccctccttgaacacaacttacgtttactttgtctaataaactccaacctttgatctccaacataatcaccacatcgaaaacagaaaatgtaaccagtttgcgagtcaatgccaaaaacatgccccgtactcttagtgtgggccgatgcatggccgtttttccaacatccaacatgtgagcactgcaagcagaaatatgtacatgataagctttccaagcactcacgacatcgcaccgctttgtttctcaaccttgccagctttttatattcaactttggatccgtctgacgtcttatataggggaatatttccatttcggagcttcaatgcgagggcaacgttgacagcaagcccatagttacggtatacggtgtcctttgcattggaggtcaaaatctgcttcaaatgaggacacgaatcaaaaactggaggagaaaatttggcttcttcaagcgttttcttaacagtagatgtcatttgagtaaaagaaaccacacaaatgctccactactcagaaaatgaaagaaaaaaggactaaaatgtgccaaatcttcaccaaaagttttttaattaatttgatatatggctagagggtctgatataccaagctccagtctttttttcagtcaatatggtcccttaacagccaatatgtcggggattaatcgtagatcaggtattcctttttctaggaaggttaaatattgtagtgcaccaaccgatcagatctagttgcacctgaatgctatccatatcggacatcgtgcgagtcaggcgcgcttagtacctgatggttcggtttactatggcggaaaacgaaattactatctacggttatagcttatctaatcagctccagacatttttgaaaaggtcactgtccaaagcgttcgaattaacgggctgtgatgtagttggcgatggctggagttgctgggtaaagctttgactggaattggacgcatgaggtggcgtaggactgaatgtttgagaggatgttggggtggaatatagggagaggatagactttttcaggtctggccgggaactgtcctgaggaggtggttggctcaaaatggaagttgaagaagaacttttagagccgaaatctaagtctaataatgatcttgaattgctctttttgggctcaggtctggaaacaagagtcggttgttgcgtgcttgcgctgatttgagtctgagaggatggttttgatgatggttcaacgactgtttttttgacaacagaaatggatgctgggtcagggagctctttggaggctgtccacttcttcatttcgtactttgtgcgaatgaagttagccatcttgccctcgttggggatataattgtctggcagacttgcttcccagtaagcattaccctttgcattgccccacttacacattgatcggagctgttcttcagtccaaacgtccagatccactgatttgaccttggatatgtgtgttcccatacttctatgaacacctgaacacttgatgcaaatgaaaactcccaagttccaggatgcccatctcgggtgagatgctaccttacagtcggcgcaatgtttatttgctgggtctttcaaaagagctttcaggatctgctggtgtttctcgctgtcaactttgcgggttccatatttcacgctactcattgtcgaaggaaagaacgcgtgcgtgtgtgagtgaatattaaatgccgagttgtagagggccaggtatattgagatcgctcgtttatcctcggttgtgttagatgggttttttgggtgcaactgaagtcgcgcgctggcgtattatcattattttgcgcgcgaattcgtttcaaactttttaacttaactacaacccaagaccccttggagtctatgaaggtggaaggttgccggtaaactatggatagctcccgaaaatgcgtaccagagaggacgccaagtcgcacatacaaattgaaggaagtatccaaacacatgagcgcagacgatatgtggatgattgtgcacaataaggtgtataatgtgtccccgattttgaattcacatcctggcggatccgaagtccttttcgattgcgctggcgtagacgccactttggcgtttgaggatgtaagccactctcattttgcgtgggaaatgatggaggatctttacgttggtgacctggcacccgaggacattcaaagactagaaaaattgaactacaaaaagaagagacggctgaaggcaccaatttacgagagagcaacctcgaagccagaaaaggaatttgttgacagcacagaagttatcaagttcatgagtcgtacagcgttcctggcatggtttgctgttattagtttgcttggatacctttatattcagttccgaaaattgtgatcaccgagatatgtgcatgtcaatcaattaccgacatgtttttgacagggacatggaagctttccactggcgcccagccacgtggcaactcttgttccgcctagggctagagattccaggtctccattcttcatttggacgaaaaatcccgctacggaccatctcaattcaggtttaggcgggatttggtcacatgactatacccgcccctcagtaacccaaaccaatccgagatccaccagatttaccgcatttccatgcagaccaaaccacacagtcaaacagtagtagcatatacaccataccctctttggttcatcaaaaaccctactgacaataccatatttattcaatacttattaatccttcccccccctctaatcgtaaatcaattgttcccgctatcttatgcataatcctctggccaatgagattgccgcgctccctgaaaaaaagagtcatactcaatttttaatttcgggttagactggaattcagatttttcaaaattttcaccccacgcactccaatataaatacttcgttcccttcccaaaattttctcctttttctctttccctcaaccaaacaacacaacacaaactactccaatacctcaatttatatttgttctattttgtatccccagttattgccgtgaaatctgttgttaatcatgtcgtgttaaatttataagttaaaaaagataagaaaagttaaaagaaaagaaagtaaaaaatataaattttttcctttttaataattaaagttaagctttttattgaaaattgtgttgttaaaatattctaaatttttttgttaaaagaaattaaggaataccccatatttttgttgaaaatgttgtgttcgtaatgaattaagatcatcctcccataatgatgttccatttgaaaaaccccctattgtaccaagttatatcctaaagttaaagaataaagaaatagatactctcattaagaaaatgtctgcaagtacttacagttttgaccaagcaatggactttgacatcgttcagtccgtgacgtcgacccaggaccatatccccatggttcttggcgagtcagtgcttcgttcttttgttggaaatgatgccaacaaggctcctgctatcaagcaggaatatgaggccttgccgctaaacgctcaaatcgtcaatcctgagctgacaccatccgtcggaactatttctcctttggagatccatacttccgttttggattctgtattgtcgacagactttactgatgctgacaactcccccatgtttgaatctccagagtctgaagatccaaacaactgggtttcgttgtttgcagatgaaactactcttgctaccactccagccgtttctcgtgcaccagcagcctctgcctctccagtagtcccttcgttgaagaccacctctggagacgagcaacagctgactgttaaacaattcgtcgagtatccttccgctaaggataagctttctcccaagtcagtggagaaaaagatttctttcaagaaggaccacttaggtgttgttggctacactagaagacagcgttcctctcccttggctccaatcgtggtcaaggatgacgatcctgtttctatgaagcgtgcccgtaacacggaagccgctcgtcgttccagggctaagaagatgaagagaatgagtcaactggaagacaaagttgaggagttactgatttgcaagagcgagttggaagctgaggttgagcgtttaaagagtttagtgaaacatcagtgatgttaagttttttttttatattgattttgaattgaaaattttatccaagtcgtttgtagtaatcagtagaccgcaccctctggtgacaaggttgtaaagtctttcatcgcaactgatttattcaccgccccttcaccccaccaaggtaagaatgcacaccatagatattacctacacacaaatctataaatactcagtcaattatcttaactacttaggaactcctattacttaatggtccttgaattgatcttcagtcacaccggcacccatggcagctgtagaactcaaaccaccagtggttaatttcaacagaccatcaatgtactcggctcctgaccatttctggtgcttgacaatttcgacaccgtcctcaatttccttagcctggacttgttgtccgtaagccttcataccaatcttctggtaatctctagagaagttgtcaacagccaaagcagtggtgtgtagaccagcaagagtaatgaactgccagttgtatcccaatttacccaatctcttgatataagtctcttgttcgtcaggagacatggccttgttccagttgaatgatggagacaagttgtaggccaaccattggtctgggtaaaggtccttgacacccttggcgaagtcaacagcttgctggtagtctggaaccttagactccatccaaaccaagtcagcatatggactgtaagctctggctctcatgatggcacactcggtaccaccttggtaacggtagtaaccctctctgacctttggagcctcccagtcaaagaaaacttcctcaccaagaatttccttggccaacttagcagcttccttgtgggatgttccggtcaatgggccaaccttggcagaaaacttgtcctttgcggcttgcttatccttgacggaggatgacttgtcaattgcttcaaagacagcctcgtggtataatttcaggccagctttcttactccagtcagcctccaattgagagagctcggcaccgtacttaccttgcaattcagcctcggtcaaaacatcgatcaagtcaggaatgtctgggttggtagcaccaatgacgaagtaatgatccctcttatcgatagtggaggtcaaaagagtagcagcttcagagtcagttctggcgacagcgatcaagtcactttggaacaaatcagcagaggttctgatagcgactaatctgttgatgtgctcttgaacggggactaagaccttaccggccatgtgtccacacttcttggtacctggagcttggtcctcaatatgaataccagctgcacctctctcgatgaacatcttggtcaacttgataatggcggtgatacctccatgtccagtgtcggcatcggcaatgattggtctcaagaagtcagtgtaaggcaacttagctctttcctgcttggaaacagacaatctctcttctctttgctttctgtcgtgaaacaattgagcgaagaataagtgctcaactttgtttggaacggtgtccatagggtagtcagccaaatctggggaaggttcgttagaagtggatgcagtagaagaacattgccatccggaaacgtaaatcgtgtccaaatacttagccatctgagtgatgtggataggatccaaagctccgaaggtgaaagaagcggtctcgttcttggcgtgttcccctaacagcttgaaaagcttctgcgcttgctggttactggctggaacagaagacaaagaggatcttctctttgcaatgtcctcagcgttgtaaatacgcttggtcttggcccaacgtggctgagaccaccattcctcaatctccttgatttggttttggaagtcttgctcttccttgtctaagtcaatcttagtgtaaggtcctgacattcttgatatacttgatactgtgttctttgaattgaaagaaaataaagtatttgttgaagagattaaccagagttgggggttctgtcaccttttatagtcaggctcatcgtctccggttttccagggcatatagagtcgtgcccggaaaaaggtgactggttgctgatataaatctggggtagcggactctcggagaaccttgcgttggtcagcccggggtggaatgggtgcacggaacgagttgaccgaggatcgcacaagtcatgtgatttaatgaggttcgatgggggttgcagatgatgatgagaaagacgttttagggggcgcccacacaccccaattatggcattatgcgaatctcttttgttttgattggcacacgacatcagccttgttaaacaatactgctgaaattcaatcatgctttacgtaaaaaatatatgcttacgtaactcttggtgtattttttttttctctttccctttgaggccctacttcgaacaatcaatcttaccctttcgctaaagagttacacctcaacgggttgagcctacgaaaaacaaatccgtttgttgttccttcgaacatttcattgtactacgctttagaagctatagtcgtatattgccctacggatgccgcttcctacaagctaccggaacagcacatttgtcccgaattcgccggatgtcacccaggacggtagtaaagatggcgattcaactagttcgtggaaaacaaataacaccacgagtaataaagtgggagtgacacattttattcgaaagaagctgaatttcagcgatgaaactctttggaaacagttctctgctcgcagactcgagttgatctcgttgatgaagttaagcgaaaagaaggctagtgaacaggatgaggagatcaccaagtgcgcccgtttattactaatcgaatttcagtacccagaggaaaacttgttggattttgataaactggtacgatgtgctatacaaagtgttagaagaaacaaaaagcgctcttggaagaaggtcgctgatgttcaaccgtcgtctaatccaaaacctcaaaagtttgtgatatttcaaccttcggatggccagcatgtccaggaaggctcttttagagctttggagccaccaaggctctcatcaaaagacttcctttctcaaattaccaagctaaactcatctagtgagaatgaaggtgaaacaccatcatattccaaacttcaggaattaccgtcaacatctaagctggccatcaattcgctcattacacccagtagaaccaacaatggtcattcatcaaccaaagatcttcctgtaaaatctaatagcatatctaattacaagttggaaagtatcatggcaagaaatccggaacaatctgatttcagagtcaatttaccctcaatatcgtcattaccatttggaggacacaatcctgagacgaacacactggaactcgagtctctagcaaaattgcttcattttatcaaaaagtccaaatcatgttttcaattcactaaaactttccatgaaactgtagaagaagacttttacaatcctggaagctcacagtcaacctacaacacagaaaacattgaagtagtgggagcggcagcaataagttgctgtttggcttacactctgcaaaaatatttttccaattcgtctccctcgtcgttaagttatttacgaatcaagttatccagtgattctgttctatcacgaattctcaagaacttggatgattcttcgttagacgtcataatgttaggagaatacactgctgcacagcttctgaagaaactaataggttgtctcctcaaagactttgggtttgacgatatccttcaaccactcagcaatgtattcaaatcaatagtgatcaaagattatcctttgatatgcaaacctattcctaaaaaatctagcatccttcatacagaagagaaaagagaggatatcgttgttcatttgcgatacaagtctaaatttctcaagtttaactacattcatgatacatcttcagcaccgacaatcatagaaattttggacaacgccaagactggattcaacattgttgataacaataaataccttcagctgcgcaattataaagagccctccgaattgtttcacaacgatttacagctggagctattttttcaaagacaaactgaagcgggcaaggatatagatatagaagtctttgcctctgataacaaagagttgacgagcgagcttagccaaaataaagatggaaacacagccaaaatattcccgccattggatatagattccaataagacacaccatcttgtaaaaaaggattccttacactcgttcaaagattatcaggatatcaagaaaactcaagaggaaagaaatcataaaaagcaaaaaatcatggttttccagccattactataagctatttcaaattgtacaatatatatctttttatttatgaactctattctgctttttcttgttgaacttgcccttcttgtggaaattcttcctactttggaaaacaggttttggacgttcaggcttgctgaatcctagttcaactgcaagctgagtgtttaaagcgacaccaaatttctccacccttctgatttcctgttcaacggttttgatcgatgcttcatcttgaaacttttgagctctattcaatctagttgttaatagatcgatagctgcctttttcatttcttctggtgtggccttgataacaggagtttcgtctttctcttccgttttttccacttgttttccggtctcggaagccgtagtggtagcgtcaactttttcaggttcaggctctttagcagtttcgacaatctggtctttcgatttctctgaagcaccattttcttgcttattttcatcccctgagacctcctccagcaattcttcatcatcgatggcacctgcctcggtttcaggagcctctttcaaacgttgaatcagttctgatttaactcctgctgttgaaaggcccttgcctttcaggatttcttttaattgagctacagtctttgatgaatagtccatttcgtgttgtttggaactaaacgtggtattgttggatgctgaaattctaggaggcgcgcttggggggatgggcgtcttgtatcggtttactgggaggagtcaaccactccaaccacgcgtactgagccttaaaagactaaacttttcagaattttacctatttatagatgaaaggcatgcttatgtattagaaaagaatagttttaaggacgaaatagtgccagagcatctttagctgagcctattattcctggcccgtcaaaataagtcctacgtaatcacccttcgcgcgagatatctacttgagaccagtcccaccactcttctaccaaggtgatgaacatctttgatttggatgaaggcacaaagtccttacttacgcttgacaacttcctaggagggctgacaatcccagagtttatcgaaacattatccaaggatcattcgctgctaggaacgcaggttaatgatctggagtatctggacccaaagccttatatcagaacattcgaaagtaccatccagtctctttatagactgagtgatgaatgtttggccaaagttaaagccgtgtctgctgaatcttcagagctttcaatcaaacataataagaatgtgatcaaagtagacgataaactgaatgatttgatgagcctcaacagtgttttggtggataaaataaatacaacatcgacggtgattactcctctaggtgaagagatgttgaaactgagtaaaaccaaatcaaattctcaggaggtgattcaattgctaatcaattaccaagagttttcaaaaactggcactctttccaaagactggctggttttatacgacgacacatttactaaccattcaaactccatttttgctaaacatttggtaaaccttattaacctctccaaaaacataatggccccagatttgcctggatctcaaaaagtctacgaaggattgttagtatacaggaataatttgctagaaactttgatacagaattttgaccagcagttttccccagagtcttacgaaacactacaaaatattacttcaacatatttcacgttaaggaacaatgtagacgaagatgatgacttaatcaaattatttttggcaagaattccaggtttagatatggaagtcaacttaacttttgatactaatgaagtgtccaaccccttagtgcacaaagttttcaacccaccttatcttgcccaaatttctcaagttctactagacagttttgaagatcaatcccaactgatactgaaaatttttcctcaatcattcacaaacaaattattgtccatgtacatcacaagactttattctgagtttttgttagttaagatttccactatactatcgaatgctgcttcaatatcaaatttaacgtactgcagagcattatacggacttcatacttgggtaattcaattgactaaagacttaaaaggactattgaatgaaagcatcgaatatgatagggattctctgaataatttcctggaccaaggcgcatctgaccttttccaaaaattcacaggagtcataatcgaaaaagagacgagcaatttggaagactacatttattctgtaatttcttccttcaacgctatgagaccaaacagaatggccttggctaaccaactaaattacgccagaggctcttcaggcacttccaggttgagcggatctttcaaaatgtcctcagcatttcagaattttatgagatcaagattggatagctccacttcattgcgtgaaaagtatttcaagaaacagcatgttgggaatggagacgtgaatgagactcaagtttctctcgagaaagtaaatcatattctccaaatgactgtagagtctctagccagagttgtcgagttaaacccagacaagagttcccaatttgcacttgaagtgttagagattttaatcattggattgggtgagcattatgtgaatataggcttagaaatatcttaccagaacctaaaggaattagaaggcaaagaatccctggatctacagtaccttgagatcactaaccaagcttcccagatactttatctcttctctacaagtgttcaaaccatcataatcccattggcattgaatgatactgtcaccaaggacaaaatcatacagctgagcaatggttttatctttgagtgcgaagaatctataaatctaatagttgacgaaacgatatcttatatcaatttgttagtcaataggtatttggttcgacaaccgagaaaggaatttgtaccaaatgagtacgagtctaccaacctgttgtcaagtgataccacgcttacctgtgaaaaaatctccagatcattagagacggtacatgagcagctgcataatattttcaagtctggcaatttggtgaaaatacttgaaaagatcggagatggtttgatctcgagtctggtcaatcacatcaatagattcaaagtcatcaacgttaatggtggaatcatccttacaaaggacatcattaaatatcagtcggtagtatccgcatggggtatccagtctctaaacgatagatttggttcattgagagagaaggtaaatctaataactgtgaggtcttcaactgaaagggatttgatcaacatttagtagttattttaatgattaaagattaagatgatgataattgtagatatagcaatagcatgcaagtgtatcttttcagttttgaattttctcaatgccagtaacaaagttgcgacgtatgcaaacccaagaagcttgacagcgccaaacgggcttggaaggaaacatatctgttgttgaatagtatttgagctttgcttgtgattgttatcaagattgttgtatagagataatagctggattgctggtttagaaatacccccagtcatactgcacgctttaactgttatttcgtcacaatagtcctcgccaaccgttcccttggtccccaagtcggtaagttcatgttggatatggcaataatcatgatcgtcaccgctcaagactaatgatggtttcgacttggcaagtataaaattagagagttcaggatcaataacagtttgatattggtaccctttttggatggggaagagttgtttgttatgttccctcaacggaccgcatgtttgttcggctggatctctaaatagaggcacatgagtaaacaaaatacgaggatactgcattgccaatgaatctgttaaattgtccaaaaaccaacgggggtcattagtcactaccggctgtgattgtgacgataaggagatcgaatcgatcaaaatgaatgaatggtttcctagtaaatcaaaggtgttgacatctccgaagaaagttctaaatcgcatcagtttatccagatggacttcattgccgaaccctatgtcatggttgcctggaagagccatattgattcgtacattggggaattttggaaagatacggttgaaccgtttgtactccttgaaccacacatcgtcaccgtcgtgttctctgcctccatcaaatagatctcccaggaaaaagatagaatcgggtcgaagcagttcgttaaccatcatgtagttcctgtgtaagtaatgatcagacagttttttggtgaagtagttaattagctgtagtctttccggatatgaatagtcgtctaccagctgtggatcagcataaaccagagaatggtggggtgtcgaatgagcgggccatttttcccaatttttccagctgcatttcttgatcgttcggtaagcggaccaagtatcacctgcatatatcagaaaccaccaaatagtcaccaatcccaggtagaacttcagtactggtgctgtagtcattggtgtttactgtttgcaggttgggagatggaagagatatggcaaccgcgattaggtaatcgagaaccatacctagtggatatgtaagaagggttgaaccattcagttgtcatgttattgctagttttagttctgaccctttgttaacgacttccttttgtatttgcccttgactgcctcctgtttggttaaggcgagtcttcgctctgttgtcccttcctttcccctcccaatcaccatccgttggaagcgcgagaagagactatggaatccttctatagatcaactggaattactgctagtgtaaacccacaaactcgacatctcagcctatatggccaaaagaagacgtttgaggtcaaaggaggactcggttaaaacaaaacttttcaacctggatgaactgatcgattccattcctatagatgttgacatccctattgtagatgagtgttcaggtccaaaaaggacgactacggagattcatgcttccagtagtgtgaatttgctaacgaaacccttgaatattgttcagataccgtctcgtcagaggcgacgactgaccaccattaagaaaaaggtaagccatttagaccctttggatgataagcttttcctgaagcaccatcaaagagccgagaaatcagagaagaaaatgaccaatatcgaaaaggagcgtgtgtttacggagtatgactactatttgcattgtctagaacagttaaagactgtgtgtcaagattacgaagcttcaatggtgccgaaccaacagatgatgttgcgaataactgaacctttcactaccatagatgatccgaacgatagacaagaagttttaatgaagatacagctgttgattggagaaataactaagtttaccaggacattcgaaagacttagaaaacttgaactgaagttgaagacgttgcacaacaatttctatcaccagatagataatcccgaagactcagatacagaagaagaggctcacatggatgttaaaaggttgagagagactagattttatcgaaggctcaagcatggtccgttaataaaaatacgttttttggatggaactgttttagttaaagatgctatttcacctcccaaggtgatcaatttttagtgcaaaggtataacttcatgccaaatgcagacgatgatcgtcatttctgaagacatcattgatgcgaacataataactcatttcaaacgctccaaactcaaaagtcaatgtataatgaaatatggagctccccaaaatcatgaaccaaaaataccaatgagtttcgaatggagattcgttgcttgctgatgtactatacctgtataattgaatgaaaagaatcgccattactatgatttgatagtaaagaaccagccttcgaatgttcaagtagcgatactccttcctgttagatgtgaccaacttgcaactcatttgggtgaataggacttccatcacacagtaaatgctaaagaattttaaatgattattcaaattgtcagctgaactgacataaaggctcgcaataaaagagatcagctttcttagtaccaatgcgacaaaggcaacagactttttattgccatataataattgtacgaatgccaccagcggatgaaataaggccttagtcgccgtgtttttcaatttcttttttggcataatttcagaagtaggctgcgacagtataaaacatgcaattagtatgtagatgaacagaatgatggtgacctggctcgcatacagggccattacaattttgaaaaatggactgtatacggggaaaatgagcagcccaagtaatgtgagagtattgactatttgcccatattgaaggtatttgtccagccgtactatcctttgacccatattaggatgaatggtccccgctagcagtggaggcgttaccgagagattgcgtgttttgcgttatcagtctgggacgctcggaattgacgatggaacgcgcgatttctggcactagatagagatgaccaaagagctacagagggatgggtaaattgggtgacaaaacgtacaagaaagcacaagtctagatggttaagcacaaatcgtagcgaacaacaaaatcaatcttattatctacaagtgcataggacgctgatcgtctatgttctcacaattaaaagtgcgcttccggaataaatttccgattcatatcgctggcataatgtggaaaaatgattactgaattcggatgtctcgttattcccgtatgcacgttcctgatattagcgtactaaaatggaatttgcattgtttgcaggtgaaactccctggcaataagcaagtaggtacgtgaaaaactattgtataagctttggacggtgtagggatcaggctaatgcggcgatgggctgaccaactggtttcttctcaaattagtccccagcaaacacgataacatactataaataggacagaaagtactttcgatgctgctgctttattgttgacatgggtgatgtgaacgatctaccaagtctgaataaagtcatagaggttgacctggactcagacccaatctcaatctcagaccaatctatagatatagagttttcttcggccaacaaaagtaaactcaattctcccgtaataatggccgacccggaggtatgctttccacataggtttgagttcaactactctgaacctgttcgttatcacgtgtaccatacttcctcaagatcattcaacttagaagaggaactcaatgattgcaggcctaagcatctatccatcgcagaagaagcagcatatcaagacggaagttcctgtgaaagctcaaagcggccattcccagatgtagtgccttgtgatgtttatgcctctcctcacttccagggtaaaaggtcaatctggaaaaagctgagaaaacttcttcgaaagaaggaaaactccaagatccatgtactcaaccaatacaagttcccgctgattacgcccgagtatgacgaaagtgcttgcaaaacagtcacatttgacccagatgtaatagtgagggaaacttggtcaaccaataattatacccgtgtcgaccctatgttaagggaaaaattggcagatattatgaattcaccggagcagattgaacagatacaaaatgagctgaacgaactaaagaatgagatgaacatccacattcagagtagatataatactcaatattttgataaagagagcaggctcatataataatctttaactccctcgatatgtagtataactatgattggacaataataaaggaatatggtagtgattttcaggcgggtcatctatctggaaaatgatatccacaaatgggaaaaaagttgtagttccagttgcttgaaagtacttcttaacatgaaatcttatcttataaattcctggggtcaaagtcttccacttatcgtcctttattcctagtacttcttgtttgcctctgctaagttttggatcaattatccaataagggattctgccgtcttcattagtttttgccacagcaaatggtctttcattgccgatctcgttgtcaagtactacgtccacagatggggacagctggaagatggcacaatccacgttaaaagcgggtttacctttagtggtatccagaatgtggcaggtaactgggtcagccatgagagtgataaaatgaaaaggtgaaagatgaaggtagatgtaagaaatcaacctggttagcaggatgaagactctactcggatttctccgaaagataagcaagagagtgattttgccgcatttggttaaactagttgctttttatgttcgcgcaagagttctcagggaaccaggaactgtcagccccgcccagtcaagggaactgcctatataggaactaattccgtccactgcgtcaggatcagatcaggaccaactttaactcagatttaaacacgatgcaatgctgctaatctgagcagccaatagaagacggcagcaagataaaagcggtcatcttttgctcttccacagtcctctatataagatcaacatagccacttccgtttcaacctctctgcttggggacttagttgactgctcgcctcatctcatctccaaaacataacaaaaacgctcgcgataaccaacagtatactttctccagaagcaatatagtacccttgctttgatctgttgatgaaacatagggcttccaagttgagtcccatagataatgctccagcacagaatcacataagctttataaaaaataacataaaattctaccacccaaactatgtccacaatatttcaacgatgaatatggtagtgcctctgttcatgagagacatttttcatttaaagtcaccactggtggtttacggaaacgaaggatatcttctagccaggtacaatgtcatgatgctggggaattatcctattgaacgcataagagtgaccggtcgattagagtcagaagttatgagagataacttcgatattctagtgattaacgatcacagcaagtctaatttgtttctgaattgtaaggtagaacattcggaatatttgagggcaggactgaactggggtatgaaccatgatctattattgcaattaacgggagtaatcactttgaatagagaaggactacagacttttgaggttagcaatattgaggttgtgggcaaagccaattgtataagcacagaggtgaaatactggaaggagtacttagattttagagaaacaataaaccagccattagaacttggggaagatgatgttgtggatctttgcactgcaacgcaagatgatgagaaagagaacgatatttcagaggcagttggaaatggacagaaaaatgaagcggaaaggaatacagaagcaaagacggatacaatacaggaaacacataacaacagaaagattatcaatgaagcaacaaagaagaaggagttaatgaaagtgaaatcaacgcatagagacaaagaaacgataaaggatagaatacaagccacggacagggacgaaaaactaaggcaaaaaaaacgaaaacacagagaaaatagtaataacggtattaatgtcatgcataacaaaactatgactgccgttacatccaaagaggaacccccatgtattgaactgatagaactagatacagacgaggaagaagaagaaccagtaattgcagttatcgagcttaaagactgtcaggaagtttccgatctaactgtgacacaagtggaaattgctttcataaagtggtgtatctccaacaataagaagaacttcaagttctacgaggtcctacttgatgaagcgctgcttaaactactagaaagatgcaaagattacgacaatatgactttgatatcgaaaatcagagacaaacttgtgagagagaacatggtacaatttgacgaggtttcgcttgttctgaatgtcaataatcttcttcacttgaatgttatgttgagtcgaatgattaagaaaatggaagttgaagttcggaaatcggcgtgcaaagaacgcaatttggttgtttcaaagatgatagaaacttttaattcagtatacaagacgaatcttcagaatcacgacataatcaacgatctaatacgatggaaaattggatacggaacttcaaggtataaatggaggtttgatgatgtgcgatggatcttcgcgaaagtttagaattagaagactaaataatttttttttcagtagactacatacataagtgataccataatggccttgtttgaagtggaaggctggaatataaagactgacaatgttgctctcggtaaagtcgacgcaccactaagcaaaaagaaggaaaagaaattggaaaagaagaacaagaggcgcgaagctttgggcaagaagaagaaccaacttcaggagtggaaggaagaggagactgtacatgaggagaacgaacaaattgaacccacacagcaagcaaatgataatcttgaagagtcagaacctgaagtctctgctgaagagacaaaaacggagttgactccgttgcagcagaaaatgatggccaaattgacagggtctagatttagatggatcaacgaaaaactatacacaataagttccgaagaggcattagctttgatttccaaacaacctcaattgtttgatgagtatcacactggtttcaaaaaccaggttcaatcgtggccggagaaccctgttgatgtttttgtgaagcacatcgagaaccgaagtaagaagaacgttaacgctccaggaggactgccagggatcaataagaaagtggtaattgctgatatgggttgcggagaggctcaactagccttggatgtacaaaatttcctcaagaagcatgccaaagataagaaggttagggccaagagtatacaagtacacagttttgacttgaagaaagccaactcaagaatcactgttgcagacgtgaaaaatgtcccactggacaaagagtcatgctctattgtgatattttgtttggcattgatgggaacaaatttcatcgattttatcaaggaagctcataggttgctggcaccaaacggagaattgtggattgctgagataaaatctcgtatagatgatgttgataagtttattgacgctctgaagttatacggttttcttcacaagaccacagatgattccaacaaaatgttcaccaggttcgaatttttcaaaccaaacgacgatattgtcaagattaaggaagaaaaaatggagaggaagagaaagtttgtagaagccgacgaccccaaagcggaatttgagaagagaagatccaagaatccggaaggtaagtggctactgaagccatgtatttataagaggaggtgaaaccgagatgaaattatccatcctaacaccaagtaaataatgtagccatagaattgaaatcggtaaccctttactacattgtagtacggacaaattagagcatatgttgaagatacgacagcttcaaaaggagaaacagaagaaccaagagggtagtggccatgtggtcaacaaggctagtcccgctgagatccgtattggcaaagatctagaggagctggtcttaccacccacaattaaagtagagcactccccaaacgatatcaagaacttaaagatcaccatacgacccgatgaaggttactacagtggaggggtgttcaagtttgaatgtagcatcaatgaaaactacccaatggaagcccctaaaatgaaatgtttgaataagatttaccatccaaatattgacgtggaggggaatgtatgtctcaatatattgagggaggactggactccagtgatctcgttacagacagtattctttgggcttcaatttttgtttttggaaccgaatgaaactgaccccttgaataaagaagctgccattgaacttaataaagatcgcaagaagtttgcccgaaatgttatggtcagcatgagaggaggttatgtgaacggagagtattacgacaatgtctacagttgaacacttcagaagaaataaacctttattactttctaaaaaaaaataaaaaaaaacttagcaagtcaaccagtaaccgacaaaaaaaagatatgtccctatgcagcttttagaaaagagaaatcgtactcatggcaacacaatatgcattatttgctttacaacttaacgtggagatttccagaaacttcctcgttgtgactgaagacacttggatggaagttttcatccttggaggattctatctgggtagagttggaagcaccttgatttatggttccctcagagttatttgcaacgactgtgttgttgaagttgatgaatgcagaggaagaaggtattttggaagagtaatatctgtttatagcatttgtgttgattgagcttaatggcttagcaacgtttttggttggcttcaagttggaaggtaaccaacatctggaagagcttttgaatgataaaacgattcttgaagaagacatttgtaattttggtgtgataagatgtgtaaaaatagggaaggtcaattgcgggggttatcgtattcttaagtactaaattcgaagaaatctggggttagctcattttctcatcatccgaatgtgcgtgagggtgttcgatatctggacacccgggaagtacgtcattagcgaaacagattgcaccccctatcggtcccacatattgctgtgttttggtggctgatagggtctcgaattacccaatttggcgtagaattttatttttttgccgaacgtcctaactcacccccaccaaaaacacaaacaatcaaaagtgacaccccgagaagacatcccggccctggttaattctggaatcttccaatcaccccaacaccccgactttaaatgagtcatagaataaccaccaagtgttagtgttgatggctaagcagtgttcacagatttttagagcggtttgcttggtgtcacttcaacaatactagtaaggccggcgcaaaatatctttcccagaatgcctacaaattatgctaaggtttcagaatcaccccacatgcaattgtagtaaggataagcaggtgacattttcccgattctcctgtgtacccgatagtgcgtaggtttctttccaatccaccagatttcaccgcctaagtcgccataactccggggacacaacccgtgatcgcaggttgttcttaatctgatgtaaggatttttatgtacagatttccttcgcatgttcggaagagacaacaagacgaagatgagtcagaatgaaatggaacctacacaccccagtattctggactggttctatgtgggtatgtgagtatttcttttgggcgatggccagacgattgactgctgcgcctcactccagctcccattgaggatgagagtgtgttccagcaggtttccttcccttttaacagtacctccgacatcgactgccttttccatgattttcacgtgagtatgcacctgacttacactatcgaaattgcgttaagtaaaaaaaatttggttagttcatctaggcaaaacggtcttcccaaaacccccaagagtgccttttttaggagttagccgaaaaccgagcttctccatgaataccaagattttgcatgtggacccatcctccatacttttcaacaaagacgaaggaatcgaaacttgtactcccatctttactgatcccaaaacgaaatcctatctagacgaggcatccatcattttaagatcccataagaactgtattggttttccaaccgaaacagtatatggccttggtgcttcatcactgaatgacgagtctgtgaaatccatttatattgccaagaatcgaccgttggataatccactaattactcatgttgcctcgctgagtcaactacaccgcaagattttacctccatcaactaaaatacccgatatttacttaccattgattaagaaattctggcctggcccgttgacaattcttttgcctgttgaggatgacacaaccttgtccagattaaccactgccggtcaggatactttcgcagtgagaatacccaaccatccagttgcaagggccctcattgccatttcagatgaacctttggctgctccttcggctaatgcttccactagaccatctcctacgctagcagaacatgtttatcatgatctgcaaggaaggattccactgattatagacggtggaccctcaaatgttggattggagagttctgtagtcaatggacttacaaatccccctatgctattacgtcccggtggaatttctctaaagcaaatacaagaagtcgggcacggttgggaggacatagtcacagctaaaaaaactgcgaatgcatctgaacctgtcagaactcccggcatgaagtataaacactactccccaactgccaaggttattctattcgttaagtgtggaaatggagttaaggcagtccaggaagctctttcacgatacccaaactccaagattgccttattgacaggatccgaatttgaaataccagaaacattacaagcccagtttgctattgttgatcatctaggatcttccatcaccgaaatggcacacaacctatttgccaaattaagaaatctggataaaaacgatatggactatatcttcattgaaggtgttccagatgctggagaaggtttggcattaatgaaccggttgtcaaaagctgcacatgaaactatatctaatgattctaagtaattaaaaatctatatcaaacagccatgctgtatccattgtatggggatgcgtcacgtctcctgacgtagagttttcgaagctcgtctacaatccatactgaactcgataacaacaataaatggaccaaatctttgaggctcagaggttcagtctggaaaatagactgcaaaaatggaatgtaaatagctcctagttgacccaaaatagaagctgcaacggaaaagttgaacatagtattattccatccaagttctgcaatacttttagaatggtgtcttgtcgttaatgcgttgaacatgtcaaagaatacaaagcatgtaaaggtcatcgtagtgtctcttgctgtgacctcattatctttgatctcatgcatgtatacgtacagagtaccacaaacaatgataaaactactttgtactaccctttgaatcaccttacctgtcagaattttatcatttcgctttcttggtggtttgttcatcacagctttatcaactggctcaacacccaaagactgagctggaggtccatccatgataatattgatccacaaaatctgcatggcattcaatggatttggcaggttgaaagcagtactcagagcaattaacgaaagagcagcaattgaagtagaaagttggaacgttaaaaagttctggatgttgtagaaaatacctttaccctcctggattgcagataagattgtagaaaagtcatcatcagtcaaaaccatgtcggctgcctctttggcaacatcggtccccatattacccatggcaattccgatgtcggccagttttagagctggggcatcattgacaccgtcaccagtcattgcaacaatatctcctctggcctgtagtgctcttacaatggacaccttatgttttggagtagtccgggcaaatacagaacaatgtgagatcgcctgagacagttgctctgtactcatagcatctatatcgtctccactgaggacagcatattttgaattgtcaattaccattccgacctgtttggcaacggctacggccgtggattctgaatctcctgtaatcataataatgtgaaccccacctctcatgaatttcaaaattgatttacttacagatggtctaggaggatcgttcatacctaaaagaccacaaaagatcatatccgatggtccatcgccagtttcttcaaaattgcctttgtcgtaagcaaacgacagtattctcaatcctgaagatgctaacgtatcggccatttgcaaggattttcttctaatttcatctgtgagtggagtggcgataccttcagcattgtaatatcttgaacatctttccaaaactttgttcagagcgcctttaacaaaaatttcagatttgcttttgtctccagagtgaacactgacggcctgatatttcttggacgaagaaaatggaatctccaacattctttcctttgttgctctaatgtcctgcaaatcaaatttttctaaagattcaataattgcaatatcagttgggtttccgaggtatttttccttttcatttgaatatttggcattgttgactatattaccagtttgcagaacttttagcgtatcgggtttgagataattggcataggactccccttgttcaattttcaagaattcatcgcccatatccacagtccataatctgttaacggtcatatgattttgggtcaatgttcccgtcttatcactacagataacattgacggatcccaaagtttcaacactaggcagtcttttgacgatggccctctgtttagccatacgcaacacaccaagagcaagagtcacagtcacaataataggaagaccttctggaatcgcagcaacagccaaggatacagagatctggaacatttccaaccagggtctaccttgaaaaacaccaaccaagcaaataaggccgatgattccgaaggaaaaagcagacaaatccttaccaagtttatccatagcctgttgaagaggagtctttggtttctcaatagagctcatcatttcgaaaacagagccaaaagctgtgtttttggctgttccgatgacaatacctttgccattaccatcacgaactaaagtgcccatatacccaatacatgaacggctgttcaagggaatgtttgggtcatcactttcaacaggtttgctgtctttagaaactggttcattttcaccagttaggttgctctcgtcgatactcaagtgggaagcgtgaataattctcacatcagccggaattctgtcaccaaccgaaaaatccaccaagtctcctgggactaggttggcagcaagaacagtttcagtgttcccattcctagttagatgagcttcggcagggactaacttgttcaatgcctccaatgatttctcggatcgatactcttgaacaaatccaactgtgacaacgatcgtaattgccatagtgatagatatcgcatcatcaatgttagacatcaaaaagctaatcacagcggaacccatcagtaacagaatcaatggatcgctgtagaaacttgacaagaatttcgaaaaaagactctcttcctcttcgacttccatttcatttggcccatgaacagacctccgatatacgatgtcctgggaattgcacaatcctttgagaccatccgtttgaaactcttctatgacctgatccacggtatatttgcaatacttaagagactctccagtcttcgattccaatgcagggggggcagattcagaagatcctgtcagctcattctcaaaaggattttcattagctgtcattctgagttcactaaatgcccaaatctgttcaatccaatagctcttctagtagaataagttacgaggacttacaaattcaatccaaccaggaaagaagcaaataacagttgtccaacttttactttttcttttcgcagaattacctgtaaataatctgttccacccgcgtagcgatgggcttggcatcaattttcttagtgcaaagccgggcggagaaattcctaagtaaacgtttctattatacatatactactcctactctaactgggttccacattgtatctcatacgaatacccatcgcagacagctctgagtctaaatatttaagcacaaatggaatggcaacagtggttgtatcgttgcctccagtgtatcggtttccctgtccatcttcccagagatccatatcatcggtcgttccggcagtaacgtcattgatcttcgtggaacaacgacggcagtggatcatggctttcgtgcctatacgaggaacggatgtttgtgtgtttaataacgatccacagcctttacatatagatgtttgagtgtagtcagaacagttcaacagacggtcttgtaataagaacgcagtaccgtgcccaataagagcatcacgttccatctctccaatacgaatacctccgtttctcttacgtcccttgactggttgcattgtcaagctgttgacaggtcccgtagatctgacctggaatttatcgttaaccatatgtctcaaccgttggtagtagaccactccaatgtaaatatcggccctcaattcttcaccggtgacaccagaatacattggctcattaccgtggtaattgtaaccggcactaattagctgctcaccgaagaaatcagccggcgtatcatcttcattgaacttccatggagtagagtcctgagcaattccatgtaatgctccagcttttccagccagagattccacaaacataccaatggtcatacgagatgggaaagcgtgcggattgattatgacatcaggttgtattccagtttcagtaaatggcatatctatctgaggccatttccgggaacagacacccttctgtccgtgtctagaggagaatttatcaccgatttgaggttgtctagtaattctgtacttaatggtgaccatttgcaattccgagtctcccaaatcatcgcttatcagtttaacctcttcaatgtatgcaggctctgaactatgataagtcttcaccttggtcttaccaagggtgtcatcatagtatgccactatgggatctccctcattaactagagtcccaatagctggtaatccgtcttcatcgagattctgtttccaggattcaggccactcgtcagtaccaaaaccaaagtgttgagtaattggatcacctttccttctgctgtcagctaaatcaatcacttcaactttatacatggtaccgtaaccaaagccacgttcatctgacgatttattgatgatcatcgcatcgtccatatcgtaaccagtgtatgaaatgacagcaacgaccgcgtttgttccattggggaaattgtccattccatagtcatcgtaaagattagcctttactataggagtttgtcctgtttgtagacgataaagcttattatcacttcgatgaaccaaagcaacaccaggtgtacccatggtttgcttacccatctgacactgatacatatttcttggagattggttgaagtcagaaaatggcgttaaattcgcaagaattgacaaaatgttggttggagaaaactcgacatgactatgaacattggattcaatctcttccggagtaacagcgatgttaatgtatgcttgttcgaaagggccaataatatcctctttatccaaaggtaggtacctgactggtctagtcatcctagcacgacctccaaagagatatagtccaggatattgacctctagaagaaggtggaacatgaccaacttccaaatcaagaggaatgccatgaccaccttccactttccaaaatctcaaagtgtcagcaacgatcttagcctgttcatgtgtacaccatcccacgatcttaccatctaactgaacgcaacacatttgaggtccagcggcaaaaacatgattggcagatacgcccagttttgatagaactttaggcaccttcgaaacatccgattcttcggtggatattttacacttgtgagccaagtggttcaataaaccacatggagaaccatctggtgtgtgcacaggacacaaaaatccccaagattctggaagtaattttctaactgtggttgtcttcaattcggcaaagaatgaacctctatgaaccattcggaaatgagagataaatctatagaagttgattttctctgcgacaactgtataacccgaaacttgctgcaaatccaatcccgtttgggaaaccaggttaccagtagacaagaaatactgtagtttcttaccaatattctcattgattctttgaaaaacacgagacatatacttcggttcgtcaaaattcactggatagcctctattaatgtctgtttggatttgtaatcgaatactggccaggtattcttcaattttttctttaataatcataccataaaggaatcctcccaataagacttcttgatgttgggtagcatctggattatcggggcagcaatctccagaaactaatgcataaagttttctaatcatgaatagtaacaatctgaatttatctctgttgtcgggtagatggacaaggacgattcttctcagtacttccttacccacatcgacatcggatacatcaggtgttgcgttaaagacgactctgaacttgtctccaagataggccaaagtttcctgtttcgaaactaacttgtaatgcttataatttctcaacagtaattccaaacgatcagtcaagaacgaattggaagtttcagagcccactataccgtcaaaaatttcacggtcattggtctccactagggccttcaaaatcatagggacggggaccaaatactcattctttctccaactgaacctgaaggtaacgttaccgtctttcaagtaatgaagaacatttgtctgtgaagtctggtctggtctgacagctcttatttgaataccaaattgggtataagaatcgcctctgtttccaaaactaggtctaataagagccattggatggtttcttctttgaacaatcaacattctgactagtttttcaataccgttgacaatgaaataccctccaagctcgtcactttcctctttgttcttcaccagttcattgggtgacattttctcaagatgacatctgtttgactttagcatgacaggaatttgaccagcctctctgatttctgtttcttctgggccatcgttgacggaccagcatactttcagcatgaatctggatttatatgtgatcattctctctctgcattcagatggtagtgtcttcctgttaacggacaatttatctccaacagccacagacggcttagccaactgaactgcatctactcgtatcttcaatttgtttcctaatcttgaaggatcgttgctatcaaatatggttttggctccgatatccttaactgctaagttcaacaatccaccattgagcccatcagtaagagcattgaacgacccgatatgtggagctacagcctgttccaacaaagggaaagccgatttatccgtaggcgggttcttgaatcgattctcacgctccaaagtcttgaacgatgccttcattgttggctgtggattcgatctctcttaggaacagtctgaaaattttttagagggagggaaaaagaaaatatgcttacaatagaaaaaaaaaaactaagaatcaaggcaattccgggagagttacgagagtactcacgtgaccaggaacattgaaccaagtcgatgtgatagataaagttctttcgtgtagtccagaagatcatggccaactcgaagtttgagtatgtgaaagcctttgaaaaggaggtttatctgctcccagaaacatatatggtggtacgggtcgatggaagggggtttcacaaactttcagagacctacaagtttgaaaagccaaacgacctgaatgcattggaactgatgaacaaagcagcacaatcggttatggagaagatcccagaagccttgctggcttatggggactctgatgaatactcgtttcttctccagaaaaattgtgagatatttgaaagaagggaggccaaattgaccagcacgtttagttccacgttcacagcttactataatttctactggaaggactattttcccaattccccgctaactccagaaagattacctacctttgatgccagagttgtcctttatcctaatcaacagaatgtgaaggactatttcagttggagacaagtagactgccatattaataacttatacaataccaccttttggcaattgatcctgaaaaaagggcttaccccacaggaatccgagaaaagattgatgggaactctgtccagtgacaagaacgaaattcttttcacggaattgggcatcaattacaacgatgaggcagaaatttacaagaaggggacggttttgatccgagagtgggaacttaaggatgaccagccgagtctgaacgaaagagaattatcaaagaggcaaaaggatagactacgaaaaaaattcagaaaagctaaaatacaaaaatatcacatagacattattaatgaggggttctggaacgaaagaccttggttgttggaaagctagttgatccttacagaatgttgcttattcttatagaatgttgctttaacaattgtttgtaggaagtcaaggcttcattaggtaacattttaggtagggattccacgatcttaatcaagtccgtggtaaatggccatgatttcacgtagccttgaaggagtgacgaatactttgcaatactgctatccgataactgagaagcaccgtgatctacacagtaaagatgagcagagagtagactaagtactctgtaaaaactgatccagttgtataagagcactttggtaacttgcaggttgtagatgcagggaagaaatttggaacagacggaagccagagtctccatttggaactttgaaggcgttgagtctagctgtgagggataataaagtaacaacactagatggtagtattctgcaaggaaccacaatttggaattgctggaggccagttgatctttggaatattcggtgatgacttcgtcataccgatcaactaatcctctgagctctgtgacaagttcagaaccaccagacttggaaagaccatgaatctttttcaaaacctttccttccaggactctcagtgaagttattcttatgaactgttcgtggtctatcattggaatattgatgtaagcatcctctagtgcaacaggttgaatcagggagaatgaaatcagtctatcaagattgtaacaactccaaaataatcgctggctatattcagagtcaccagagttgcggtttaggttcatcaacagagaattcctagtggtcattccaatcaaattccaagacagtgatggatccctctcgaggcaggtatacaacgtgattagaattagaatctcagtgattggtagggtatctttagatatgagattttccttggaaatcagctccaaggcattttcccgggcacttgtgcccaatttgtgttcttcaaaagaaagcatgttatgttgggagtgagagaggaaagttgctccaatggcgacaactagattaaacttgcaaaccaaatttttatcgtttgccagcgtgtaatgagagttagcttcacttgacttgatgtcgtcgcaagtaatgaaggtgccagcctgctcctgaaagctctggaaggcttcgaaatactttgtagtcaagtgaacaggaataattgagtagcttgatccgtttgaggaaatattgaaagaattggacaacaacttacattggagtacatccaatgaacttgagaatttgagggtatctatagggggcaggtgaatacgagtgggataaggcgacgtagccttctcttctggcccgaacgtgttattcaactttttgtctgtgctactaagcacataatttggttcctccctaggcctgaaggtggcgggagagagagaggaagctttcacgcttggcgatgccattgactgagttctgcgtttcttcctctcagtatatctacagtaagtgccagacattgtgcaagttgcacattctgggaactctctggaacatttcttcttcagcttgcgacacttgacacaggaataccttttggattctccaatcgaagaatcatagattggaacttccaaggacgagcgattcttcactctaaatttggttacaccgaatggtttcggaacgctagcgactattgactccgtcatctataatagagccatggaatagagttttttctttccgacacaaaagccccaattcagggacatccactaggcctttataacagtaatactgtgtaacgatatgatgtcatattaatgagtgatgaaatatgtggcatctatctaatgattacatgtatataatcttcgcgcacactgatccgaacccgtttccgtttctcgcctagcttatcgtgacatataaccgtgtgggcttacataaggatgtggagtagagggtgaattactctcgggtaaagacatactattaaactataaaaagctaggaccagcctgcctacctcaagtttcgtttaagcttgagcgaatctcgttttctttgagatgtaacgttgtataacgggtccaaatcaagatctaatgggtctttcagtgcagaaacacttccagcattgataacgttactgagcgaagacttcctagtggtattcggaggcttggtagtgcctgcagatagagtgttgttcccaaaataggagcccttttcgtggaaaggtgattgaagaactggaactccatccgagcttcctgtaaatattggactcgcaaattgagggctagtggttgaaggcacgttaaatggaacagacaatacctgaggctggattcttccctgacccgcgcttgcaattccagtcacattgctagacgttgtcgagttgttcgatcgctccttcctttcaaaactgaactcgtccacaaatgagcctgctccttgagaagaagaggggggagtaaccatcgtgaatcctgcattactcttcttgtttttataaaactgtggggagacgctatcaaccaacgaatctgtactagagattgttcttgaattgagattactgtgtagccacgaaggctttccacgttgcattttaggcgcctgtgttgtgcttgaggtcgatgcattagatgagaatgatgatcctgcagagaagggggcttgtgaagtttgagggaaattaattgaacaggccgaattttgccgggatagactgtattgagagtccgcgtccatgtttcggttacagaaatctagtaaccgtttacggatgatagcaagtaccacagatggctccctagtggaaaacaattcatggtttattgcgggatttctgtccaatgggatcttatctttcagacatctatcaaaaacgtccttagacaccattgaaatgacccctccgggaggaaacctaatgttaaagggagtagtttctggattcattgagtagctcatgtaaatttcagatagaagcatgtcaaaacgttcttcaaattcgatattgttaatcaatggctctgtttcagccattatcgatgaggccatggaggagactgaagagcactttgtaaggggaaacggcctctcaatatcgtccaaatccattccatcgttctgataacttgggtgctctttggaaatccctatcgatatcgcagacgcgtttctgctaccgttgtagggagtttgaaacccactatctaagcccggatcaccagctgtagaaggaaagaaactacttcctccagcgtgattggggggatttgaaggtgtctgtagtgtctgttcaacaggagtcttgaaagagtcaaccccgatcgccttctggttgttattaatatggatgtgaagctgtggttttagcgtcttcatgttgaatgagtgataaccactaaacgaggtgaacaatgaaaattagccaaaaagaggggaggaaaaaagtcacttggcttcaaatttgcaatttatcagagcaagagtcaaaatgtgatgctgacagctggatagaaatgttctctacaccggttagaagtgggtatgaagtaaaaatagtggcaagaggaagggattagggaacactttaaaatcgcgtctttttcgcacaaagcaatgtgacacgacatattaaattattcttagcctgattaggaaataatccataaaactccgagattacacagtgccagggaaagacagctccatttcgcagtacgaaaggggttaggggtatggtatgcatacagaaggtcaggtcatgttgcttttcatttctatttacagagagtttcttttcgtcgatcgtttacaaatctttttttcctgtatgacttctctttctggcacaattgggccgactcgggtgctaggccattcacttggtaatattccagcttttttaaaaagcctgataatggtgggcgttggctgggcaccaacggaaagccaatacttggatttttgaaagtcgagttgtatgtcttttgtcggaaccagtccttgaagcttttgttctggagatagagggggagcaatggggttgtaggtgcctatgacttcaatcggttgtgaatctcttgcagatcttgctttcgccaccaccacgttgtagacaggttgtctttttctgccaaatctggccaatcttattctgacgctgcccttcattgcgtttattcagtgatgctgaggttgtttagtaggagaaaaattttggggtcaaatattgtgcagtgcacgttaagacgttggatcttatgccctcggatatcatgtgactctctgttctcctatttcttttccaagagcttaaaaaaatttattagaaaaatttctaaaacctttcccttctctgataccgtttgcctaaactcctgattcacagtcatcaagatatccactacactcatgacgtcagactatgatcctgaattagaggcgaaactggccaagatcagggttcatgccagctcaaaattggaaaatcagaagcacatggccctgattctatcggctgttgaagaaaacattcaagagcagaataatccaagaactgcggtaacatactttgtatccttcatgtctttattggacaggtgtattcaagatgatatcatcactgataatgctttggctctatctacagcatacttcctggatcttttggcacctctgaccccaaaatctttgttgaaatccaattttgcagagatcttaaccaagattgcccctgctataacaaatgaacaagctgaagctccattgattagatcttccattggtgttttagaaacgttgttgttgtctcaagacctggcttcttggaagaacgcatctagcatgaatatttccccaaagagaggtttgatgggattgttggagttaacccttgactcaagacctaaggttagaagaagagcacaggaggctataagcaagatattatctaatcctcctccggggccatcagtagaacatccgggttccttagattgtgcagactttgcaacaaacaaattaatagagacaatgagacttcaaaagtccaagcgaaagtcagaagatagatccgccaactctgcagtcattcactgccttcaattgatttcacaaatcacaaacacaaactcgtggccaaatgttagaattgaattggtctgtgatctattacttgaagttgccaaatcatcagatcaatttctcatcaccaatgcctttcaagcctttgaaaacctcttcaactcaatgtctgaagatgaattgagtatcgacaaatttgactcggtaatcaagattattttggatttgaaaccttctgtgaatgatacccatctcgctgctccttggttggctgttgtcgcaaaagcttctactgcatattctaatgccaatcaaaccagatttattaagaaatttccaatcttcgttcagacaataatccagttcttttcttctgagtctgagaacatctgcatttcaacatcccaatgccttatagccatcatcactgagggaatccacgatgattctttattaattccctcaaaacagttccctatctctcctaagttgtacgaaagtgttgatgaatccattactcaattggctgaggctgtcaactccctattgtctgttaagtacaaccattgtttaagtgacattttgaacctaattagttgcatttttatcaagttgagatctagagccaatccagactttcttaactgtttggagattgtgggtgcctggagatctgacgaacagaacttccaatacattcaggaggctgacaatgtcattgggagcgcaattggtgctttgggccccgaagctgtactcagtgtattaccattgaatcttgacagccccaagaagacaggaagagcttggttactgcctttacttagggacaatgtcagaaacgccaatctttcctacttcaaaacccaacttgctccgctgatcaagtttttcgaacaaaagattgcctcttccacaggtgattcagtacatgcaaaaatctttgccactataattgatcaaatttggtcgctgctaccacatttctgtgatttgccaactgatatgccaactgaatttgacgatgagtttgcttcagagctagcgtctttgatgtactccaaggtggagttgcgtgtcactatttgccaggcattcaagtccttagtcgagtccaatctggtctacagttctggtgctctttctgaagacaaacttcttcaacaacagtttcctaaggagtccgcagctgccaacattgaagtactatccaagatgagctctaaactcctttctgttcttttcaatgtgttcagtcaaacagttccagaattacgaggattcatcttagaaactattgagccttatctgcaaatttcttcgcaagatgatttggttgattcgttcaaaaaggtctgtttacatttaaatcaagctcttgaggaagataagaaaaacattacacaagcccaacttgacggaaagaagcttccgaaccagaaactctccacaggcgaaattccaagattgagtgttactatgatggatttgattgtcgttatggttaagtacattccagaatcttcatacaatgccctcctgtccatctttaatcaaacggttgcaattgacgattctttgattcagaaacgatcttaccgcatcatcgctaggctactagaaactgaatctggaaaaaacgcagtagaacaatttttgccacaaatcgaatctttgtttattgacagtgctgaaacaactcacattcccgccaaagctgctagatttcaagctttgcttcgtttgatcccaatattaccagatgaccatctttacttcattccatccatactctcagaagtaattatcactatcaaagatcccaaagaaaggtcgaggctattagcttatgatgtactgaaagctatggcttttaggatgcaaaaaggcggtgttgtgataacatccaaagttcctggaatggatccagacactccaaacacacaagcatccctttcagagtatttcacaatgtgttcagctggtctcgctggttcaactgcccacatgattggagctaccatcaacgccattagttacttgttttacgagtttcgtaatgatatggatagagatcttctcaatgaagtctcatctacagtggaattgttcttgacctccaagaacagagaaattgtcaacgctacgttaggatttgtaaaagtatccatcctcacacttcctagtgatgttgtcaaagaaaatcttccaaacttgttggccaatttgatgaggtggtctcatgaacacaggggaaacttcaaaacgaaagtgaagcatatggttgagagactaatcagaaagtttggcgccgacttagttgaacaggcaattccagaagaagacaggaaactgattgccaacattaagaagaccaagagacgagaaaagaggaaggcagtggaaggagacaatgagccagaaaagtccaaggcaaagagtaagactggattcacctctgcattcgaagatgccatttacaatgattcggaagattcagaagatgatggtgatgaagacgaacccagtaacggaaaaagccgacagtatatcacagaatccaaggatgagcctctggatcttttggatcaacaaaccttggctcgcatctcctcctccaagcctaaaaagttcagcaagaaagaccttgctgccaaagcaggctttcgtaccaatcaagaaggaaaattcgtcattaacaataaaattgatgatgacctcctggataacaaggcttctggaatcgacgcttacgttgaggctgtaagaaatggacctgtcaagggacagagaaataaactcaagtatttgagaggtaagaaggctaacaatgatgaggactttggtgatgagagtgatgaagaaccagcagctacgaagaagaatatgtttaacaagattagaaagcccaagcaaaagttcaaggccggtagaaaattatagcgtatgactttttttgtaacttagtcggtgcagttgtaatatagaatttatatatttagacgaatctttaatttttgtcgattatcgtcttcatcattgtgttcttcgtaatcaaaatcgggagtcgtttgttctggttgattttcattgccatattcgtcatttttgttgtgttcattgttgcggtcaccatcatcctcatcctggtcttcggaatcttcattctcctcttcgtatgaatcatcgtcttcctcatcgtcactattaatataaggaaggtattgcattaatttgtctggagttggaccagtgataatgaaatcgtaattggttgcatatttgtctgtggaaccatttccatttactccgttttttctctgcacatcctccaatacatttgaaatatacggctgcaacacggaatttttcagtttagaatcatgtgcttggtttctcttgagttccactctgagattgaatcttatccagtcttcatctagagggaaatcaccggtattatctatttgttcttcctgcttcttaaaactgttcatgtattcagggattctgtttttggacctgaactgtgtgctggggtctaaactctcattgacttccgctatgtattgtttgcttggcctggccacttgccttgccctatctgggtacgggccgatgaaccagctttcaaagttttgaataccttgaaggttatctggagacacatcatatggatctaataggttacaaggtgtaattatcttgagctctgttagcgcttcagagatatcttgtatctggacatcatccagggattctccacgactggcagtatatttcgcagttttttccaaaagaaggcctaaaaaccggattgtggtatctgtcagtgcatcaataacggtattggagcatctatcaaacccttgtgactttaaaagctttatagagttagaattggggcaagatgtataataaaaagttagtacttacctgtattatcgttattcgaagatagctgaaataaaagctggatttaggcattgagcttagcttctatctgaatattttttatctctttataacttgatttgctgccttagtacgccagatatttcactatgctcatagcagaatgatcggccctgcccaccaagttagaatccttattttttgatctggtacactcatcgacaagtctctcctctgctcttcgcgcgtcttctccgtcccgcgtccaaacaggacacatcaaaacttacccaactaactaaacaagttccttgcaaaatgactacggatgtgtctctttatacggtggatagtgtgataatactggataacaccggaaacagggttttggtaaaatatagcaatcctccccacgccccagaggactcagactcccttgcacagagacccaaacagcaggtccagtttgaaaagtctctctttcagaagacacacaaggtaaacggtgatatcgttctctttgaaaataaaaccgtggtgtacaaagaattttcagacgttgtcatctacattgttggaggtttaaatgaaaatgaatgcttcttgttcaatgtgcttcaaggacttgttggagcattggagatagtcctcaagtactctattgataaaaagacaatccaagaaaactacgatatggtatcattagcagttgacgaaacaatagacgatggaattgttttggagactgatccttctgtcattgctgctagagtttccaaggcaccaactgaggaaaactccataaagatcgatctgagtgaagaagggctgttcaatgcgttcaaatttgctagatccagggttgctgatcgtctacaacaggggttttaataaaataaggtttaaatgattatgtgtgcataaaatatatactgacagctagaaagtaaagcaagttcgatcgatcgctttagttcttcttcttgccctttgatttcgtcttaccgctactgctacctccctttttgtcttgagagccgggaaatactaccttcagcttactaactgtaatgggcattaaaagatcctgctgtccaatggtagagataatttcttctttgtcaaaccaatcttcttcatctttggcaaactgttgtgtaagctttttgaaatattcgacaacatcagtaactgattttcctttcttattgtttcccggttgtacttttactttgtactttagtttattaagggaggaccatggtgcaaaaactggtacagcatcaacgatggtgtctgttttctttggtgaactaatcaccgttgataaaacctgggtgtagtgtagttcagggacaacttcttcatcatctggtgactcaaactcttctagaagttttcttaattggtgcaactcagcaagttttttcttttgcactttcgatgctgatgaagactgttgagcggtattggttgaattcgactttgacggctgtctttcgatatcctcttgggcttgcacttgtttcaaagtacccaaaagctccattcgttttaatttatcttcttcatcttgatccgcatatttctgtttgatctttttgagttttgctcttctaccgcgtttaacttgagtctggttctcattgatatccaagccttccaacgaactaacaatgcttttgctgtcttcttctgcattatcaaccgaaggctccttatcattttgaatctgtttcttttccagttccttttcatatttggataaagaggcaatcatggttttcaattcttcgatctttttcttcttaaaagcattaacatccacactttccaaaccaagttcttcagttctggactgactcttcgataaataatcatcatttgttctcttgtctccaagccacaacattccaaatcccatgaccatttgacagggaggcaagaactgcttctctgttgtaatattcacaagtccaggcgctaaagcagatccatccacatctctcttggaaacagaagatccagtcacaatccatggagaagacaccattttgttttcccaagcctttgtagttgatagggagaatgctccagcctgaataaaagtgttcggagcaacatccttgttcaaaaatggattcttaacgataactttcagcgcaccctccagctcgttgctgacaagaaaatcgttatcattgtcaaaatattcaaagtagatgtgatcaaattgttggtcatcacgtccagcaacacagagaaaaccatcactggaaataaaccaaaaatatttctcaaaccaaaacttgtctctgatttgtctgagagctgcattggaattattgacctgggaagattcggttttcttctgttttttcaaatctctattgatttttgattcggcgctcttgattgccaactcactattcttctcagtcttgacaagtttatcctgtgcaatcttcttggcatcaaagtaagtcgaagcattggcataggccgataaagaaagatctatattcacattaatggttttgtcctttttcctgctatgttttgttgatgattgtttcttgttcttagtctcttgttcgtcgcttgagctgctatcttcgctatcgctttcatcctctgaatcagattcatcttcttcttccgatgattcatcgaaattaaccaacggtagagctaatgatattttattctctagcaaattcaacggtaggttgattaacttcgctatctcattaccacgtttcttttccacaccaattaacttttcaatatgattccaatccatttgctggtcaagtaaactctggacagcggctttgcattgttcaacaacatcgctataaaccataatcacctcacctttctgtatattaagaagctgagcttcagtcaatttggcaatcttttcaaggttttctgattttacagactgtagtctcctttcagcattgactttttgctgttgttctttcaacgagtgtttagaaacctcaattgtagtgaaaaagtcatcaatcgttttgttataacctttgatggtctttatctgggtatcggaagatctcttgtgggttggctcataaggatgaaactcatcatagatgtactccagagagccctcagtcgatggatcatgaattgggttccttttactgacaatatatccatcaacatcttcctttctagtcaacaattcagagagacgaatttccgcctcagctaatgattctaacagtttagccaatgaatcttcacttctgtagagagtactatccgatgttggatcgattcccttctccctaagaacgatatggatcaaatcagacgaaagatgtggcgcattgacaaataaaagcttttgaattgtgtatggtttcattgttttaccagtctttttagcttgttcaattttgaagtcctgtgtatccaaccattgaattatatcttcctttgagtaagacttgatggcatgatcggccggtgcctcactaaataattttttggcatcaaacatgttataaaattcacctgtagcatatttttcgttattttccttttcagacactaatctttgcaaagtcatgattttctggtcttggtcaagaaggataacgttaccaccgctgaaaaattccaaaaccaagtagtacattccgtcactgaattcaaaaacaaccagtctatcatcgccaacttgtttcagattagtcaatctttttgctttcaggtgctttctaagtttaactacgaaattagaaggttgctgagttgtgggtcgctggaagtcagtaagatgaagctttactccactttcaactaccaagcttttcttggagtctggaatggcaaatttgaacaaatacgatttattgttgttaatcatactgtatatgttttgtagccgataaccctttatggaatgactaagctcagagacgatgagcttgagatccaaagctgaaatacgttgctgatcgagttagtaaaagccctaaaaaaattcatgattcattgggcaccagggatggctgccgatcagatatgtgctgcttaccttcattataagtttactatggtacagatctcgttaaaagtggcaaacaggatggacttggtcctttggttgagagtactacacaacatcttaacaccaaaataaggatatgatgatcaattggaaggaaaagaaggatttcagttgcatttttggcagtcaatcactatatttttcaattgagatgatcaaggcagatcaagcaagtgaaaactgagcagaaaacctgccactaacttgaactgatgcaaaaggggacttcatacctctcagattaggtaacatctttcaggatcgcggtacatactaactgctcaagtagataagatttagcctagagttttaggaaagcaacagaacaatggaagaagcgttgcaaccattggttgaaagattgaaaaaaggaaatgtcaagatatcgttaatgacaggagctggtatctcaactggagctggtattccagacttcagatctccaaaaacaggactatatcataatttggcacgtttgaatcttccccatcctgaagcggtatttgagatcaactacttcagagaaaaccctcatgctttttacacattggctgacgaactttaccctgggagatttttacctacgaaattccattttcttatcagactattgcaagacaagaagctgttaagaagggtgtacacacagaatatcgatgctctggagagattgtccggtgttttagatgattacatagtggaggcacatggctcttttgccagaaaccattgtattgattgtcacaaaccaatgtcgattgcagatctgagaaaagatatgaaggataaatctctaaaggggatcccaacatgtcgtcattgcaagggttatgtgaagcctgatattgtgttttttggcgaatctcttccccgtaggttttttgatttgtgggaggaagaaattgaggaatatgacgttgcaattgtcgcaggaacaagtttaacggtatttccatttgctatgttaccttctgaggtaagcaaagattgccttagagtccttatcaacaaagataaatgtggtacatttgaaactgatccaagggactctgatgtggtaatccaagacgaatgtgataaagttgcagaacttctggtggatttactgggttggagagatgagtttgatcaattagttgaggaagctacgaagaaacataaagagaatagattaggattagggttagacgaaacccaagcactttctgaaaagttggccaaagaaattgagcaggatatccaaacaaacactgaacccagagatgaagagaatgacatttctgatatagtagaggagattaacgaattagtcatatcttcagagtccaaaccttcaaaggactctgagtctaaccatgactctgagcctgagataacagatgaatgaaagatgtttttgtttagttgactataagttaattttttatattaatttgcactctgtccttcactaaactttagtttggtgccaacttatgatttaaaaagccagacaattttaattccccaaacagacctctaattttgcccgaataatgccaattaacattctagaaacttcgattaactatatatttcataaaccatgacctttttccgccaatatcctcatatttcagcctaaggaagactctcctccttttagcctacaacgaacttgccccataaatacaccaagcgcgaccctcgttcatcgtttaactcgtgttttcttctcacctttcgaactagtagaaatcaaatgtccaaagaagtagcagctaagaacaaagtgaagttccttgcgttctttccagacctcgtgtttgagctggaagtcatgctggaaaattacggcatgcctgctgatgcaatcaactggttcaagagatccttgaactacaacactcctggtggaaaactcaacagaggtatctctgttgtcgacacctatgtcattctcaaggggtacaagtcatgggacgagttaagtgccgaagagttcaagaaagctgctattttaggatggtgtgtcgaattgctacaagcctacttcctggtcgctgatgatatgatggatcagtcaatcaccagaagaggccaaccttgttggtacaaggttgaaaatgtaggaaacattgccattaacgactctttcatgctagaaggtgctatctataaaattttacgcaagtacttcaagaaagaatcttattatgctgacttgttggatctgctccatgaggtaactttccaaactgagttaggccaattgttggatttgatcaccgctccagaagaccacgtcgatctttccaagtttaccccagccaagcattcttttattgtcatttttaaaactgcttattactcgttctacctgccagttgtgatggcaatgtacctgagcggtattacccatgaaaaagatctacaacaggctgagcacatcttgattccgctaggtgaatacttccagattcaagatgactaccttgattgttttggtaaaccagaagacattggaaagatcggaactgacatccaggataataagtgttcttgggtcatcaaccaagctttgaggttggctagccccgaacagagacagatattggatgaaaactatggacgcaaagatgccgacaaggaagccaaatgtaaagaagttttcgaccagctcgacattgccgggaagtacaaggcttatgaggagaacatcggcaaagaattgcagaagagaatcgctgacacagaagaagacaggggattcaagaaggaagtcttccaagttttctttgacaagatctacaagagaaccaaataatctcaagactggagactcgctctttatagaaatagatatagccttttactattaattccattttagtcatgctgtgttatattttgtagacatgatataatcactgtatattttcaactttgatgtgcccttaaacgttaacacgctcaagctcctctctacctgccttggtgtacaggtattcattgtagtctctagcttgagcccacacgttccaaacgatgatacctggaataatcacatacaaagcctgagctttggttcttctccaaacgttgaaaatggctctttccgatgatcctttcaaaggagatccgacgtaaggggagatggtgtaggtagtgacgttcttttgcttgggggatccaatgaatccccaccagcccatgtaagcacctggatgtcctgccattcttaatgtagttttagggtaagtagatggtagtagaatttcccgtattatattcgaggccatctgattggtgataattccgttctgaaatattcgcagggaaacttaggttggtagcagtgatacctgtaactaccttgcagagataatcaccagctaataaagtatggccttggccctttcgcatagagaatggtcaagacgtacagaactatgagggcccaacactgtttccattactcgtcactaagattgctccacacagttagatttgacagtattgttattacataatctttccacatttactcactacacagaacatctcacctcactgggcatcgcgcgcgtgggtcaatatcaagtggagaagaccaaaaactttccttatctacttagttctctagaccatctaattatggcaggatccaagttgacattcgcaaaagatcttgatatcccactgaaatcaaaacctacaattgcatccactgtcaactatactcctatcaaaccttctttagtgccctacaacaagaataatagctttaccacactctcaacagaggacagaaaccccgcagagctggcagacatagatccaaataatgccaacggcaacaatcaaaagatcctttatggagggttcacagagaaagactcaaagattgaggatgataaggatggtgactatacgagcgtcaactattaccacggatcctcttccataaagggtatggaagacgaatatgttcctaattatgagttcaatcaggatattctcaagaattggtttagttctcaagatctggcaaatgagaatgttgaaaagaagagaaaccttgaggatgatgtgttgaaagaacttcattctcaggcaattccaataagtgtcccgaagaaccacaagaagagagatatggaaaagaaagttgacgcaaagaagattgatgaatggaatgaaccagtggacattgacaaattatctcaattgattgggtcacctccaagagattttgatgaaaagattttgaacgaaataccatttaacttccaagaattctcattttctgaaaggaagaagtttttgaccaagataattccctccgaactgcgtaataatgactataaaaaccatttgacaaagctcatcaaagcaaagttcaagtccaaaggtaacaacttgtcctcctccagctcattatcatcgaaaaaggcatcgccagcgatgttatttctcaacaacatgtcttccaaagttagggttaccatggataagaacgggctgccttccaggactgacctttcaaacgaaccagtgccccccaatagtaacagacttggttctgtagtgatgggatacaaactcggtaatgtcattggtttcggagcatggggaaccgtcagagaatgctgtaagtatactggagttgccagcattgccgattccacgactacatcacgggcagcttcctatgctccgagccgaaggagttctttagcgctcagttttgtattggatcccaagagccagcagtttagaagtaattattctaatccaccagcctccggatatacaaatgcgatgaaaatcacttcatgtggtagcgagtcattgatgaacgaatttctcagagagataaaagtgtgggaaaaaatgaatcatcctaatttgcttcccttgctgaactggacccaagcaaatggaaatatttttgccctgaccattaagtgttctggcggaacccttttcgatttggtagatttttggagtcattcttctcctgatcaggccgtaattcggaaatacatgatcgatatcgccaatgcattacagtacatgcatggactggactatattcatggcgatgtaaagctggagaactgtctcttggatattaccatctcttaccatgaattgacaaaggacaattgtggtaactgcatactttgtgattttggtatggcccgaagtttggaagatatcaagattgaacgcaaagtgaacgtgagaaataaggcaagcttccacattggtactcctccccgaagaggtagaagcaaaaccccgacgttgtctttgggaagaacactttccagcaaggaggttgtatcagaactatcaagtcagcttcaaaagatcaaagaccaacagaactattcatcttccgaaactctgacgtctgcagatacgtcacccaatgcatcgttaccaaaactgtatcgcaactctgcaagtccagaaaaatctccaagtattcatcctctgccagattgcaatattggatctcttccttatgctgcacctgaattgcttgtagaccctgactgcccacgttgttatctgagcaaagaatcggatatctggagtttgggagtgatgatatacacgatgatctctgggaaattaccatttacgaattcaagcgacgaagttttgaaagaactaattaagaaaggggatgtagattattccattgcagaatccagaggaaaagagtttactcccttagttaatattgtgaaagggtgtctcaaaggtgacccgaaagagaggtttactttgaaggagatattagatcgattgctggcaaccgatgctccttttgggtagaattaataagtatcatagaactgatcgacgagacagtcatcagacaacgaatgtaaacgaatctattttccacaccatatcccttttgaggaaggcctattatctatttatctcatctcgcgcctgataaaaaaaaaaaatttcccataattttttccttcaagaaagatttagtttcccgacagaatggtaagaagacaaagagcggctatcttgccgaataatatcattttattgcagaacttggtccgtagagatcccaagtcttatgaagaggagtttctccaacagtattctcattaccaatcgttgagagatatctaccttagtgatgctaacagtggtaatgaaggagctgatgagtttggagagctgattggattcgtcagtagcgtctgccagtgttttccacaagagactaagcaatttccatctgacttgaatagtcttctgatcaataactacaaagaacttgatgttgacttgagggagaaaataattcaatgccttgtgatgttgaggaataaagacgttataagccccgagtttttaatccagacaatatttccactactgatttcacaagaaacatctattgccaacattaagcagcttcgaaagcagatctatcagactttaatatctttacttaaagctgtaaatgtcggttccaagaaccagaaattgaacagatcaactcaagctctgctttttaatctactagaacagcaaaccactcaaggtttatgggcaacaaggctcacaagggagctgtggagaagaggtatttgggacgactctagaacagttgagattatgacccatgctgcattgcaccctgatgtgaaagtatctattgcaggtgtaaagtttttcttaggtgctgataaagaaagagacgaggcccaagactcggatgatgacgaggaacctgatttggcacaactgaagcatcaagcgcagattactaagaaaacaggaaagaaggctaagaaactagaaacagctcttaaaaccttgaagaagaaaggatccgctaaacattcagctacgtatctaaacttctcagctattcatttactcagggacccacaaggttttgcagacgaacttttctccaaacagttacagggtaaacgtgccaacaaatacagtctggaacaaaaaattgatatagtgaatctgatttctagattgattggtacccataaactaacatgtttgggaatttacacatttttattaaaattcttaactccaaagcaacaggatgtaactcaattcatggcagcagcagctcaagcatctcatgacttagtgccacctgagtccattaccatagtggtcaagaagatcgcagatgagtttatcagtgatggtgttgcgacagaagtagcagcagcaggattgaacaccgtaagggaaattttagcaagagcgccattggctattgatgctgacttgctacaggatctgaccgaatacaagggctctaaagctaaatccgtaatgatggcagcaagatcgttgatcactttgtatagagaagtcgctcctgaaatgcttgccagaaaggatagaggtaaagaagcttccatgggaatgaagtctggtagcagaaaaggtcttccacaatttggtttggactctgcccttacgaacaccaatgatttggctcttttggctaaatggaaagaagaacataaggatgaagataaggtaggtgatgaatgggaagttgaggaggaagaagaagaagaatctgacgagggtgaatgggtcaacgttgacgacgacaccgaggcgaagacttctggaaagaaaagggcctacgaagatgacgactccgatctggaactctctgacgacgaacggaataccgacaagaacaaaaactcagacaaggactccaatatggatcaagttcagaaacttttgtcttctgatattttaactccagctgattttgctaaactgcatgaattgaaaacaaaagctggagtggaaaagatcatgggccaatctatttttggactcaacgagcaacatgtggactcctccaaattggttggatcaactaaatacaagcagaataaggaagagagattggctcatgtcaaggctggtcgtgatgaagatgctcatggttctagaagaggaaagagagaaggagagcattctaccactaataaagagaaggctcgtaagaagaacttcttgatgaccatccacaagagaggtgtgcaaagcaaacagaaaatggctcttcgtgataagcaaaaggttctacgagctcatatcgataagcaaaaaaagaagggtcattaaatatattttttcttaattttccagaaccccatggattagtttttgtatattagtttatccattctgaatcttcatcactaaactctaaaccgttttcaaactcttgaaacttcttctcggctatctcagattcttgcttgaccttagtaaggcctgtcaaatcctcaagataattgttttcattcagggcatctttgacaaaatcccaagttctggatttgtattcgtttaatacctgtatcgaacatgcagagcagtattcgtagttatttgcttcaagtttggaggtttcgaaattgtgaagaaaccctcggagttgttgtggtaaacatccaagaactgtggcattatcatggagtgatgcaggcgcatgactctttagagggtgttgaagaatggaaacaaatagttccgcagccaaagaactagcaagtaaggctacccctggtctggtcactgtgcacatttgatccaaagttcgatcagttgtgctatctttcggagcaatgatatcgttgcagaaatagcatcccagcctgtgagagttctcttccgcttctatgtgctcggtattaaacaagtttccatgtctcattaccaggtatgaatcaaatcccaatgcagcagtgatgcaaattttatcaaaaacgttgcaaagcacggtaggcagccacctcgtttcccttgaatccattagaaggaaaactacatcatgttcctttattagggtcactaacctttgatagtcttcatactgtcttttttcatcggtaaccgggtgtccagccataggtacttccaagttatatccttggcttgttattaacggaaaaattaatttcaatgctttggctgcagtttcggctttcggagcacctccctccaaacaatctgtaaaattgaacaacggttgtctaacagggttagagaatgaaactttaccattatcaacaaacgtaatgtgtcgaactccatatcctagcaatactctcgagacataacttcccagtgttccagcaccgagaagtagaaccttactattctttatgatatccagatcaagttcaggcatgactctccatttcatcagctttaaatttagatcaactgattggtcagccaagcgggcagggtcaaccaaagcacctatatcggccagtttggggcccaacttaccttgagcagttctctcccaccctgttgtttttggctcggaagtaagaggctcagcaagagtgatgtctaatgtaaaggatgtggtattgttgaatctgaaattgtatactttgatgttctcaaagccataataagccagcatgtacagaatatttctcaactgggtggaacatttgttgaggatgctgctggtgtcaataaacccaatgctaagctgatcgtcaggtgaaaaacttgacaattgttcaaacggtttgaattcaaggttgtcaataatgaaagcttgcttttgctcaatgggcaaacgagcatttagccactcgttaagcttactttcatacggctctatctgcgattcagttagaccactcagtttgtttactttccatctactcactaatgatgggaagccaaaccaatagatgaatttgaaccctttcaagtcgctaaaggacagaatgaaaaattgggtcaactttgagagatcttttagacacgaacggtcttgaattgatttatgcaccaccaaaccctgtgattgaagaaattcattcttgtccacctttctgaaatcctcaaccgtgtttaagttcttcagtattcctttgaccgggaactgtgcatgcgtgtaagttatattatcattgaagcttgactcatctacagataaacttgttggctggttcttcccaatgaacttaaaatcgacactgcccactatcgccttgtccgtgtcgtccagtctatatttgttgagcttcaattgggacagcttctggaagaatgacgagttcacaaatgaacttatttgcgaataggggatatccatgcttgtcatggttactgtgtgggggaaggaaccttctaaaggttagacaaatagggaaggctcgatggggcctaacgcgacatttgattctgacacgaccacgccattcctgtaaactgcttggctttcagcgtactaaaaaagggggatatctggcctgtttagaagatatcaacagcctaccagtggaaacgtctttcaagatttttgcgaaaaaaaaaacaggcttctgggaagaagatccgcaaccctatcatcagtgaatgaaaagcttattgcgcatccccgcatctttctttttactcaaccggtgtccgtgctaattgagtccgactggtagcaacaaaacttttccaacatttctaggaaacagcaattgctggagtacaaatactagtttttttccccttacctcttgccaaaatcctagccgtttcatatctcttctatctagtacatcagtagtgccggaaccaaaagttttacctctagctcgaacattcaaccttcatgagagatggcttgtaaacaacattttgaatttctctactcaagctggaaggcttatgacaattagcttgtagtattaatatgtccctgaatgaattacaggcagagccaaaggataaagaccccataattagtcaggattcagattcttctatggctgatgctatcgaggatggaaatgtgcctgaaccaggagaacgtgatagtttgtcgaggtctcgaagtaggtctgactctgaaattgaagaagaccaagctgttagagtagatggaaggaatcagaatggggagcaagtagttgaagccatcactagcgatgtggccaatgatgagcaacggctgccaaacccaataagtctaaaaaaatcaccatcagagccagtattagaagctgatatacatgtaaagcaagaaaacgaatcgcaggctgagtcggacgataaatcgcaaggaactccagaacaagaagaaccatcacaatcacagacacaacgaattacacatacagaacaagaaaatcggtcagcagaacccaagcaagagctaggaagcaagtcagagttggaagagctagagccagaactttctgtgcaaggccctaaaagtaacggaagtgcaacaaaaaagggaacaccagaagaaaaatctgtgttcagaccatctgcttcctctgacgaatccactgctgagggaacgcccattgcttcccccaaagtcactgacgatgtttcatccaagccaatctttgatgacaaggtcaacgcttcatcctcaaaggcctcaccaaagacaacaccaaaagctgctactccaaaggaatcgcacaaaccaacacctgttctggatgcagatgaagatgaaaatttggaagatgacaaaacagattatgtcaaagctgaagtagttgaaagaccgttacccgaagataaacctcagacacatactattgtcataccatcttacagcacatggtttagtttgagaagggtcagtgatatcgagaaaaagtcccttccagagtttttcaataatgttaataaacataaaacagaggccctatacataaagtacagaaactttatggtgaacacttatagaatgaatccaaatgagtacttgactgtaacagcatgtcgccgcaatctgattggagatgctggaacaattatgagagttcatcgtttcctcaacagatggggactgattaactaccaggttaacgctgagttaagacctcagaatataaaccctgtctctacagagagctacagaatagactacgatacaccgagaggtttgtttccgtttgaaacttacaaacctcctacaaaattaccagatctgactcatatcaagaaacttctacgaagtgatgacgtagaaactactaccaatgagccacccaagaagaaagtgaagctatttacagaaccagataaaaatcaaggttggaacgaagagaagttagggaaattattcgaaggaatcaaacagtacggcaacaactggaaccaaattgcccagcatgtgggtgacaagacccctgaacagtgtatattgaggtttttggaattacctatcgaagacaagtttcttgaagagaacccacaattactaggacctttgaagtatattcccagacttcccttctcccctgttgataacccggtaatgtcaacccttgcctttctcgctacgttggtcgatcattcagttgcttctgctgcttctactagagccatcagggcaattgaaaaaataattgttaataagattgagttgaaggaggataaaagtaaagaggaacctcagggtgaaactacagataaagaaactaatacgatcaagtctgaacgaaagcagtcgacggatgatacagaaaagtcaccaagaaccaatactccctctgaaataaagccaaccagtgagaaagaaaaggaagaaaacaaagaagaagtattggagaagccagctgagaatgtaaaggaaagagaggacccactagaggatataaaagatgctggtgtcaacagttttggtattgttgcttctcgagctcatgtatttgcaacttatgaggaaagagaattacacaaacatattatctctctcgtaaatcaacaaatgaagctggtggacatcaaactcgctaaagtgtcaaagctagaaaaagaattcgaattcaagaagaagaagttgaaagttcaacaggaaagaaactttttagagagaatttctttgtccaaatccacaggtcaagtccatgacaaattgatggaagcagtgaacctgttagaaaactgtgactcaagtgaaaaaatcaaaagtatccttgatgaagcaaaggagttagcgttgaaaccttcgaacatagaaacaatagttagaaagataggtgctaatgatgccaatccggatggaacgaaagatagagatgactccgtcaaacccattagtttggattctcctcagttatatagatactggtcaggttaaatacttcttcaatgtgatctaatgtaacaggatggaacttccctatgtgtgctgtattccgagtttctctgtagatggaccgttcgaattcataccgttgtcacgtaatcgcgggggtagtgtgcatcgcatcgtattggagacatctgtctgttttcttccctcacatcgaaatacaacttcaccatgactgacgctgacttccaagtagtatttgaagcgtggcaagctgtcgatctacagggtgttaagaagcttgtagatgatgaggcaaaagagattgaaagttcgaagtcttcaagtttggatcaaagaaagcagttgagttttaagacgaaggagttcaagaaattggacgatgagcgtaaattgacacaatggaggtcgttgttgaaggagtatcaaaactacattgatgatttgaccaagggaaataatcgtgttgtacagacattcttggaattgcataaagtagtggtggatttgaaggatcctacaagtactttgagcaaggagcaagagacgaataccgaattacagaaagctgtgaaaaaactttccacagaactgaggcattcagaacaacactgggcttccgagaagaaaggattggaagaaaaatttaacgtacagataaaggaaacggaagagaaaagtcttgatcagattaagacagcccaaactgaaatagtccaattgagggatgagctgaagcaaaaatcttcagaaaatgaagagcttcaagtggtgattgaaacccttgatgccaagctaaaaaagaacagccaaggacaaaataatgatgatacatactccaattatgacatgttaaatagagatttggagtccaataaactaaagatccttgaattggaaaggttgaacaactctctaaaggaggaattagcaaagaaagatgacaaagcctaccaggagagggtcaccgaactcgaaaaggagagtgtggagtatctctctaagctggaagaagaaaggttgaataaacggaacgccattaaaagtttgaaggacgaattagatcgaactaaagaagctttgaacgagaaaatagaagagtgcgcccgtttgaattctagtttagaggagaaaaatgactacgagcagattaaacaagatttaaaagtgcttaaactaatcgagttaggggaaggtgaagaggaagagttgactggaactcttgataatatattactgaacaagaacaaaaagctaagtaatgagttggttagctacagatcgaaacaagaggacatggttaattcaattcaggaactggaagagaagcttgcgttttctcaaaagcaagtagagcagttacagcagttaaaccaggatttggagaaggagactagtgtggaaaaatgggatgcaatttcaatgatttctgccaggccggacacttcaatacaggacaattcgttgattacaatggtatcacaacaaagagatcgatttaagcaaaggaacaaagatcttgaaaaagacgttagattacaattgaacaaaatttctgagcttcaaagaaaggtccaatcactttcttcagacaataatcaattatacgagagaatcaggtttttgtcatcctatgacagtaataagaatcagtccaaggagagccagtcggaagagtactacaagagaagttacgaagacaaattgcatccgatagaacaatttaggttggcagagtccaaaaggattagctctaggatttctccaatggaacggatattcatttcgcttatccgagctattctatcgaccaaactatccagatacttgtttttagcatattgcatcagcctgcacttaattgtgatgtcaatgacgatgtatgtgatgaatatccataatgatctttctccagaaattaccatcaatgagggtgccagtgtaggaggagcaaatgctggaggtattcatggaggcttgggtaacgtttgatgaataaggaccattttacactaataattatactttctaaatgacttgaacgcacgcgcatatggcctcttttaattttaagtttagatcatgaaattcgttagtagtcacgaccaagctcttgtggtcatcataattctcggttaaaagtccaataaactgcctgaattctgactttaatctagcttcacttaatcctgaaatcagttgccaatgattgaaatccactggttgattactaatgtttgttgaggttagcatgaaagaacagagggcaattatcttcaaacacaacgaatctgggaccacgtagtgctcggacatgtactgcaaaacttgatgaaatctgagcaggtatatcgttgacattttgaatccgtgtagagaagtttgactcctccgtactatttctgtgatgaaaagtctcagtgtactataatcaacacaaccacaacgacaagttgagttttccaaagaaattgaaaacaaatctgctaaggtttttgagacataagaaacgatgacgctgatcagaaagctcttttctttatatttgtaactgttgatatcattatcgtcgtagaccaggtctggtaaagcgctttcatcactagcagagctggatcccgactctgactcagcaagaaagttctttacctcagacttatttgagttattcaatttgaaggttctcgtgttttttgtgtgtgtaggttcaatagaagctgagttcgtagtaaagtaagggagttgaatacctgaggaaactaccatgaataacaatccaggctggcaataacgatgaaaaaggagtgacaattaaaagtggcagtagatgctggattgaaaatcgactttcaagtactctattcaataaagataatacttgctagtgattattaggagaagaaagaattatttcacgcataaatgtatggatcaacgcgaaaatatagatgatgagactgtgtgtcacttgggactgttcgacgtgtaagaaggtggcaaatgggatttgaagggtgtagagagaagtaaaagtgcctttctccacttggtatataacattgtaagcatattgcatctttctatggagggctagctggtagctagcactacatcatgctcttatggacaccttaagactaaatgaagttaccacatttcaggaaagttcttttgggagggcatcatcgtgacctgaatgtatcccgttttactcacacgacagctccattccgacgtctcttatttttgttgaagagtttcgccctgccatgacaccaaacctcaaagttcaaatcgagaaaatctcaaacggtcttcaaactctctcctctgataccgagcaagcgcaatgatgatgttgactccacgcgtacacctgcctttattacgtagagctggatgctcccggccgccactcacaagacctttctccttgtctccaagttgtcttcttctgtacaagaaaacgactccaccacaagagacaaaggagccacctagtgaggttaaaccagtctccaatgaagaacgtttgatgcagaacaagtactacagaagatgcccaagatttttcagaccttatataggagaattcattacttcgccagtcaagtttggagtgtcgtttgtcattctgcatgaaataacagctattgtaccattcatatcattctggtatctgatgatgaaatacgactggattcccctggacttaccacaagagtttctgacgagaggtacagagattatttccaaaaagctgaacgacatggaccaacagcgattgggatcactgttcgacaagactaaactgatcatgagtggtgccaatgcctacgcaatgaccaagatgttacttccattccgagtgcccctttgttttctgctgactccgtggtttgaacgatgggtggttaacccgataatgagactattcaagagagaaaagaagcaaggaaagaaggaactttgggaaatggatgaattgaaaaagagtcagaaaaaatctctggaaaaacccagactctgataatgtactaattcgattttgtaaataaatagagtaatagggtgctttataatgatcaagttagctcctgattgttttatactggtggattttgtcattgggtgtcaggtgtcagttgtcggctgtgacctcgtcattttgacagtttatcatttatcgcttcttcgagtactgaattcagtctgcccagccacaataaaatcacaaaatgaatcgtctttacaaccaaacgcagcagccaatgaggatggcaagcaatgacttcttttccattgggccttacagaaagcgaaaggatcaatcaagggagtctgtgcttgacaaatacaccattcttggatacatagcgtctggaacgtatggaaaggtgttcaaagccagtggaaagtcaaaggataaccagaaacaattctatgctatcaaaaagttcaaaattgacagcaaagacagtgaaattactcattatactggtatatctcaaagtgcaatcagagagatatcactttgcaaagaactaaagaacgaaaacgttatcaatttgacagagattgtgctggaaaacaaatgcatttacatgatcagtgagtttgccgaatacgatctgcttcaaattattcaccatcatagtcacccagatttgaaacccatcaacgaacaaatgctgaaatcgattttatttcagattttgcaaggtttgaactacttacatgaaaattggatcatacatagagatttgaaacctgcaaatattatggttactagtgaaggaatagtgaaaatcggtgatttaggtttggccagaaagttcaacaatttgttgcagaccttatatactggtgacaaggtcgtagtcaccatttggtatcgatctcctgagctgttgttgggagctaggcattatactccagccattgatctatgggctgttggctgtatcttggccgaattactatctttgaggccaatattcaaaggtgaggaggccaagatagataagaaacaattgcccttccaagaaaaccagctgttaaaaatcatagaaattctaggtacgccaacagtgcactcttggaaatcattgaaagattatcctgaatatcatcaattgtccaaattcaatattttccctcctaatttgtcggcatggttccattcaatgggtggtcagaataagaactgcttaggactactgtcaaaccttttgcagtatgacccggctgatcgtctgagcgctcatagcgctctaagtcatgactggttctctgagtcaccggcaataaccaagaatgtcttcaagaacactaaggtcaagtatccaatcagaaagatccaaaaggacgatgtcaatcttttgaaccagtcacaacaatactcaaacataggccagaaaagagcaatacaagatgatggtagtcgtaagagaagagcctgagaaacttatagatgaagcatagtattaggtagctgaaagggtagatataaaactttcgatgaataataaatctagtggataagttgcccccttttggtattattttttgtcgttcaaatatgactctttgaggtaacagcttctataacaatagaagatgcacctccacctccgttacagatagcagcaacaccaagcttaccaccctcctggtgcaaaacactcaacagtgtgacgacaattctagcaccagaacagcccagtgggtgaccaatggctactgctccaccgtacacattgagcttctcggttggaagattgaggatcttttggttagccaatccaacaacggagaaggcctcgttgaattcaaagaaatcaacgtcattgatatcaacaccggcatgcttcaaagcctttggaacggccaaagatggagcaatagtaaagtcttccggagctctggcagcatcaccccaacctctgattttggccaatggtatcaagttcagttctttcaacttacgttcactgaccaggataacagcggcaccaccatcattaataggggaagcgtttggagcagtgacggtaccattttccttcttgaagacagctctagcagatctcaattttggttcattaagttttgagtattcctcgtcctcagtgataacagtatctggcttaccacggaaacccttaatagtgattggggctatctcattggcgaactttccattttcatgggcagcttttgccttcttgtaggactgaacagcaaagtcatcttgtgcttctcttgacaaatcatggtcagaggcacatttctcggcatggacacccatagccaaaccatcgtacgcgtcattcaaaccgtcctttgaaacaccatcgactaaaataccgttaccaaattttagaccagcacgtgcattgggaacatagtaaggtgtgttggtcatagactcagcaccaccagcaacaacaatatcggcagttccagtcagaatggcttgagctcccaagataatagatttcaatgcagaagcacagaccttgttaacagtagtagcgactgtgtcttcacccagaccagccttgatggcaacttgtcttgctggcgcttgacccaggttggcttgaagaacgttaccaaagaagatttcttcgacggcagttggtttaatctgaggaactttctccaacgcagcaacaaccgcgtgagctccgaggtcaatacagctcagagaggacaaagatccttggaaggagccaattggggttctagcagcactaacaatgtaaacaggttcactcatgattgcgtaggggagataattaaaagacaaggagtcgtacacagtagtttattgggtatgctaataaatacgatacaaacgagcaggctggttgaaaaagcgatgggcaaacgcggggttgttgggcggacccaaggagagagtccggaaagaaactagaaggaacacatacttccgttgggggaaatagcataatgagaattctatgtaggttataggtacttatttaggcggccgattacatcgtctatctcgtcttttatcgtgctgtaactggttgtatcaatggggatgcaagacagttcaaaactgtctggaggctctgtagtgtctagttgtgatttgatcatttggggcttcataaagtggttttttctcccgctgactcgtttgtagagtacctcgggatctccatggaggaaaataacaattggatgaatatctggattaatcttggtgattgtttgaatgagcagatctctgtattttttcttaagtgcagagcatgagaggaaacaaatatcaccagaattctctttagtaaactgttggctagaataccgtgccaaagtgatgagccagggtaatctgtcttcatccgttagcggtattccagaactcatcttctcgatattagcatgtgaatggaaggaatcgccctcaatgtatacttccttctcgtctcgtagaatgtttctgtctttatagtgaagagccaactcatgggctacagtggacttccctgtgccacaggggcctccgacaataacgatatatttcatcaactgaaccggaagaagcggcattgtcctctcgatttctggcatctccccccgagagcacagaatcctggtccccaaaatagctccctgggatgtataacataaaaaaatttatatacatgagaatcttcttctattatacaattaggcgtttttctatataaatggtagtcattaatgtaaaccctcttccttaatctctttgatcttgttgaagttgatctcgtcaagaatgcgtttcgcaccttgatctatgagcttctgggccagcctttcaccgaaatcttcagcttgctcttcagtagtcacgacttcagtcattgattctgttaccgagtcacgaccgttacaactgacgactagggagttcatggtaagttccttcgtatcctcgctataaatagtggagaccccaattggcaccgagcagcctccctctagatatctcagcagtgctctctctgcaagacaacgaagggtggtggttctatgcccaatcttttcacagatatttttcatgaattggtcaccttttctgatctctactcctaatgctccttgtccgacggagtggtacatcacatcgtcgttcaaatacattgaaattctgtgttgtaagcctgtcctgattaaaccggctgctgcaaggaggagacagcagtactcggaatctggatcatctaattttcttagtctggtctgaaggtttcctctaacagatttgaatttcagatgagggaaattcttcagtagttgagccgatcttctaaccgaagacgtaccgaccacagctccctctggaaggtcggccaatgacttgtaagataaaccatcttgcacgaccaaagcgtctctagggtcttctctttcaataatgcaacccagctcaaattcgtctggtaaatgagttggcatgtctttcaacgagtgtacaatcatgtctatttggtcaaatcctcccacactctccaacaacaacatctcaagttctttggtccacaaagattttcctccaaacgtgaaaagtgctttattctggacttggtcccccagggtggacacactgaccaacttcgtctccaattcagggtattctttcaatatcaattggcggacgatttctgcctggattatagccagagcggactttcgggaccccaatttcaaggaactgcaatcaatgggtccgctctgttcgatttggttcatgttctgatagctctctagcatagctgagtgggctgtattgcctgtcgtcaaaagagttgtgcttgattggtagttttgtgatactggagataacatcttttgttcttaattgatcatgcaacacaagcaactattaaaaggtttcctttgcttaaataattacaagtcgaagtgtgtaatgaaaaaaagcaagagttttccttttaggtttttcttctgtcacccttagttcagttccagtgaaaattgatgattaataagggaagtcagaacgactgatttttctgaggttttttctttttcctgcgtaatttttgttaagattggtcttgcttatgtgaggccgttctgattggcggacgtctcgaattgaggagaggagagaggctacttcaactctaaatccggttgggacacgctcccaactgtttcattcctgtttacttattataatttcctggctatatagagaactaaaattcatccatgcttgggtagtcatttgccttggctctcttgtctgtggaaactttggacacgctccttgttttcaagggcagtggcgaccaattggtggaatgcactagtcttagcttgcgactgggtggtgtcagatcgagaaatagtaccggcatggtagtccaaatcgtcttcctctgaatcctccagattcaatgccttgaggttcttcaatctgttttgcatcttgacaatctcgatgacttgcttgaacttggatctggcattgaatccttcacgcaagttaggcagcaagtctgcgcctctgtcttctttgaggttggacgtgatccagggatgcttcaataactctttagccgtaggtctttgattttgatcaatttgaagcatgcttacaataaactgtctggcctccagggacacatccttccagtattgttcgtaaaaaatcacccatctttctgcagtgacctcctcaaggaaattgtcaaccgattctgaccgaacaggggaaaatccgcataatacggtataggtgataatacctatggaccagatatcacatggcttaccatatccaacacccaccaatacctctggagcagcatacccaaaggatccagcttggttgactataatttggtctggagtacgcaattgcttggctacaccaaagtctgccaagacaattggtgaatcttcatctctagtcagatacaatacgttctcgggcttaatgtctctgtgaacaatatctttgtcatgtatatactctgtggcactcagtatttgataaatgacacgagcagcgtcagcttctttgaattttgtcttttcaataattctatcaaacaactctccgcctgtagccaattgagttacgagaaagaacttgtccttactttcgaagaaatctttgaaacctacgatatgcttatgatggagcttgctcaagactgcaatttcgtccataatcatcttctcatttccatttagagtttttttcaagataatcttaatggcataattctctttggtagcattgtctctagcctgacgaactacaccaaatgctccggcacctagggtctttccaaacgtgtaatcctgtttcttgttgtaggaactgggctgtccttgaattctattgatgatctttgaaaaccctgcaactaacgattcgtccttcctaggagcagagtagggcattgttctaagtgtatgtcggtctgattactcaaagagcgcttgtcaacttatgatgaaggaagcaacatcttggggctttgctgattttctggagaacccttggcttcgcggtaatagtaacatgacagtctgccagagcctggcgcagtgagaaacctcaaaagtttcagacacgtccagggcgtagtcttgtagaacagggattaagttggctttggagtttgatcaccagtattggaaatgctgcagaaattccaagaccgataattttcttttacattctacatgtctgacctgcgtagccgtttactctttcatcatgcatagacagttcccccttgtagatctcaccccctactcactcactttctgccctccgcctggccaccagttttccccgtctaacaccatgccactaacagaagaacaaaaagcaaggtttcaggactttctgcaagacagcctggaattctatgtttcgaaagctttgaagcttcagccaactatacgatactacgtactagcgttggactgtaacatccaagaaaactgtgaaatttgcaccgctttgaatgacccaaaatcttttcaggacacagctgaaaaatactacgcagacagagacccagagtacttgaggacagaaataaaatacaacagtggcgatttcaacaatagttctgcaaggattgaggcactcgaccttttccccaaccaaatactggaagacagtcaatgccagtctattttgaatgaattattgaagcagatggtgatctttatggaaaatccaaaatcgagctaccattcgatccctaaaacggataactttaaagtcattgtctatgaccacgaccaggacccctccgtcgcctttcaagcccagcataaactgtaccccaaaccggaattttatctaggctaaaacccagtcgtgattacgtaataataagatcctatcgcattaattcttctctgcgcgacccttacatcatcagagcaaagcccgtctttagtaatccaaaagaaaaaaagtaaagaataaaatcttttatacctactcatacctcatgaatacgctactactattgcatccaacgatagtaacggagccgcaggcggtagaggccgcaaaggattcgttggcgcagaagttaggcaccgacaagtccaatatttcacaacatatcatcgatagagtggcaacaggccaagttagtttgcgaccttcatactacaaccatatacagtacttggcacctccagaggccaatgtgaaaaagctccctgttaaatgttatgaaattatctttgaagcactgcaatcgaacggagtttttgaaggaaccattcctcctgagtcggctacagatggtatccttcaaggttttttggtagagtcggacaccaaatgggtcaaaccaagcactttgggctctgtagtctcactgaaaagaccagctggacagaataaaaccaaatcatctgctttcaagaaagaaatgccatttttcaaaaagttatctagtccccccaccttgacagatagctcagaggctgatgaagatgaagaatcacaacttaacgaaaaactgaagggcagcaagctgatatactttgatgagtccagtgatgacgagatcattgatgaagatgagttgctgcgagacgacgatggcgcccttaaaggtccagtagttgtaccagttaaatgtgctctccctaacggaaaaagacgaaagaaggcatgcaaggactgtacatgtggtttgaaagaattggaggaaaatgagcagaatgagcgcttggacgcccaagcttccatcctgtctaaattagccacctctgccaacgctgaagcggaaaaaatcgaggaacgtcttagaagaaaacaggcaagcaaagaaggtgaagaagttaaattcactgagcaagaagtcacagagatcgactttaccatccaagggaaaacgggtggttgtggatcttgtgctttgggggatgccttccgatgcgatgggtgtccgtacttaggactaccacccttcaaaccgggccaggctatatcaattgagggactaggagcggatatttaaaggactattggttataatattattatttatttaaaaggaggtgatttattgtagacatccgaaatcgctctagccggtcgacttgccagagccaatgatttgtgtgtgctcaccattttagagctaaagaggtcactaggccaaagctaggggtggctgcacactgactacccttcatggggtgtacagcaccccctcttgtgcttggttcccttaaccgtcagattggcttacttttgacccaataagcagctactgaaacggaaatagtaacttctcgacctccgataggtccatacccgctcaaacaatttggcccttgttttacgtcccatctggggtaattagctcctgtgatgttctgtgtgatgtcagttagatttcggtaatcgtaagaccgactcagctctagtgagcgcccgcgatgtccaataaatgcgtaatctcgcgcagcttctgcgctggcccacacggaaatcaccccctcaaccccctagtttccctcccctctccttgtgaacaagaggccaaccgcaactttggactggttgcggaatttccgaagtccgggtaaactatcctctgtgtcttcctttcaacaagattggttgaacagagactaactagctacaatcatctcctaattggctacctgggggctctccaaccaacacagggcgtccgcgccccaaaaattgcagcattcagaaactttttttctttgaagaagaaattacgcaagaattttgaaatctctttcaaacttatcgtgtctggcgagaagggctccactgaactaattttcctcgttctcttttccctaacccaatctcacctgtgatttgtagtccttcaaccattacaaatgttttctagaagcgctaggcaattgggtagtgggagcatattgaggagtccacttcgttctgcgttccgtcgggctgcttctaccaccccaactactccagtcccaccaccaccccctccaattccagctactactccagtggttaagaagaagagaatcggctttttccgtttgacttggagactgacctggctatcgttgttgggtagtgctgcgtacttgacttacgaggtttacaaggaagtcaatccttctccacagatcccacaaagtcctctgaagccaaatggaaaccgtcggaaaaccgtcgtcatcttgggttccggttggggtgcaatttccactttgaaacatttggatacttccctgtacaacgtggtcgtcgtctctccaagaaactactttttgttcaccccattgcttccttccgttccgaccggaactatcgacttgaaatcgattatagaccctgtgagaactatcgccaagtcaaccccaggtgaggtgacatatttggaagctgaggctactgatatcgatattgctaagaaacaactgactatccaacattcgtcttactctgccacttctggtgttcaccacgtcactattggcggagatgaagccaagcctattgtcgcaactattgaatatgactatctggtcttcgccattggtgcacaaactgcaaccttcggaattccaggaattgagaagtatgcctactacctgaaggaaactgatgatgctgccagaatccgtcgttctctgtttgaaaccattgaagcctctcaattgcttccaaaggactccgaagagagaaaacgtttgttgtctgtcgtcgtctgtggtggaggcccaactggcgttgagttggctgccgagatcaaggactacattgatgaagacctttccagatttgtgccaggaattgagaacgaaatgtccgttactctagtcgaagcccttccaaatgttctgaacgcttttaaccacaagttaattgagtacactgagtctatttttgagaagcagcaattggaccttagagttaacaccatggtcaaaaaggttgatgacaagaacgtttacgctacagtcaagaaatctggtggtgacactgaaaatgttacaattccatatggaactttagtttgggccaccggtaatggtcctcgtcctttgacgaaagctgttgctgcccaaattgaagagcagaaaactgcaagaagaggcctgcttatcggcgaacatttgttagtcgatggcactgactccgtgtttgcccttggagattgtaccttcacgaagaacccacctaccgcccaagttgctcaccaagagggtatttatttagcatctcatttggccaaactctccaagattgacgacctcaagtatgaaattggtcagaacaccgatcctgagcaattagtccgcttgcagcgccgtttggacagaacccaagcttcgattctgcctttcaagtacactcaccaaggtgctctcgcatacattggttccgaacgtgctgttgccgatttagtttggggtgactggtccaacgtttccactggaggatcgcttacgttcctgttctggagatccgcctatgtatccatgatgttgggagttcgtaccaagattttggtcgtctctgattggatcaaggtcaaagtctttggaagagattgttccaaggaataaataatattactttattatattaacctattactgatttgattatgcttatatctgtgtgtttttctgcgtcttttctgttctcttgctctatttatttaccaccctggcaacacaaacggagatgtcgtccactttacctcccatgatgaaattatctttagcccccttattggaagaaacgtcgttgatcttctcaacgtaaggagttatagcaaaattatcgaatgcaacttctctggactctttcagtatcgaattggccaactgtcggacattttgaccttctttgaaatatttttgggcaactaattgctctagctctttttcccacaagttgtccgtaacaccgtcggagcacattactattaaatcatcttgttgtaactcaaaagttttgtaccaacatttggcagatggaagatgtctaagatcattggttccaatttgaacagggcagagtgggctggtcatttgctcctcgttcttgaaaactattttcccgtctctgaacacgaatattttgctgtcccctatgctcacaacgttcaacttcccactgtaactcagtaatgccatgataaatgtagatgatccatggcagttgtctagatccatcaggtcagtggaatggaaaaagctatcatccaaaatttgctcaatctccctttcattgatgtcatgaggccacactgagttctgatgctgaatgacaaagcggcttgtggtttctaacatcgccctggcccacagtccagcatcagcgtcctcaccttcctccaagtcactccaactagaaacgccatctgccagccctaaaagtgttggtgaaaccaacatcgcatcgtctccgcttcttattgaaagggtattaatgggagatcctggaggtcttcgctttggtaacaacgctgccaaattaccaccatcggagagatccgataaggaggagatcatcgggattctcttaccccttgaatgatgggagtaggaagagtagccgtactcaaaatgaaatatactcaggtctttcttgggctgtttttcttccctcacatggtaaacgttagtcagatcgtgatttctctttgcacgtatacgggcagctttatccatgacagcagggttcaccgggttcgtaggaggggaaggagtcgcatgggatttccaaggaagcttgccccaaaacgagtagttcctccgttgcgccctgaacaaaggaagcatggtcgacatcctgtttcggcatatcttcattttgcgactagaaggtaaacttttttattaggctaagattttattaggcactttttgtcgtttctttttctgtcacctatgacatttgatggattatgtaagcgttaatctacaaagatgagttcaaggatgaaaggtacggctggtaggaataaaaggtgctggagtctgaagggttagtaatatgttatataccaacagtttggtatttgaaaaagaattattaatgccctatataaaatacttgttgactaaaaatatagtttgttatttattttttcccaaatcgagtaaattgtttataataaaatcatctatataaaatataattttccatatcactccacttacggccaattcaagttttaagtatgtgaataagcgtagatcgtatttatgtaccgtttcttaactcctttgaacatccaataacacagccaatcttcaaccgacctacctgttccttctatcatctcgcaaacccatatgcaaaagcagctggaacaatatgtactaactgccgcacatgcttgctgcacgacagcgacaaaaaaaatactcatatgtccatttttagcggtttgttttttggccgacggttttagtcgccatccaccgccatccgccgccacccacatgcgtcatctcatcgcctctctattaagataagaataggacaatccatgcttagggcagtcaaacactatataaatacaattaccccccgtatacattttactattattctatttgactattctttcctgtcttttacctttatatccataaagtcctaggaaatgtccactactatcgataagcatcttcacgatgccaaatgtacacacaaaccgctcgagcttatcaatgaaaagccaattgactactcagctgacggcttgttcggctacggtaagattcaattgactacctacactgaagacccagaggtaaaaccaattcctttggcttggggacattcgaacccgttgagtagaggtccaatcactccttctagatacggaaacggaatgtacaaacacaatgcaattggagctcatgctgggccatactccatttatcatgcattggccgtcggttccaaacagttgaaactgaatcacaaagccgattacactaatgcccagccacctgttgatttccctcaacaaccccaatggtctggtttagagaagatcgtcgccatggatccatttggccaccttgcaccatggttgttttctgatgtatctgagaaggaaggtgtcgaaattaggcccaccatctctatcaccaaggcaaacttgcaattgaccgaattgaaagaagaggttgccaagggtaatttaaaggttgatggcgaggtatgtgttaacagtaatggtgatttgcatatcactaaacttgccgtagacccagtctggtatctgcccggagttgcaaagagattcggcatttctgaaggtactcttcgccgtgctctatttgaagataccaatggaatgtatccagaattgattactagaccagatatcaaagtgttcttaccaccaatcggaggattaaccgtttacattatgggagacccaaagtttgtttctgatccttcaaagaagttagctttgagagtacatgacgagtgctcaggttctgatgttttcggatctgacatttgtacttgtcgtccctatttgatttttggaatagttgaagccgcaaaggaggcacaaaatggcggttctggaatggtcatttactttagaaaggagggcagagcccttggagaagtaaccaagtaccttgtttacaacgcccgtaagagagggggtgacacagcagctgaatatttccacaggacagagtgcattgccggagtcaaagacatgagattccaggctttgatgcccgatatcttgcatttcttgggggtcaccaagattgatagaatgctatcaatgtccaacatgaagtatgatgcgattgtggaccaaggaattaccattaaggaaagagtccctatcccagatgagatgattccaccagattctcgagttgaaattgatgccaagattgccgctggctatttcacaaccggaaaagttatgacacaggatgagctcaagaacgtccaaggacgtacttgggagatctgattgtataaatttattaataaaaactgactgcagagtgtactaagttgtactacagttatcgtagccgaccgctccacctggactagatgacaagcgtccagtgactcttaattattgtcttctaatccgtgtacctttcagctaatattctggcgaatacatcgtcaccttgctgcctgttttacctctctccctgcttccatctttaaaccgcaatatctcgcactatctctccataatctgtccatgcatctatcaaccccttgcactaacccgtccgggggccattttcgcgacctggctgtggtcttccaaactggaaacaacttctctcccataccacaaaggtttgaggtgaaaagtcaaatttaaggtcagattgttgctattggtcgaagcatattgagcaagctgaaattttccattttgcctattgtctaattcgtccattttcctgtttagaataagtttgtccttcctttctttgaatcttactgcccaatgtcagagacaagtgcaaaagatccagagccagaggtgagcactccgaatacagaggagcctcccattattccagaacaaacccccgaactccaatttgagggagcatctgctgatgagcacgaaaacgaacaccagaacgttgctgagggtacatcgcacccggaaccttcaaccgtggcgtcttcagccaatgcccatagacggacagcgtcaacttctaccataaattcttcacagatggggaatgctacaattggttttatcaagtcctcatttgaaaagattgtaagcaaatgtcacaaaaaggatgctgacctgaaagttaaatgttctcggatcattgaaaaattgaatagtggtgacgttcctgaggtcattgagatttttgaacctttaaatctggcttgccaatcgaagacagtggacataaaggttactgcgttggactgtcttggcaagatgttcacctttaacgtgtttagtgaaccgcaaataccagaatcgtccgtgcccaaggacatgctccagtactggaccaatattctgcgaacgcaaagaaaaaatgaccaggctgctcttgaggggactgatattcaatatgaaagcggcgatacaattcctctaattgatatagccattgaaactatagcagaatgcttcgaaggtgagggaacgaacgagaaagttgaactccaagtggttaaagttctcatggcagctgtattgagtgaaaccatggctgctcatggtgctgttctcctgagggcagttaggcaaatctacaacattttcattctatcactttcacctgctaaccaaggagttgctcaggctagtctgactcagatatttaatatagtttttgaaagggtacatcgtcacgataagagcaacggtgtcgttccaagtaaatccggaagtttctcaaacgttaataatattccaacttctgatatagaatctcaggttctgcccgatgcccaagctccaaaattaaccctggagaaccttgaaaatcttacagctggtgatgaattgactgttgcagaagccaacaaagctattggagaagaaaaggaactggctgtgaaggatgcctttttgatatttagagcaatgtgcaaactttcagtcaaacccattgaagtgaacaacatcgacatgagatcgcatgaattgaggtcaaaacttctatctttacacatcatccataccattctccaagatcaccttggcgtttttttgaacaagagagtggtactgacaacttctaatcaggagcgaaacacgactttgattgatgctatcaaacaatatctttgtctttctttgtcccgcaacgctgcttctccgttggcacctatttatgaaatatctttagagattttttggattattctatccaaactgagatttgagtttaaacgtgagattgccgtttttattgatgaaatttactttccagtcttggaaatgaaggcatccgccacccaccaaaagagatacttcctagcggttatgaatcgtttgttccatgatcccaaggccgtcattgaactatacttaaattacgattgtgattcacagttgccaagtctctgtgaaggtcttattgactacctgactagattttctttaactcgcgttgagatttcgcaacaacaaaagatcaactatagagcaagtttaacacgatcacttgctgtatacagtctcaaacaatctccaatgctatccattaaaaaactaggcgccaatgttccagatccagaagcttcgtataactttccgggagagtatgcaattgtgattgaatcaattgagtgcgtggtcctggtcttgcagtcactctccacttgggttgacagtgtcgctaaacaggctgttgttgagtcggaagaggatacagctttgtctgtgaacggagcaggagaggatgaaatactgtctcaaagatctgaatccgctacccagctttctgaaacctctggaatcccccaagatcctgccaaatttgatactcagaagcaaagaaaaacagcccttttctcatgcgtcaaagcctttaactacaaaccgaagattggaattgccaaagctatcgaaagtggcttcatcaaggatgattctccccaagagattgctaagtttttactctacaccgatggtctggataaaacccagattggtgaatacttgggagaaggtgacgagaaaaacattactataatgcatgactttgttgatctcatggacttttctggattggagtttgtggaggctatgagaacgtttcttcaaaacttcaggttaccaggtgaatcacaaaaaattgatcgtttcatgttgaagtttgctgaacgatttgttttgaataatcctggaacattcgcaaatgctgatgtgccttacgttcttgcgtactctgtcatcttgctgaacactgaccagcattcagctcaagttaaaagacgaatgagtctccaagacttcattcgaaacaacgcaggtattgatgatggtcaagatctacctgaaacacttttgagcaaaatttactatgagattcaaagcaacgaaatcaagcttcagagcgaacaacaggctgctctattagctggacatattcagcccgaacctgtaactgggttattcagtttccgcaaccaagaaagggaacaatacatgcagctttccaaggaacttactttgaatactgagaaagttttcaaatcgtttgggcaagaagctccaaactctaacatcgtatactattacgcaactaaacaagccgaccatgttctttacatgtttcatacgttatggatgtcaatatttgcggggctcactcctcctttcaaagaatacgacgacgaggatacaactaagctctgcataaagggtatcaagctggcaattcatctgtcctgtacgtttgatattgagaacgctagaagttcttttgtgggtgcgttggtccaatttggtaaccttcataatgttgaagagatctctccaaaaaatgttgatgccatacacgcgttactgaacgttgcggtgacagaaggtgatcatctaagaggctcatggaaagaaattttactctccgtgtctcagattgagagaatccagttattagctcaaggaatcgattctggcgttgttccagacatctcaattgctcggatagtaaacagagcctccttggatagcgtgagaacccgtagcaccactagcacattcttctcttcgccgttcggcaaacaaaaaactctatcggagcaggcatatgaacactatcaaaaccaaaagctaaaaccaagcatagttccattgattacatctacggaactgactgttgcaatggataagatcttttctcatagttcgcagatttcaggtgatgcaattattgactttgtgaaagctctgtgtcaagtatcttcagatgagatagaatcttcagggagaagcgagagtccaagaatgttttctttgcaaaaaatggttgacgtttgttactacaatatggggcgtatacgtttccaatggtctaatctgtgggctattatgggagaaacattcaataggtttggtacacattccaacacttctattgtattttttgcattagactctttacgacaactatcaatgagattttttgacatcgaagagctggctcacttcaagtttcaaaaagaatttttgaagcccttcgaattcatcattggccataccggatctgaacaagttaaggatatgattctggattgtttgggaaatatggttcaaactaaggctgataagatccgatctggttgggaaaccatgtttgagactttgactatagcagctggagactatagcgaatcaattgtcatgaagtcatacaaattaacagcactaatcaatgaaggaaagttggacgatacattgcagcagggtacttttgagagttttgtacacacactaacagcattagccaagaatcaaaggtttcagaaaattagcttgcatgctttacaagatttgaagaaattgattaatcgagtgtcagattatacgctagacgaaaataataaggtggatgatgaagtaatggtccaactttggttcccaattcttttcggatttcatgatgttatcatgacaggagatgatttggaagtgagatccagggctctcaactacatgtttgatgctttagttcagaatggaggtcactttgacccttccttttgggataaaatctgcaatgaattgttgttccccattttcaaagttcttagtgagcattggcaggtcagccagtttgataaccaggatgatatctcagtctggttgtccaccacacttattcaagcactaagaaatatggttgcccttttcacacattactttgacactctgaatcgcatgttggatggatacttggagttgttaatctcatgtatctgtcaggagaatgatacgattgcacgaattgggagatcatgtttagaacaattgattgtgcaaaatgcgaaaaaattcacaccggagctctgggataagatcactgactgttttgaacgattgtttgatttgacactccccaaggaactgtttgacgacgccaatgtaaatttgaagaatgcaaacggagacgtcaactcaattgctgtgaatggcaaaaattcaaacaagtcaacaattgttgtcaaatgtgttttgcaattactgctgatcgaaactatggctgagctatttgatgatgatgggttctatgacgagataccgtttgagaacgtaattaggttatccaagttcttgaaccaaagttatgagtttgcaagagatttcaatgatgactacaatctacgagtccgtttcttcaacggaggggttatcgacaatgttcccaatttgctaaagcaagagacaagtgcaagcgcagtttatttcagcataatgctaagactatattgcgacgatcatatatccgaggagcagaaagaaatgattacgcagtcattacttccaatgtggattgccattgtggaaagatacaccaagctggatgatgtgacacaacagcgtaacatcagcacatggcggcctgttgtaattgagatcctacaaggattcgtagagttagatgaaaaagattttatcgccttctgtccttccatgtatgagttggtgctaggcatcttagacaagagtcttccatccgtgttccgctcggcaattaaggcattcttcagtcgtgtaggctcagtctacatttcggaaaaggaggcagagcccgcaactgagaaggccaccaagtaattagatagttctatgaaatgattaatattgtagacattacagtaagtactaagacgatatcatgacaccaccgacgtaattgtgagaacggaccaagttttacacgcctccccacaatcaccctcggtggacagcgatggacgaaaaaactgatggaaaaaaaaaaagagaaaacccaagactattaccgtattctttatttggaagttcacaagatgtccaacaacaaggtatgtacctttttacaacatcaatctttgtaatatagcagacaattgactaacttttcagaacctttttgccctattgggtaacgacgtcgaggatgaaactgagattctggtgaccaaggaactcgtcaagaagaacacctcttccaagaaggctgatgttcctcctccttctgccaacaaggaccgtgctagaaaaaaccgtcctcagcctaccggaaacgaggctgccattagagagaagaacaccaacagaattgtagagccacctgtgccagctaagcaacgttcttccaagccacgtaacgaccgtcaagacagaaccggaaagtctgacaccgcaaagaagatcaagaagggttggggagatgacaaccaggagttggagagtgagttggctggtgccgctgatgccgaggctgaggctgaagaaggtgagccacaagtctctaccaagcctgtcaagtcatatgccgattactttgccgagttgaagctttctgctgatgccttgaaggccacttccaagcgtactgctaacgccggtgctgaagacaaatggggatctggtgaggttatcgtcaaggaggccaagccccaaggcgactctgctgcttctaagaagagctccagaaagaaggagaagaaccttcttgactttgaggctactttcgccgatgctcaaccagagccaagaggaagagactcttccaacagaggccgtggtggtgcccgtggtggtgctcgtggcggagctcgtggtggtgcccgtggaaacaccagaggaaacgctcgtggaggtgctcgtggtggtgcccgtggaggtgccaatgctgccccagccaagaaagaaatcaactttgatgaaaagttccctgctctctgagttaacagcctctttgagcttgcaaaacctccagtgaaacaaattgattggctggattcccagtcaaatccgaggctatatcgagaatccgtaacccatggatagcatcatgtgtaagaagtgtagaataaacatttcggaatgtatttagtggtattgaaggttcttcgggagacaattcattcaaaacggatattggatctgaacatgtgagccttgaaattcactctgcaaatagtgtaccaaccattttcattttgtcagtggaactagaatcatcctggggacatatcgcgactttcttcagagactcgtccaccttctagctcgcgtcaccaactccctgtggctttccccctatcggaaggtaggaagcaacacttttccacgccgcttggcgtaccctcgatttgggcacatctttgtaagcaatgagcgaaattagccaatatcaactgtgtacccacagattaactttagacgttaacacttatcagtcagagcaattcaatccaaacgaacgcctttgttattttgcaaaacaagtcaacagcaaactttttataccgcaattgttggtgatattttgtgcttccaacctctgaaataatgagcgactctcgtgaagtatctccaagttatgactcaaagtctgaaactaaacacgacaaacctttcaaatcgaagcaatccaaggagcaacacgttttattgtccacttcatctcccgagggaattgccgccgctcaaaaggtgactccagctaggctggccagtttgctgatggaaaatggacctctgccaattagacacataaccgcacacctttcaaaacaaatatccgggttccagtatctttctttatcaaaacagagaagactgataatatcggcactggattccggtgatgtcgagtcaaattgtattttcgaaaaagttggctggggtcaatgggctgcgaaggttgttgatcaccaaacagcgttggagaaacttcgagctgcccagcagcaacaacagtcttccggtgaccattcagtttctaaaagagaacaacgtgaattcaaaaagaagagctcgtcaccctcttatttggataatccagcaaagggcacttcttcctcttggaatgtcagaagggagtctattacaaatccaacaaatgaccctcataatattaatttgccgctctctccccatttcggttctttgaagaactctgttgaagcaaggcaatcctccctcgatcaagcaattgaaagttccacgtcctccgatgatgacctgtacgacaatgaaaacgctattgatgaggacgacaattctgatgatgaggcggtgttttcctttgacgatgaatccaaattttcatccagggttcctatcaagcagatgatgcgtcgtcattctagtcatttgaccacgcctcgaagcgggatccacaaacctagacgatctcgcctcaactctttcaacgctaacccgattgaagcaactttagacgggaactctctggagggaggtttggatgctgctgctattccagacagttttggtatcagaagaagaccgagggcttcgttctcaaatgcttcttcgttgagccgacaatcatttcttagaaccgccctttcaccaactagaaacccaggagctgtttacagtttcaattccaacaatacctcaactgcccgacacagtacttcctctgtaaacaacatcccgaatgcccaaccaaacacccatctttctgagactgatgaagaggattgggagtcaatgggagctgcttctctccgtagaggctctgttttaactcctccgaccccctatcttattcgatctccccaaaccaacgttgcctctacagccagcaactcaaaggaggagattgccgtgatggcattaatggacttacaatctgtctgaacacagatacaacaggaaaagataaagaaaatacaaaagaaaattgggattagagattttttatatgggtttttttttgggtatttcaactgttgttactatactttttttcttttatttcattttattgttaaaatccaatttgctggtccaaatgtgtgtaattactatggtaaatcaatattatattgtttcaaaaacactcaaaaataattaactaactaaaattcactgatagcaacagctactgactggacgtcgtcatgagaaatagacaccttgacgttcttaactccagcagcagaagcagcagacttggcatccccgtgtagtacaacagttggggcacccttgctgtccctaacgatctcaatgtcctttaaagaagcaccagcacccttggactcgacacccaaagccttgaaaacagcctctttagcagaccaggttcctgcaagcgatgacttggacgatggagcagaagcgcaataagagatttcgttctcagtgaaatttctttcgatgaaagtgtgattctcattgttgatagctgaaatcagctcaacatcgacaccaacacctttaccaccagatgtgacatcgctagtcagactgctaatgacttttgcagtgtcattggctgactttccgacaaaattctgtttcgattgaacatcagcattgacgaagaccaatttgcttgggttctttttacagttgttgacacgggccaatgggtccaagtaaactggttgctcaagttcatcagtgtatggaggatcactcttagcaacaaacatggtatttctaatgatagcattgtgcatgtagcggtaggtggacttgtaacgagcttcaaccttagtcttgtactcctcaaaggtttcactatccaaagaagcaaacaagtagtctggatgaacaacgatagcttgccctcccttttgaccaaatccaaaagatgtaacagaacaagctttgataccgtcagtttgaatagatctagatggatataagacatattcaaagtcttccaaaattttgtcaacgttgtcggcgtttctattacctggaacaataccagtctgtaaaatttggatagcaccattcaacatccaagctccagcagcacccttaggatgaccagtcaaatacttctggaaaacaccaaacactgggttaccctctgatctacctaagtgttgcatcatcttattgatggtaatagactcattcttatcgttggccttggtagaagttccatggaaggaagcaacgccaagatcatcaactgtcaagttaaaagtagccaacgcaccacgcaaaggagcaattcttggatcgttcttccagaactcgttaccccattcttgttgggccatcttgacctgtttagtagcctctctataaacttcttcagtacgctcagaaacgaatgaaacggcatcaaacttagcatcagagtttgccaactcggcagcttcctctcttatgtactcaagttcgtcttcaacccattgcttgatttgatccttacgcttgtttagttgcctggtacggtacttgatatccaactttggagacttagttttcaacgacccgtggtgctcacgagcggtggttaatataccctttcctggagctggcacagatctaccaatcttgtcggttgcagtggcagtcaaggcgacaatagcatagattggtacacccatcttaattgctaactcagcgttcatgatgacttgagtacctgaaccctgggcctccataaacccattacgggttgtagtggcaggacgagacatctcctgaggggttctaccgtggtcaaactcgtcaagggagttggacgtagcgttcatattggcaaactcataagaaccttcttcttgaaagtcatcgtaaccaccgactaaacaaatctttgcctttccagacaaaatggtctcaacaccgatatcaacggattctacagcggtggcacaagcaccaacgggagtcttaatcggaccggatgaagacaaaagtaacatgttaacccaagcagacatagtgttgatgaaagattcctgcaaaatatcattctgaacaggcttgtcggaatatctgtccctgaacattcctctcaaagcactaacaccacccatacctgaaccggaacagttaccgacttcagaaacgtgaacatacttgtaaaattcatacggatcagtaataccagcagacagcaatgcctcaatggtagaaactaaagcatataaagtgacgggatcaacttgagaaattgtgtcttcagaaataccgtatcgcttagcatcccatcctgtaggaatttgtccagcaaccaatctgtcaaatctcaaagcttttggaacaaataaacgagcacccttcttgaaagtaacagtgtactcgtcagattcctcagactttaaaatatcgacagcatcctcgtgttgtagtttgtactgttgggcagtagattcatctgtgacgaaaggagccatgtcctgttcgataataacctcctggatcaattccttcttttctgggttgtaaccacggaagagctctggctcgatcaatctgataccggcatgagctaaaatctcttcttcgtatttcttcttgatatctttgtcctcaactggctcgttggttttggcgtcaatccaaccggtgtatggcttacccttcaagttaccgttgtggtacttgataaaacccatgatccaggccatttctaaacaaccttcaatggaaaattcaccaaaagcctccatttcccatcttgttctagtgttaccccaaggagatacttcaccgaaaccggtgacaacaatcactctttccaaatcaagcaagccctccaaacctggagccttgttttgaatttccttgtgagatttcaaaggtggaaactcaaacttcagatttgctcttggttcgattctggctttctggtatggggcatcagcattctctccattgacaaccctagtttcgataccagtttcaattgaaacagctcttctgacttcagaggtctcatagatctcatttctcaactgtgcagtgtattcacgcaagttctcaataaattgaagaccaccattcaaatcggctacaacaggtccattctggcacatttcagtcaactctggtgtcatcaaacccaagatgttgaaagccatttccttctgggagaaagttctgactcccaacttttcaagaccttctgcaatgatgttgttacctgacatcaaaccagtaccacgggtccaaccaatgatggcaccacagacagtaagctgttcactccatgattcagagtaccatctgttgaacaaagtttctaaacccagcttggactccgagtacaaaccgtctgaaccaaaagttccatggttgggggaaagaggaagaataatttgcgcaggtctggtgttgatagctctagtaaatttttgcttcttaacttcacctaacaatctcagtaagtttgtcaacatgattctgtgagccaattcactcttggaaccaagctcgtcaatttcaattcctgcttcaggaattgcagcaaatggaataactgcgtccaaatcccatccaagaccttcatctttgacatcacgatagatgtagtcaatcaaagcttcaacatcttgtttagaaccttggttgaacggaacgacgatcagacaagaaccagcagcaccgaatctggcatatatgtcctgatagtattctgtgaccttcttggagaatctagaggtcgtaacaataaccttggcaccacctgagatcagaccttgaagaacttcagcaccgatggatcccgcaccagcaccagtaataagaacgttcttacctttgtaagagataccattcacagcacccttttggagtccgtccaagaagagagcagacgtgtctctgtcgaagacccattcacccgaaggcaacttcttctttaagtgcagaaacggcactgtctctggtggaatgccaccagaaacagggtcaacaatagaagttttctccgatagtgaagaaatctcggcgctcctatcgctatcagatgacttagaggcaagaacagcgttaatagacttcgaaacttcgatttccttggatttttcaacaaactcgatcaaagaattgtacagtttgttgaattccagttgactctcagtagaagcctgtttattcaaagcctcatagatcttggccaagtcttcttggatagttggttgaacctctttggttaattcaccaccttgagacatttcaaagacgtattgttccaacttgcggacactctttctgttgacttccttgtaaacaatattacccttgctgtcaacttcagtgtgagggccggttgggtaagagatatctttataaactggatcttggttggcaacttggatacagttgtcgatcaactgttggccaagagacttagccagttgataggtctcacctttgtattctggacaatggtcaatgtggtattgcatgaacttgattaatgtagggttggaacggttcatcaattgaatacattgtgaaacggtctctctgtcaacatcggtcaacttaccaaagataatgtcaaagtacatggataaagcatcttgtctagcccagttccagtaggagtcgtaagttctggctttcagatgagaaaatacaggcttaataccttgagcataaatttcaccatgctcttctgcccacaaatcgagctcttgttgcaaaaggctggaagcttctttctccttgacgagagatttctctcccttagtaaggtcgtatttgagatacctggcaagaacctctaattgttgtctggcaagaactctgttgtccttggtaagttcttcgaaggcctcagcatcgataaccgcaccaccggcgccagacgatccagcaccaccagcggcagcttgagccaaagtaataccggcaccagaagcgtacttttgagcacatgagtccaagaattccttggcttcaccatcagaggacaaacgagcaccaggttcgttgacaagagcgactaagaggactgagtcctgtcttccagggcccaaaccccacctggtttggaggtactttcttgcaacggaaagagaaaatccaccaggcatcttggaagacatcaatctattaaccaaagaaccggtctgtttacccaaacttcctgggaaagtgcttggaattgttcggccaactcttgcaaaggagtgtcttctggtttttctggagtcgagccaaactctttacccaagtcaccaagaatttcattctgaacagtggacttaccaccgaccaaatccttgatggcctttgacaatggcacagcgtccaaagacttcttcagtttgtgggctaccaaaacgtgcaataccagagcagctttaactggttcgtcaggaatttcagcaacaggtccagagggagcggcagcaggagctgcggaaacaggggcagcagcagctggagcagaagaggaagtagcagcggcagaagtttctgcctcttccttgattggaggagcaatatctgccgggtcaggagtgtagtagatctccttggtgtcctttgcgtagcacaaaacttgtctttgcaaagacagagcagcatcataagactcatacttggccttgatcgttctggaggccattccagccaaagttggcgaaggaccgatctcaacgactctctcagtgttgtagtccttgaggaaaacgtcttgggtttcaatccatctgacaggagaggcaaactggtaggccagcagctcagtcagaagaacgtgggaaagttcttgttctacttctggacgcattgggtgtgttaaaagtagattattccttgtaatatggtttgcgtgggattatgctatcaaatatatcctaaaaaaatataggtctctacgcctactccgaactggacgcgttgggaagctggctgttatgttgggtctgttgaaaggttggtgagcgcgcgcgcaaaagttggatgttagatggatgatcgatgttagatggcaaaaagtcactacaaagcgtgcactgctcagaaaaaaaataatgggagactggacacatataaaaagaacacttttttggctctctttccctttcttccccttacaggactttttaggattcagtagagtcctattgcggtcctgattcttccaatgcattgattgtttcccttttcttataaggggatcatgtctttttttcaacggctctgttctcttcacagatttcagctctatgccgacgagattacctttgtattggtaaattgatcttaggattactccacctggcgataatggacttcccaagtcatcgctggactaaatcaccttcctacatttttgtgccacactttttaagaaaattgttcttgattttgtaattatacaacgtattctacctctctttcttctaattttaccgttgtttttttctagctaccatccactgtctttacttttgccattctatcttccccagtttccgacaccgaatcccagaccaaggatcagtgcaagaatacagatgataaggacacagatccagaagcagatacacttctttctccgtgcctttttagcactagtcaaggccttatcggtgtggccgactgctttttcaatgtcctgctgggcagtgtctaccaagttctcggtctcttgaacgtgttgatcctgctcaactaccatctcctccatgtcatggaacagttgagtaagttcagccatagtcttttctaacctttgcaactctctgtgacgagattgaacttcttgaagcgccgtctttgcctctcctctcctattagcgttcagcaaagccgttgagaacacctgctggccacccaagtcgtcgatagcatctctgacctcttcaggggaggcatcgggcttaacgacacgatattgcctttcggcttggactcgctgctgttctctgtagttgctttcaataatacggtagtcctgaatagcttgaagaaaacgttgtcgactggtctcagcttgtcccaccttagccgagtcgccaatagccagctgttgagcgttcttaatcttggactttaacgataattgcaaagaggaggattcactgattagggagtctagctgtcgtttcaaagagttctcctggtctgggttgacttcattcacgagttgggtttgtttttgctcaataatcttcactagttcttcgtagttgtccaaattggcgttgatgtcagcaatttcgttcataaacttgacaaaatcgtcgttgttgccccccttgtacgagggcagctcgtaagactggttctgctcatacggattatactggttactcatttgatgcgattccgaacagaaagtagataaattaacggattgacacaaaaaaagtggcaggtttcatagagactttgcttcgggaggatattcgcggtaggcggcgcagtgcctgctggaaggagcggattgcctggggccagaactagggtcgtaccgtcgtttaagtatttatctatatctgtctgttatctttaaggtgagagatttgctgtagaaggctttccaaaccatcaactaagttttcatcgtaattttgtcctggaacaaatgtcgagtgtgcaaagtccactaaagccaatttgctgagcgggcaattctcccgaaggaggtgttcatcgtcagggtcgttgtggtcctcctcttcctgatcgtcttcgtaaatctccctctggaaaactatgctgtcttggttatctttcttcttccaccgggctgaatcgttctcaaaaatgattagtaggctcccggatataacccgtatttcctcctcgagcaagcagttatacagcaattgtaacctagtctctgtattggagagaataatattcctcaactcctctggcagctcattatgatggaaaaaaagatccagcccttcaaggatcgagtctacgtctagtgctcttccaaaccatttatcgaacttgagatactcaaccttgtgcgcgtcttggtaagttgtgacgtagtcggaccatttctcgtggacttctttacgggtctttttgatgtccattccacatattcgaaaacctaggctaccactagtagtagaatcactgactttacccagtctctcctttttatcatctgtggcatcatcatcatatagtttgactcccaatttgatatccaatactgagggctggctaaagccaaacaataggttctccaacaagatgtactgtttatctgaagaaggttgcacagaggccttcttctccaactcagcagctacaggagcgccttgagatttcaagtcaggtgaaattcctggggttaggactcccataaactgaggaacccagtcaatcaaaccgcttcccaatggtttatcttcagagacattagaattcagcctgctgtaaaattcgacctccttcctatttgttaacttggcgaataggcctgagtcttcagactccagcaagtccgggtgtcctgcagcctgatgtgttaaaggcacaaatttagagaggtccatatttctgtttatgttcacgtccatgccatgcaccatccggtccaggccatcagtcatcaacaggggaacttctcagataaaaaacccccacccaaatcgacgcgaaagttcatgcccccaccgtgaccccaacgtgggttatccgccgtgcgccaacttgggaggtctcaaatctgaccactaaacgtacgtcagccttgtacagttgctgaatacctttgcatacatgacaatccctcttatcacgactgcaacgaattgacgaacagcagcattgtaataatatcatgtaaattgtgaattcacggacaactaacatgtggccgtagtggctctacggtttatgcgagcgtcatcaaaatcagaattcaaactatatgaactaattaagccttgttggacaagtaaactacacctggaagctcctttccctccaacagttccaaagaagctcctcctccagtggaaacgtgggatagcttgtcagcaccaccgaacttcttagcaacggtagccgtgtcaccaccaccaacgatgacagttccaccgttctgagcgttcttgatggcagctgccaacatagacttggtaccttcagcaaacttgtcaaactcgaaaacacctggaggaccgttccagacgattgtcttagcctcagcgatggtagctgcgaacaattctctggattttggaccagcgtccaatccttgcaatccgtctggaataccagactcaaccgtggcttcaccgacctttgcatccttggagaaggcgtcggcagtgacgaagtcgactggaagaaccagtttgacattgttcttcttggctttctcaactaagccgggaactaacttggcaccagcctcgtcgaacaaagagttaccaatggcaacgttatccaaaaccttgataaaagtgaaagccattcctccaccaatgatgatggaatcgaccttgtccagcaaattgtcaatcaattgaatcttgtcagaaaccttagcaccaccaaggatggccaagaatggtctgacagggttttccagggccttagcgaagtatgtcaactccttagccatcaagaaaccagcagctctttgctccaattcaaatccaaccatggaggagtgggctctgtgagcggtaccgaaggcgtcgttaacgtagacatcggccaatgcggtcaattgctttctgaacctggcaacagcctccttgtcggccttgatcttttgaccatctttcttttgagatccttcttcttcaatgtggaaacgcaagttctccaaaagaataacctctccattggaggcagagttgacagccttctcaacctctggtccaacactatcgttcaagaaagtcaccttcttacctagtagggaggacaattcagcagcaactggttttaaagagaattttgggttgacctctccgtttggacggcctaaatgagaagccagaacgacgacctttggcttgtgatccaaaacatattggatagttggcaaagcagcaacgatacgctggttgttggtgatcttgtcaccatccagaggaacgttgaagtcgacacggatgaagacacgctttccggcaacatcgagatctttgactgaaagtttatttgaaagagacattttcgtaatcaattgggctatgctaagagattttttggcaaacaattgtggaacctattagatgctttataaggagagagggatgaactatgacgggtgacagtgatggtgtggtggtgtggttcgcggttggcgctagtccgaaagtcagaaaggcagcaattattctctagacggagctcctccgaaggaggctttattgccaggcgcgaggaaaggacggagaggactcactcatggatgagaacaattcgctgagagacccgttttctttgcaacctccgcccgtagttggaacgtttggaggcgatccttagtaggaaacacttcactattagctgaaagagcttccaagaaagaacatataatctatgtccaaaagctcaagatttatttgaggccaaaatgcgatcggcagtaaatatattcctttccgttctcgcggccaatcgcaacacgcgtttcaaaataccacaagaggtggcatcacgggatctgaccccagctgccagttattttcgctttccactcacattcctcttaccccccacctgatagcgctttgaaaccacaattaggttggacgaaaaataaacattagtagattgcttgcctcgcaggtgcctgtagaatttactcgatacggccagcttagcgcaaaacagccgagcgtctcataaccacgcacgtcgtcgaaccaaaagggctgcggcctacagcataggacacttgctcgagttagagccccagcctgagtttggagatcaggccatctgcgaatcagaatccttttgcggtttaaagactgaattaggaagtcaacatcgatggttttggcttacgacaaatactgcaccaacattctgcgattagtaagtcttggtatgtgcgtctttgaacattgaatttttgttatgtaccttaatttaaacctcggttatcatgagatttgctgctccagccaaactcagagcaggcgtgatcggctgggtaccaactttggccatgccgccgatcatcgatgcacctctatcttgccgaatatcacaatcaaacaatcaaacaatcaaacattccccttgaacaacaaaacataacaacaaacgcagcgtactggaatgtttgagggttgcggttgctatctttccccactgggaatggctgttctcgagcgatgggggtagagacacattcaaattcaaatcccaagcatttcttatttgaggaatgcataccgtgtacaggcagcatatgcacctcactgtaaaagctacaattttgaggctacaagattgtttgtgttttattgcgggcacgtaccagatgaaatatgatagaatcgcaatggaatccacattctgatacgtcaccatccttgtgtcttggattgtatttgagactaccatgctggtacgacgtaaatctgcaccattttaagcgacccacatgcaccctcaaatttgattgatgagagcatccactaaactaaaatctagggctcgcaaggagtgtttcaactggaattccatcagtggtgaaatgtgttactgaaattccttcgacgtatatttactcaaaacttctaaacttgaactcaactgttgtgctgcctagagtgaggcttggctcaagtcaagttcgtctactcatttgcccagcgtgtcgtcgagagaatgcagcctgacatatgatatacctacatagaccattcgggtactaaaatttcctagtttgagccttacacttactactgcaactgcagtgcatgcgttctttataatatagctgcaagcgttcaaaattgcgtctacatgctgtatccttccgcataatagaggtgtcgagagagcacctcgatttggagttggtattgtacattatatatgaaatttgccctttaaaacacttagttcagttaatatctcattcaaaacacttcttagctcaacttcgcttgccctttgataaagtcaactatttgaatacccaactagtgccatatcgcttatttagtaccagttttgactgctattaacaccccaacttgtttcccctcccaaagtatggtggtacccctaagtcagttcccttcgccgcccaactcaagtggcgacggctgcgagaactcaagtacagtcttttccaaggactgtgtcaagaggactgcatcgccattagaccctcaatctcaatttagagtctccccaaactcgtacactacatccacaaactattctaccccggtttcttcccacgaaactttgtcctcctcaacatccgggatctcagtgacaggcgttctgctaccatcaatagattcattagcacgctcaatctcctatacaggacgagacgctgttcctttcaacttgtccacttggactgacaagtcaacacctgttactaattcttttgtcatctctcagtatgaagacacgcgtgttcctcaatcagccaccagttctacacatccaaacatacctaaacacgccaaagagtatccgttagcaaatgggccacctgggtggtgttggaattcccattccagtatgtcgacagaccaaccaatatatccaggacaccaatatccaccaccgcttcagcagcactaccactttgcttcacccaggcaactatcaaactctagctctgggacgtcatccgttcctttccaaccaccccctgctggtcaattacaaccacaaggtaattctatgttcatacacatgccattttcgctaaatggcccaccagctgctggacagcaattgataccaccccaaggactagcctcaatacctgtcggccccggcaacaacagttccctattggttagccaaggtgcacctggcggctattctttagcttcaccagcgttgtcaccggtagatgcgaccttcgaagatcccgtcaagagactgcccaaaaagcggacaaaaactggatgtctcacttgccgtaagagacgaatcaaatgtgacgaacgcaagccgttctgtttcaactgtgaaaaaagcaaaaaggtgtgtactggttttacgcatctattcaaagatccccctagcaaatcctaccctcccagttcagatggtgcctcccctgttgccaatgaccaccctgtccccccaaggcaaaactttggtgaattgaggggcagtctgaattacatcatcaactagaagaatgcttattccttttctctactgtataatcacgacgttatgtcctttaatataagaaacgacaattaaaccactttaggtggacataatccatttctggatgctgttcgatgtgtagtgtctaaaccgatactgagatttctctttctctttctctttttttttttttttttccaccatttccttcaagaaaatacacctttcgacagatcatcataaatggtggcctctcttcacattgtcaatccgaatttggcctccgctttcagtttgcctcccaggtcaaacactttgagcgtttccatacacgcttcggctttgttacagatcctggaatcaagttacttcgaccagaataagaatggtcgtatcataggaaccctcctaggttctaggtctgaagagacaacggaggttcaagtcaaagactctttcatagtttcccacacggaggacggagacgagtttaccattgattcttctcaacgtgaatttgtcgccatccacaagaagtctagcccaagagactcagtcgtaggatggttttccattaactctaaggtcgacagctttatcggactggtccatgactttttctcaaagggtccagatagcacacacccgtaccctgccatatatttgagtatccagttatgtgacgagagcggatccttcgtagagccagttttcaaggcgtacgttgcctccccagtgggatgttatggagctctggcaagtcacttagaccttgaaaaagctggctcttttgtcttctctgaagtcccaaccaaggtcatatactctgctaacgaaaaaagtctgctggctcatttcaagaacaacgttgtggaacccaaagttccaataccacaaaacgacacaaatcaactaatttcacaactcaacaaactcgacgtttccattgaccagttaatagactacgttgacaaagtcatttcaggatctctggatagaaatgatgtgaagaatgatgagattggccgtttcctgttgaccaacttagtttcccttccaacttctccttcaaaggaagagctttcatcttccataagctctcatatccaggactcactgatgatcgactacttggcctccgccgtgaaaactcaattagatgttagctccaaattaatgaacctggtacaagatgataaataggaactcaaatacaaagcctaccattaatgactgttttatttttatactaaagtagctaaagggtgattatcaaggagtggttaacgatctattcctagcagggcactcagctcatcgatctttccaatatcggcgtataacgcttccacttctatcaacgtatcttcgttaaaaagaccacctctggtgggaactaatccttctgctgccgcctctgctaaactctgtcttcgaatccgtttcttactaacatcagcttcgacagataagccactcttctttatctttttcttagatcctgttttgaatctcagggactttactggtgccataacaacttcctgttccagtaccttgttcttcttactcttttttggtattaaagaatgtcccgccttgagtcctcgatcatccttggccatactcaatcgtctagtagtgctgttgaaatgctgtaaagaagaggaatatcttcttaaatggttggtatctttttcagcaaccacacctttgtttcggaaagcggataatggcacattgcttggattgatagaagaagctataaaagcccatcctgcgtttggagcagtttgattgctctgagttactatgttcaactgtgtattggcaaaagccttagagtcgctgtctgattcgcttatattgagtaaatcatccaggtccaatagaggaacagaaccagtctgcttcccttttggttttgtacgatccctaattgcacccttcacagaaagttctacccgtttggactttatactgtctttgttctctgatactgatcgcattgaaaacccatcaataatctcaaagggtttgccacagtccgaggtggtccaaattccaatcactggagggataggatccactttggaagatgccagaacttcttttgcaattttggtaccaatttttttattggatgttttgggaagagcttcatcttcatcagtggagttgctgctttcgttgtcatctactttttggtcatcttctagttcgtcgtcgtctgaagcaatagcatctgaggaggacgcatctccttcacctttgaaaaagtaattaaataggtaggagtcatcatcagaatcttgttcttggtctgatcccctttcgacggcagcttgaatgttgtttcgactggaaaatggaaaatcagcatagtatggatcgtcaaatcttgtttcttgctcgttttcatcgtcctcatcaccagatcggttgaaatcattgtaatcgaaaccgggatcatcctcgtaatcatcgtcgtctcgataagaacggccgtcactttctttgctatcatcggaattatcaaaaacttcttggaattcatcactttcaaagacatctcgagagtttccctgattagggttcttcttttcgtttgaaggttcataaagtaatactagttcatcgttctgtttcccaaaaaacgaagcccttcttggttgaatcgtatctatgtccttcagtgtaggagaccttggaaatgaatagttctcataatccttcagtatggcgtctgcttcttccttcagtagataatcttcgtccaagaacacgtaagaatccctctcgtcgtcgtcttcaccagttgttccatcatcatcgttattatctagtgcagtgtgtctaactcttagttccagatcgtcgttatcattttgaagagttcggattaatttcgcctcttcaaagccataatcattgtcggagttgatttcgtcctctttgaatttaggtacttcgatagtgaaaggttcatcgacagatttctctaattgctctgctccattggattgcttgggagttggtttgacttcctcaccaagatcttcatcacttaaattgtgtctatctattttcgttgacgacgctgactttgttatcttggtatgtttgctctttataatatcgggcatattgtgttcattttctgtggatttgggaacggcattattgttgaggtttttcctagccttgtgttctttggtaagttgaacataatccaattcgccgtcagacgaagaagattcgtctgaggaggaatcgctagaggatgaacccagtatagcattcacttcagcgttggtcgccttccagtattcttcatccttctcctctgacgtactggaatgcacatctgagtcgctagagttgtcagactcgtcagtagagtcaaacacaggaacattatggaaattgcttgctagatcatacctactattgttatcagatacgtcagacaaactagatgacgagtcgtctgattcctcgtcagaagctaagctaaactttctttcagctctatagttcttcttacctttgccaccaatctttcccttaccgggtaccatgccttttccctttcctcgcccttgaccctttgttcgggcagttgtggctttaaaggattccaagttcttccccccatgcgtgtggtttttcctgggagtcttggccatttttgtacacttttatcaaattatctagtgcactttctttcaattgttctactaaatattcattctgagaagcttctatcacaaatatgtactgatggctttctagtgacagtctcctgatgctctctaaaattttttttaggaaagaaaattcataatctcatcttacttgcaacaatacacgacctctatccttttaaggctaattagggcgctagagattagcctaattggaagcttagaagagcactagctcatcgtacccgcgagggatgagctccaaagtctctcaggctcctccgtactcaaatctcagtgtagcgtccccctttcccgatcaaggcgtgagaaattaatcccctccaggcaaacacacccaacccacccttccctcatctgtctgtatttggtcgtctgaattgctggatctcgtatttggctaatgctggggagattatttagtggttcaacgactggtaccctttcacaacaccaccactcccccctcagtatcaacggagtcctcttgaacaacgcatcaggtcttaacagtccttccgttcaagcaggcaaaccatcgtacgaggattcttacacaagaacactactttacggcacagctgaccgtctgaatccagtttgctccctgaatgagtttcaaaagctgttccgcgttgtcatcttccaggatgggcgggtactgaatacaaggcaagttttgtttgattcagccgttaaacaacaaacttcagtgcaaaatggagctaacaaggtgaagtttaatttgaatacaaagatgtttcataactactctgagctatcagagtacatgttcggtagtggtgtgcccatcaatgattctaccaattccatcaagttacatattcttccagacttgccatatcattccgttcacaaggtgaaattggttctaattacccgtctcttctccacgactaatagatttgacagtaactttggaaaccattctacttcaagtaccaatgcgcatgatcaggaatgggtaactcatcccaccatcgatctgtcaatcaaaggccgcggtaagcgttcaggtgccacaaattttggtattggactcatcattcccatatcgttggagaactgcttgaacactgtcatcggagataactgggaagagctaacagattacgcatgccatttgcagtttacaaccaccaataagttgcagaaaatatacaacctccagcagcttacagattcaaaagacaaagattctgccactccaaatttttcatcatttgtgctgcaaaatgatgttgggttacaccaattgtttcagcaactgatcaaattaatgtcgtacctggtgtcgacaccaagagttcttctggggttttccagcataaacagttgcactattttgaattggactcagacagtggcttattggatggatatcaaagacgggcggaacccagggatttcctctacaggtcttcaccataattacaattcacagaatatcaaatttcttgcttccttattgtccattctaataccaatgcggcacaagctactcaataaacctacagataaaaccaaaacagcgtacagagtcgttattatgtctggtaatccaatcatatcttccaagttaatttatatccttactgtgatttttgctgacacacatttattgttcattaataaggacaagcagaaggcgcctaatcaattgcccaaattcactcctccatcgtttcctaattccgatttgggcatgaaagacaatgagactagtccaattccgattcacaggagcacgactaaaagcaactcgccaaggaccacgccctcatcgatcaagattcctcaaagctttaggagaccaacagcagaagcttcttcttctgttgtcaccactaatggaattattactactgatttaggccctgggcaaagctcatccggcgagtctcaaggtatccatatcaatagctcttacaactcgcttcaaaatctctctacgtccttgtcatcgaactccgtgtcacattcatggaaacatcatggattgagtttattggaaaaatggaaagctggctataatcctgcgtctaactctttatcagttgattcacaccgacatcttccaattactccatcacccagcatggactatgaagagtatccatggtcccaacagcttactcctccaacttcacttgccgcaacgcctgctgaaacgcccttcccatctatacatagagctaaatcatttgtggacctacatggtgatgcttcaacttataataacacagtcaagtatcgactagatgatttgcctaaagttaaaagagatgcaactacagtgaagactatcatttatgatcgcaatgaatctagctccgacaggatcatgattaatacctatatcaagacacaatgtgagaagataatgaataatgatgatattaattatgccctggtggattatcctgggcattctcagccggttttagatattagtggtcaaaattttacggaatgtcttgatagtaaattgaatttgattgacgagaaaccagatatactttatgattctttcatgttcaacaagtacaacaagaatcatttttatagattacatcatgcagcactattgacgcccatatgtggatttgttgatgaatatcgaccggaattctccattcaagcctgtcccatttcacagcatctggaacagcagatcataacgagtttgaaatatgacacactaagtcggaattctcacgactcagtgttatcagaaaccatttttgtttcattgagagcccgagaaataaagagtttcaaaatctgtgatgaaggacgcctcaactctagcggagtcaagtcaccggttggggacttttcacttctcgaacaactttcaagaatgaatttcagtggaggtacttcaccaacagatcacgaacagccaaagttgaattcgaatgttgatcaccattgggacaaacttcaggtgaagacgaaagttttgtttcctcagccgttgcagactggagtgaatgctgcgtacgtcaataaaattgatagttatctaggagaagtggctagtctttacaatgatttgacacaattctctagctccttacagcgcagacctaagaagggagatgatgttcaagagaaacttaaagaagctgaaactaaaacttcaaaggaggtggaaagaataattttgaaaatgatcacttctgaggttccgtatagctattcagatatttaatgccccagataaagacgttgtttgtacagtgaaagtttactgggttgagagtgttatgttgaaatcaaactatttgtaaatcaaaagtagaaaagccttccgttccctcccccctaattcatagggtcgcaaggattaattacctcgtactcaccttccaggagcgaacgagaatgcgctcagagttttcagtatctaaaaaactacttgattaccatagggtggacttaccgctgaaaagccatcgataatgagagaaaggacagtttccgatgaagaggttgataattatggacatgccagtcacttcaagcgtaaggtccaaatatatgattatcctgcagacaagacagaagaagcgttgacaaccttcaagaccttgtcccagaactcttaccagaataaaacgttggggaatgctcataatggacgatccacagcagatgggatgtcctgtgactgtgaagagaactgggatacagtctctgggatcaacaatgcttgtggagaatattctgaatgtatcaacaggttgacttccatcgagtgtataagcgggacatgttcttgcggtgacgactgtcaaaatcaaaggttccaaaagaagcagtatgctcctatagcagtgtttgaaaccgagaaaaaagggtatggtgtacgtgcccaggctgacatcaggcaagatgcgtttatatacgagtacttgggagaagttattgatgagtcgacgtttcgcaaaagaaaggaaaactatgataaccaaggcctcgagcatttctactttatgatgcttcaaaagggtgagtttattgatgctactgctaaaggtggtcttggtagattctgcaaccattcctgccgtccaaatgcctacgtcgacaagtgggaagtcggcaataaactgaggatgggaatatttgccaaacgagaaatttacaaaggcgaagaaatttgctttgattataatgtggatagatacggggccaatccacagaaatgttattgtggcgaagataactgtattgggttccttggcggaagaacgcagactgacagtgctaatattttacctgttcctattgcagaagctctaggttcaacaaacgctcaagaacaacgatgggttcgcttaatgaaagaacaaaataaatctatcaaagcgagtgactattcaagtatcaacgaggattatgtcaactctttggagatgagaccaattgctgataaagacgaggcatccaaggtaaccagtgctttgttgaagactcaagattacattatattaagaaagttgattgagagagtaagtttgaccaaggatcccgaagtgttgaaagaaatagtcagacttcgtggttaccaatgtgtcgctaatatactcacgatgattgtgttggaccaggagcaacagcaagtcgatgtggagtcatttacgttgagtgtactcgacatgttagagagctggcccaatagctctagaaacagaatcagtagctcacaaattgaatcagtgttggagagtgttaaaactaagttgaaaaagattcaaccaatagggaagaagatcaattcattgctaaacagttggagcaaactcgaaatttcctacaagatacccaagagtcagtcagtaggagcgtcaaatgatgtggataatggtcatgctgaatcttccaccttccagttaagagatgaacaaaaggaaaataacgcagcttctaaaatctctccatttcgtatagtggataatatgttactgccagaacaatggagatgggcagtagatgagtccactggggccaattattactacaacaaatcacagaatattacgcaatgggatcttcctcctggttgtgaactattaaacattgaggtttctgaaaagaatcgtgacaagaagccacctatagataagtcaagattagaattgaaggagagacaaagaaaacaagagtacgaacgagtcaaaaaagagagagaacgcgaaaagctgaggcttcagagggaacaagaacaagaagagcagagacgtacggaaactctgaagaagattattgccaatgcggaagcaaagcaacaactgctaagtaagagattagcagacgaggagaatgaagggaaaaaacgacataaaaagagcaagaggcctaccagagaacaagaatggaataaactctttgcgacagtagtacccaatatgatcaaaaaacacgaatcgcaaattggtagagacaacctgaagcattgtgcgaaagatattgtccatcaactgagtagtaaagagataaagaaggatacgagtaagaaaccacctaaagaactgagttctgaaaagaaggctaaagtgaaggcgtttgtggggccatacatggagaagtacttggacaaatggaaggccaaacacgaaaagaaatgataacgattcattcagaatggtgcaggtggtgtacgtgaggtgccagatgctagacgttagaagtcagaagttaggcgacttgaggggttattgaaataagcgacctccacctagtatgaaggagcgtactgctcgctttctgtctactgaacgaccataaaatggttcaaggacagcgtgaagtgaaagtggtaaaacattctatgtaaaaacagcgtgacagatgcatcaatagaaatgatatattgtcacgtgctccatcacgttcgagacgcgtaattccagtttcaccttccctattgtctgataagatacgtccactaatttctgaagaaaaaaacgcgctacaaaagtaaacaaaactcgcccattttgtgtttctgtaaaaggagaaaaaaaaagattcaggtcccccctcccccaaaagcaaaccaacatccaaaattacgcgtcgttcgtgttctatccaagtcttctatcaatatttctttactggctaaagattcctttactcaagcgatgaacaacttgaccacgccaccgaagtcggtaaagagaactaaatacaacgacgtttcaggtcgcttgacgcctccaggacagagaatcaaaggttcgaagatcaccagtaccaagcttttatctcccgatttatcttcaccgccaacaacagcttcttccaaatctttacagaaaccacagcctgcaagcaaagcatccagtatgtccaagggcgagtccaaagggacagtttctttgaaacgaaataaaaagttgaaggtgccccaagaagtcgtgctgcctccaccagaacaaatgcctccagtgatagatgactctgtagatttcacaaagaagcctccttattcttatgctacgttgatcggcatggccatcctgcgagctccaggtagaaagctgactctggctcaaatctaccattggatttcgtccacgttcaggtactataagaagtcagaagttggctggcaaaactctataaggcacaatctctcattgaataaagcattcattaaaaccgaacgtgccaaagacggtaaggggtcgttttggcagattcaaaatgggtttgaatacatgtttttaagaaccaaggacgggaagattatcgacttggaggttgtgctacacgaaccgtaccaagctaaaccacttgaatctattactgacagggattctgaagattccgaatctgaagaagaggaggacgaagaagaagaggaagaggaggtggatgaaataccagatgaagagaagaggaaacacgtcactccaacaagacagggtctcaacaggatagcgtccagaaaaagaaggaggtcaacggaagcgtcaggaaataacaacacccctcagctgtttactccactaattaattggattcccaatactgagaattttcctttgccctctgcaaacactgggagtagcaacattataacacaactatccccacctttccaaaggaatcaaactcccaatcaatctttcaactctagtttcagttgcaactctaactttgatctctcaccgataaaatcatcggttacaggcccgttattagagcccaagacgccgatagccacaatcagagtctcaggaaacaacaacaactttttaacagcagcaaaacaaagtacgggtacagcaacacctaagtcaggattggtgagaacgcctttcaaaactcctaattcagccaacatcatgaaaaagatatggaattctccgtcttgcttggaagatttttatagtagtcccagcaacaaatccaattcttctaaaagtaacaactactactatggaattgatatggtttctcttttgaagagcatgaacaatccagatgaagaattggaaaggtgataaataaaaggttctggtgaattatgttgtattgtatagtatgggccaggttgccggagtggaatgatacattctagagtaaaataggaatttgtacaatagtgtttttttagtataatggatggataatttataagatacctattatgggaggaaacttgtacagattctttttatagctgtgttccagttgtcgtacgtccaatgtttggttcttttcgttactgtgaggtccagctggagaccaagctggcttacatttatgctgttgaatttgttaaccaaatcctcttcggtattcttgccggactctttgcgaagagtgtattggagagcttctagccatgaaaggatgccgtgtctggtgacaagattttcgttggttgttgtcaaacgaagcaccttagaaatgaactcttgaatctgtaagtgaatagaggagctgatgtatggagaattcatcaagttcattatccacgggaagaaaccagacagggatagcattctcagattgtcgtcgtccaaagtcatggagtagcggtaactagtcagtaaccaagtcagttggtcgtagtataatttctgctcatccacagagagcttgtgatattcatccaatttcagtaaactgattgatttgaatagaggaatctcggttgaaacaaaccaaggaccaatcaaaagatacctgtatgccttttcaaaaactggatgtgttgggtcagcaagaacaggtacaaactgtgaaatgactccgataatgaacgaggaaggtctgtcttcgccaaaatttaagaaggatgctaagatttttccaagatatagcttgaaaagatacctgtccttgaatggataaacctttctgggtagtttttcaccctcttttttattttccagtaattcaatatcatctgacaaactagtatagatggcattcaaaatggtgagagcaatcctgttacaagatgcctcatcaatggttagtgataggacaacgtattgaagaattcctgattcgacgatgtttttcacttcgatcgtatcgtcgtctttaaacaattctggattgctgagaagaagcagattgaatacttctgggtcatagattattctatcgggatcaacacttgctctcttacacaacagtattcttgtgttataaaactcctcatagtctgagatattcttcaaagagaaaatcgaatgatacatttcagggtcaaaattctctacagattcttcgactactttcttatcaagtgtcaaaactgtatctttttcacctttcgaaatcaaaggagaatagtcttgttcgtaagagaactcttgcaggtacacccaagtatcaaccaaaatacaccaagactttcccataacggactctaaatctgataatattaccttgatgaaaaggtcagaaggcctcaaggacccttgataatatgtgaggagctgctccaaaagcccactaacattggtagacgcagtcttcaagtccaaagaaatcaatttatagagtatcaatgaagagtagtattttgactcttcgtcacctgtcaagtttgatagttcaatgagctcgttattagtaaaaatttgcagtaatttgaggccttcgatagcagaatccttatctcccgcagagatcaggagaacacaatattttaacaaatttttgttattgacccattgcttgtgctgaagtatcacttgtagctgtgtattcaaaatagaaggttgaatgaatttccaaacattccattttctaaatagtccctggaacgaagtaagaaaggccagaaaattttcacccaacgtgtcattttcggcaaccttttttgtaatgtacaggaaagagttgaccaaccaagtttgcatttctttcagattgacttcagatctataggcaaaacttgcaaacgcttcactgaaaatatagttctcagtagatttgaactttttgttgtccagtgccttcaagagcacaattctatctctttctatagaaggggtaccatgattgaataaattcaaaaagtcaatgacatcaatcttcgaatcaaagaaatggagagatttggatttttcaaacatgtggaaagactcttcaatgactgtatcagcaaactctctgtcgttcaacatcgaacctaagaaaatcttgtccgatagagggagctgatcaacttggcttaatgctaaagatgaagagtatataattagtttcctagttatctccttgcaatggaaactgattgacttggtcaacaatgcaacgtactgactcttatccagcttaatcgagcctatgaacgaaatgatatgagattcataatgctcgttgactagtaaaagtaagatctcaaagggtaattgaatttctcttgaacttaattcatccaatatagcaaagacaatctcatgtcttcccttttcactaaacggagtcagaaaactaagcagtgtatctttgtcaacagaccagagggctgaggtaactagttttaccagcacattgtctttagcttcaggcattaagctggcaatccgatttccatactcttggaataggtgagcattgtttttagtacagaaattttgaaacagttcgttaaccaaaaagctaacaaagagttgccattctaagggcttctcactgacaaacaatggcccccaaaactttcgacttgtgatcctttctagtgattggggattgtccaacaagtatgtctccagcttattgaatatcaacactatgctctcgttaactttggggctagtcttctccaaattagaaattttgtaaaagaattgtactacgtcaaaatcattctttggtggaggaatctgaaagtcacccttcatattgttcaacagaactctactaccaggtgaagagtcgtcaatataatattttttcctcttgagccattttccaaagggtacattgaaatgtgtcattaaatattccagtacagaaggatcttctccattcacaacaagatagttcaaaaatgtgtatagccatgtaaatgtttcttcagatggtatcttgacaaacttccattgttccaacaatgtaacaataaatggtgaaatttgacgtttggtaacggaaaaggaaaggtcaatgtatttgtagggagtcttgatactcctggcaatagtttcgtccagcaatttgcaaacttgatcagttaaacgtgaaacagtcttcaacaatgggtatatgggattgattttgattgtgctagagtcactccttgaatcttgaaacacgatgtggttaagggtcaacgtttctaacacatgaccaactctttctgaggtagatgataacctgatcaggtgtgtaaacaacgaatggtcattgcttgcaataggattccaccatttcaaagaaaatgaagaatccaatagagtctgcaatgtcaaataatgatccaagattgcaacgtttggtgtagaacttccaaccagtggtaaatacagttcctgaggtaaactgacagcaaattcgccagttatttgagggaaaaatttcaaatatccttccaaagtcatcgtcaaggccagtagatacaattcatcaacgttgtcgggatcaattgctttgaaacatcccaaaattgtgctcaaatcaggaatcctttcaataatagtattactcagatcagagaaatccaccagaaggttggaggaactcaactgaccaaaaacagtactatacttgtggaagatagagttcaacaactgaagtgtcagataattaatgaaatttgaagggtcagtcaaacctctgattaaagactgtttggtcgtcaatagaggaacgatatgcagggataatgactcagcattagtgttgtaggtagcggtttctgggatcttaggtggtttcaggtacgacattttggtcagcattaatgtgaacccaatagcggtagaagttagtttgggtgaaaagttcccaatatgagtagacacaaaatattggaacggcaagaatatttcgtaattctgggacgccagttcaataaacaatgctagctgtttcgcatccttccaaggtttaagctgggttgccagatagtaaatcattttattgtacaatttaaaagaatgaccctcaaacttcacttcggcaccaccactcttcagagtgttctccccaagttcacaggcccagactttatcatcgtgaaaagtgacacctttagcaaaactacgaagaaattcgtacacgttttcgtctctgtccagtaatttcgccaacacggagagtacgggctcgttgattatttgtaacttggttgatttcttgaaagattcttcgtgcacaacatagtcttgaaggaattctacaaaatccttaacgacctcatcatcatccaattccaaatgtttcaaaagcctgttaaatatgtacttgttggtaagaagcagatcctttctcagatgactggaagcattcgacaatagctgtatgtaaaactgaatcatgttgtatcttgtcgtagatttgaagtcaacgtattttctctttgtagaaggctccagtagttcggtcaaatgctcattcttgaagttgaaagcttcagagaactcggtaaccaaagagccctcattgaactcaacaatgtgtgtcaataatctaagtattggagaaattaacgtaggcttaagtgtttcaaatataggataaatgtggttcatcgacttgatcaaatgtaatgcaataactctgtagaggtctatttgttccaaaaactggactcgttgcagaattttgtccaacaattctgacaactctatcagttcattgtcgttcctgacagagctgtagtaagcccagttgttgattagtatttcataattatcattcttctctaggaatgaagtaaaatgaacatctgacttggtgtcaccaagcagtttttttgcctttagagtgacttccagttgggcactagagggcttcaaaggggctgacatggtgaagagtgttagagggatcgatttaaaatttttaatagagagaaaaattatttcgtgaaatatttgagagatgagatagggataagaaaccaaaaaagggacctcaaatctcaaggagcagtattacagggagtgcacgcaagttcatacaatcataattcgttatctatacatccaggattgcttggtaacgcttctctaaaatgttttgaagtagatcattttcctcggtccaaagaagaggttcgaagccatggcaaagtccttcccactcatgaaattcaacttgtacattgttctcagtcaaatttctatgcagctgccggccgtcatcgtttaagatgtcaactgtcacggtttccaaataagttttgggaaatttggaccaatcaacattaggatcgttgaatgggaataatgatggctcatattcttctttttctgatagaagagaatcaaaggccagcttgttcattctatgagtccatgttagataaggttttttctccttaaggtcttcagaatcgggttcttcggtattgtttgagtccaacattggataaatgagaatctgcttggctattggaatgcccctttctgctgccaatgcagccacagataaagccaacccagcgcctgatgaatctcccattagaataatcttgttgggatcaatcattaggttatcacaatgttcataaaggtactgtagcgcactaaagccatcttcttgaggaattggagctggatattctggagccagtctatagtccacactcagaacaggtacgccagtcgctgagacatattgagaggtcaaatgactgtaacggctaacgtcaccggttatgtatccacccccatggaagtgaataatgcacggtagcttactggtccttacttggttaggatcagcatctttagagtagaaacggcactcaatttgatctccgtcatgagcagtgatagtaaattgcatgcctgcaacgtcagatggtttggttatcacctctttgtagtagtgttcctctatcttgtcagcatgctttctcagcgccttaagatcattctccacaggtgcgccgcccttctggttttctaagacgttctttaaactcgggttaatcgtcaaggtcatagcaataaggaagaaacagtaaaacctggaggacttaaccaccttccttatatagcctctggggaacggctagtcaaactttatcttttctaaattataattataacatagtatctatgatattatattataaataataaagatgactgtaccgttaatgatcgatttatttgtcagcaccacgaccaggcggagaagatgctttctccttgtggcctcccccactaagatgccaaccaatgcgcactatctaaagggtgctagtttctcatttttcttttcctctacaatcccatcacaatacacacagcaatgctacgactattaaatagacaaaagatagtgcctatcaacaggacttttttgaggagcctatttattcaaacacaaacgacccccaacgatgatgccctcaagtttttgccatccatgaagattttacctgagcaaaccactatagagtttcttaacggaagacaagcattcaaatcacctttagctctcaagttgtttgggatagatggagtgaaaaccatcatgataggtcacgattttatcactgtagagaagaagactcaagatgattggtctttgttgaaaccagagatatttgcagtcctcacagagtctttgaataacggtactcctgtcttgaacgaacagcaccagtcagacgcaaatgaccaggctttgctggaagaggatgacgaagatgaagtcgtcagcatggttaaagagctaatatttaccagaataagacctgccatccaggatgatggtggtgacatcgaatttgttagatttgagtacgagacaggaacagtatatctaagattaagaggagcttgcagaagttgctcttcaagttccatcaccctaaaaaatggaattgaatcaatgttgaagcattatatagaggaagttgaggcagtggaacaaattgaggaagacgaagatggaaatgaatttgaggacccgttagcagccaaaaagcctgctcaatttgaggaagcccaactgaaaccaagatctagagacgtggccccgcctccatctctgtaaaaagactgatattgtagtataggtcgtgtatatatatgtttaatggaatggtagtcatatggagacttcaggggggtggtatatacgttaagtgttcttgcatgtgttccttttggtatctcagtagtatggataatagtacattccaaccaaagacgggtcaatcaacccaccaggtgccaatgttgtttgtgttgtttgtgctgtgagaggtggcattgaggaacctgatgcggtgctaaaataatgattctgattgtaatgatggaccttaccgtccttggagttgtacttattttcgtttcttttggcaaagctcactgctatggtaaagttttctgggctgataaaggcattgttcagttgtaccattgccttagaagcgtccaatggattaacaaaacaaacaaatccgtatcctttacatgccccagtatcctcatgagtgatgactttgaaactttttatctttccgaattgactaaagatctgttttagcctctcatcagtggtagacggagggagatttttcacatacagattgcaatcctgaaactctggacctggaattggtaactctggcggagggaagttactccgggtatacagtctagcctttttcgaaatatgatggttcacgtagactttatacactctatcattgactttcgtagaaaaccctttcaggtgcattagaatctggtctgcagaggttttagtcttgtactttacaaatccgtaatcagtgactatcttggattggattatgatgccgtatttttcaaattgagtgaacaatatgtgataaacttcctttggtatctcagtagggggtaaatccttcttaatttccggaggagagtctccttccaactgactggctggatctggatttgcctctgtcacttccgacactttgaagtaaatgttccccggatgcgatatactgtggtagataatgtctatagtactttcatcaatgccaaaatcttgtatcaaggagtagtagacgtcatctatgaatccgggggctgaaatcttgaaaaacccctgatcttccttgataaccacgttttgatacttcaattgcaattcctgtatatcgatttgatcactgtagaaaataacatcacatatattcattatacaagtccaagcaacagatggtttaatggatcaccctaggtagcaattccgataaatgccctctttcgctgaatgcatataaataaatatagttttgagggggcaaacggggggatcctagaaagagaaaaaggaaaaaaaaacaagtcagactagtccgagtgccctcagcagggtcatcacctaaatgataggacagagtaaaatttagtaggataacaaaaaaaaataaagacattgaaatagaactgaaaagaaaaggacaaaaggtatggaggaatgtggtggggcatcacactatgacccacaagaccagataccgacaacctaactattttctggatcttttggtagtagtggtggaggttgttttcggttttggttttgctttcgacttcttggctgcagatgtcgttgttgctgttgtcttagatggtttactaaccttccccggtttagctgcggctgacccagtttttgttttcttagcaggagcagctttcttagttgggacttttttggcggttgtggaagaactcttctttggggcagatttcttggaaactactgttttcttagccttggttgctgctcttggggcaacgacaactttcttcttcagcactggcttggtcaccttcttaacggttttaatgtcctttttgatttcaccatctttgtttaactttacaggtccgcttggtccctttggctgtttgaagtatcctgcagcaacattacgtctaagggtgagattgaactgggaatcaaaatttgttcctactgggtagtttgccaagacgtgtttcttgattgcctgtctgctgaaagtagttagtaaaagtttggtttctgacttg

SEQ ID NO: 102 - DNA, 512752 bp, Pichia pastoris
aaaaccaagcataacaccctctgctcagatgtagagcaaacaatgtactgctctagttacccgttatacccatttctaactccacatctcttcaaaaaaacgcccgtcttgcaaccccacctaatttacttacctggatccagttctttctttcaaagaaagaatggcgttggtaatcatatccttgtaggagattttgctgtcggcgacagcctttttacttgttctagtagccatggttcaacttctttatggactatttagcaaaaacacaaacaaactagaaaaggggaatacgtgcatcttttgtatttatattcatggtattaaaacaaaacacgcgaaaatttatgttaatcattgttgcacactgtgccaaaagtgcaagaaaatttgagactctattctaggttctctaacttgcatcagtagttaactcaatcagccttggaactgcatccttctccctttacagctggatcaaatgtcaaaacatccttcagaagagtacattaatcctttggccaagaagttcaaacttcaaaacagccatctgcccgcagagaaagatcagtacgaagggctggcacttcccccaaactcggaacttttaaaaaataattcacacgaagccttgaaggcataccaaaggcttctcaaagaaaaccagactacagatgatttgataaatgcacaattggttgccctcccattaaatttaacttgtccacattacttcccagaaaatgtgcaactattaataaacactatcccgactctagacaaccttgcaacacagatactgaggatcatcgctcagggtccgtatcagaagatattagacatagtagccaatcaagatagcacgttggcggggatatcgtacaaaaacctgatagaattgttcgagatgacaaagagaatttacagtaccgaagatccgttcttgaacgttgaacatttaacttttggaatatggaaatatggctgtgagcctcccagttttttgaagggaaaagaagatagcgtggagagtactctgagaaaagtcaatttggccaccttcttgaacgcaactttgggtacgaacgatgccggtttttaccacttgaatgagtcttttctggatgtgttttgtccttctcagtctttggatccctcaaatacaatgaccaaccttaccggaaattctatttccggatatcaagaaggagagactcagagaacgtctgcaaattttgttcctggtaaactgttaaagtctcaagcaggactatacttggacttgaagacccaagcttacatttcggcattagaaatcaacgaaaggccaaaggatgagattttggaggatttatttcccgataacatggatgaaatattgttgaaaagaaagaaccctgatatggaattacagctaccaatcaacaaatccactgctttcacgccggctgagtccgatttcatatcacgagccaatattagaaaacaaaggctccaagaatcagacaatgacagtaaactagctgaaacctacgaatggttggtgttcttgaaagagttatttgactacgtctccaagaatgtcggtattttaatttggggaagaagaggacgtttagggaatctcagtcaatctttgaccactacacttcctgcctccccgatagagttaaagaaaacaacctctggtaaatccggaagtaaagaagctatattcaaggatgactccaaagatgcaacaccagtacctacatctgcatcaaagagttctactccgcttaaagccgatggagaagaagagggaaacctcaaattgcatccaaattttgagcagattacaaatgagttacttccctccgaaatccagaaacaacagatactcttgatatctcatccgaataagatacgccagggatatagaagaccctggactgaagaggaagagcgtgcactaaaacaagccctagaattaaagggaccacattggtcacaaattttagaactttttggggctggaggaaaaatttccgaagctttaaagaacagaactcaaatacaactaaaagacaaggccagaaattggaaaatgtttttcttaaaaaacaactttcctgttccttcttatttgaccaaggtcaccggcgacctagatagggatgaaaagagctctcggagaaataaatctaagaagccgagagtaaatgctaagaacatagatcctaaaacatctggcccaattaaactacagcaaggcgaacacacacaacacaataatgatactactaatactggtgataacgaggcagaaaacatgaaagctatgggtacagaagtcaataatggaaacgaggatgagagttccaatgctgttgctaatgccaatacagatacaaacaggaatagccaggaaactggaaatggtgataaacctctaaaagagaccgaggaacatactgacaaagatagtgacaatgaaccaaagaatattgttcaagataacctaaacaccaaacaggataccaccccattgagtgatacagatgtttccaagtctacagaacccacgacacagatatcgtcagaactgaaggagaaagctaccacggatactgaatttcaacacaacgcagcgattcatgaagattacgaccaattgatttcaaatatattggcccaacaagacttggaacaagttgatggacaatccatgcaagatgtcgataccgaagtggctcagatcctcaataataatagtgatcctgctgctaatcgcaccaccacgaccgagaatcaaagaagcagtgacagtgatgaaaaacaagactgagcaaattattctatgttatgttgtacttgaatggtttaatgttatatgttacactaatagaaaaaaaaagaaaactaacgttctacttcgactgtaatctcaaagcgatctccagtctcatctaaagtctgtatatcaatatccgatgattgctgaagtaattggtcaagaaaggccttcgaatcaaggttctgtggttttaagtgggtgttcttggtgacggcatcattcaggcaacttctcacaatctttgagatgtaaaaagtgaactttgattcgtcgtcttcagaagcacctggaatgctaatgctcagtagaactacaaatatcttgtagttaactttggatattataatcttgttgacggcgtatgttgacttaaaaccatcaattgaatgaatatgagacctgattgttcctatcagttgtgaataagatttggcagtgtaaggatatgatataagaatgatcctggatagcgattggataagtttccaaccaatccagagaattatcgcagaagtaaggacaatgaatccttgcataatcaattctgcgtgcactgattttttgattatcggatagaatagagagtatactccaaatgctatggataggaaatttgtagagttgttaaaagttttcctgtcatgctgaatataatggttgataactctgggggaagcaaaagcgactgcgatagataaagcaacgatcgctagatagatccaattattcatactttcggagtgatcagagtgttttgcatgctcagaatgagactcatgtaggataagggatacagccagttcttccagtatatgcgatattaggtctccaccaacaaatatcaaggatacactcaatgcaaatccaaccagaacttcaattcttcctagcccaaaggggtattttaaagttgaatgatgccaggagtcgaagtttgacattacatggaccaataccacaatgaagtttccaaaaaaatcgtaaaatagcaaatgagataggatactaaagcagatatttccataatgaacactgagtccatagactatgacatcgtaaacaaaataaaagaaacaccacaataaactgtatttttgctccttggtcaaggattcgatcagctctgttcggttgggtattggtaactgttgagggattgctaacggtgctctctttgggggttcctgaaacaagttcatcgaaatggaggagtgtttgtacttgtgtcctctcctatatttggtattcattttggaaggagcagaatcatgcttttcgaaattgaaaggctggcgaacgggcgacgtggatcggatgggggatgcgcttctggaaggaagaggagaacttgatcttggtggcaattgaggtgtaggaatgtatgcatcagtactctttgtaggagataaagtcctacttatacgggagttgttctttctgtgggatcgtctacttgaacccaatgaggcaggtgggaagttcttgagaggactctccaggttggagacgacaccacctgggttgtaaatatttatgtttgggataccattgctggaggaaatgggaggatcaaacgaggaaatatcttcctcagctttctccttcataaaatcatcatcgtcaggttgaaggattgggacacccgcgttagtgaacagcatagagttcctctgaaccggtgtggtattattcgatctgctggcgaatctgcttctggaagcttcagtaggagtttcactcatagctttcgaaggggattttccatgacacgttgtcaactgggcaacactgtatgattattgttcttaatggacctggctggttggaatgggaagcgaaacctatggtgacagggctcgccggacttggcaagatatgattatgtaatgaggtgagaaaactttccagtagtactatttctcatcctctctgggaaaaaagatgattgaagtgatttgcaatgacaggtaagtgtagctttcacgagctgtattggataagagagtattgtactaatgattgcaagattgggtaaaaaaattagggtgaaatgtcttccgagtgacacaattggtgattttaagaagctactctcactgcaaattggaacctcatgggagaagatcaccttaaagaaaggttatcaagttttcaaggatcacattactcttgaggactacgaaattaatgatgggatgaatttagagctatattattcttagaagatcaaagccttcctgacccttaggttcacaagaaatattctacctgaggagcctttctatccagctctttaggaatgccgttgaaatactcgttaaagaattggtcatcaaattcttttcttttctgtgattcttcatccagttcatctggatcttgttgatgattagacgggtcgaccattccggagcctatgaattttaagtattcttgattactgctaggagaagcatcaaatatattgaacctagaactttcgggcccattgaacgagtcgaatatctccattattgacgccatattcccacatctatagcaatagttaggtgcagaccatacggttactacctttccaccccaatgcaattgatatccctcattacagagctggtgagctctgattatcttgtcaaatttattctctgacagaaacttattaaccacatttaatccaaattgatagccagctccacgtgaagaaatttggaaattgagcaattctatatctgggtcagaccacacgagatctgccatcggtccctcgtgggggatttctttgtaccggtcgatcaccttaattgattcaatgctttgtatgttgggagagagtcctccatgaatgcaaaatatgctatcgtctattatcaccgaaagaatcaaataatcaaaagtatctgttattagttcccaaacacgagaactcccgccatacttggtgaggcattctgtataaaacccataatttagggtgatttgtctcgattcgtggtttcctcgtatcagatgaatccgactgggatatttcagttttagtatgattagtataataatagtttccacggaatgaaatcctctatcgacgtaatcaccgaggaataaatagttagtctgtggaggtgtgcccccgatcttgaaaatttcaagtaggtcatagaattgaccgtgtatatctcccactaccgtaacaggtgttctcatatgaagtacattggggtctttgatcaagagttccttaaagctaaaacacagttgctcaacaacaatttctgaaagcagctttccctcgtatgactgttccaggcattgatccaagtcaaccattatctggtgaaatagaaaggtacagtacagtagtagtactggcaacaaaaaattagattctcgaaagggctctcggaagggcaccctgtccaggctcttgatgggtgaacaagcccacttagatgattatgttgcggtcaaaaatcttggccagactcaacacattaattgacgtaaacagtgcattgtaatcggtcaatatatgtcccattaccgcagacagctcatccgtcatgttccccaccttttcttggtgtcaatcctctgaacactctcctaccctctctaagaagcttgtcctgtacgtgtctcaaacaattgcaaatctcctcagctatcaattcacaactcccttgcatagtacaccacaatcaacccttgatagtcaaatgggagactcagaagacccttcgaaaacagaacaaggtgttgtcaaagactccgggggcatagaattggtttctcctaaacagagcccgaccgagtctccaaataacagtcggaaaattgagcttacgaaagacaacagcctgatccacctaatcactgtgaatgattcaaagaactcaccagtggtcacgccaagcaacgcattgggcagtcttaatattcaccgtccaagcaacactccgggcagtccaggaaggagcaattctgctttgaacgttccaggaagaactaatacgaatccattatcaggtctgcaacggagtaggtcaagctcaagatccttgccaaagagtacaaggccttatctcagcgccaataattccaatagctccaagtacaataatgaccagtttatgcgacaggagatgttatatttacgaaaagtgaaagatgccgataacctcaaatatgattactacaacaagggaataggatctgtaaccgatgttggtgaagaagattatgatgatgaatcgggtgccgaaacggaagcggagatcgaaatggaccatcttggaataaacgaccctagtgacaagaggatgatgttacagagaaagcaaagtgcagaattgaatgaacgcttatctccctcgttagataatcagctacagcataataagagagtgtcagtattcgaaggtgagaaacagtcatcttcttcgctgtttaatatgccattcacaagcgagctattatcgaaactgaaggaagataacggaatatccctgtttaatctagctcttcctcgatccgacaacattatggacggtggcttggaaaattctctttcactagaccacaacgccatggttgagcgaatggaatggcagtcaatgttgaactcagtgcttactggcgatattgtgaaggccgaaaaaaccaaattaatagtaccagctaatgaagtcgaaggagaaagttatttgcatgcaacttataaggaaaacttgtggcttggaatacgttcaaaaatcttttgcagaactgaggccgaacagaaaaggctaatttactactctaggggtttagcagacgagacgatcaatgaaatactgcaattcaaggtccagtatcctgattcgttttcaggctcgcaaagtagaatcgctttggaacaagttactaagatactagataaatttgaatctatgggaacgctctggaggactcataaagaaatgtgcaatgagaaaccgatgtgtgcttccccagagtttgaaagcaggattaatgctcttaacgcctggaaaaatatcacagaagctggaggcaacgaagctgaagccctaaccaaatgggtgggtaacgatgaccttgatattttacgttcaggatcaagtgagtctactattcgaattcacactgacacgttacctgacgattccctggccattaagtccgacattcttagagataaccgttctttcgtagaacgtgttttgaaagaaaaagatctttctagcatttttgaaaaaagattgtttagttcagtgttgaggtggataacaaaggccaaagaatcatatttagaatttcgcaaattatttcaagacatgaatctaccctcatatatgaaaaagctactagagctggctttgtttcctgcaaatttgattaaagaacttatacgcgtgaggttgagatatgccagaaagctaaaaaacccaactctaatgatgattgatcaaatgatcgaagattttcgtctgtatattggattagcctgtgatattcgaactcaactaatggaatattgctaccctcaagaaggatgggttattgaaaatgttttagacccttcttttgatcaaacaatacttgattgtgtccattattatctcgtacttcttaacaggaaacttcttgatagttcgagatcatataagaccttcagaacttttaaagagccagaagaattggaaaaacaatggttttccttacagaatgttggtttttatgttgaagggggtggattggaaatttcaattcaattcactactttaacctccaagctagttcaccgtcttttagcatatcttcaataccaaattcaggaaggacctgttgcctctacaaaatctgaactgataaggtggtatacaactaccactgaaaattttggagcattgagaaggaaactactaagattcacaaacgttttggatttttcttttcgaaatgcttcagtctacaaactggacaattacagaaataaaaagtttctaagtcttttgaaagatactaaccatgtactagtaaggtcggagacttttgaaaagtatggaatacatctgatagttagtgaacattttattaataaaccttcagaggtgattagggttttgaaaggagctcaattgggtgttgattttcaaactattccctctaagcatttcaaagttttgcagaattatagtgaatatttcgactatatgaaggccaaggaggcttcaagtgattctgatgatgatgatgcctttgttcccagcgacggcgcacgaaaagaccagtcacctggatacgttttggtaatttgttttaccaggccaacattgtgggaaggaaaatatatggagttggatacttcatctattcctgtgattaacgttgaacctggaaacctgatgttgatctcagacatcgcctcatcaaacttgaataatactgaaaacgcatttcttgacattgctggagaatcgattggagaatttgttgaaaggaggtgttcattggacaaagtttaccatgaattcttaaggataagacggtcgttttataaaatgacttgtactctactggattcagttgctatgctcagaggcagatgcaaacgtgtttccaattcaaatgaattgatgaacactattttcatctatatgagagattttggtaacaactcactgcaaacattttctggatatagaaaacccgctttaatcatgaaactcatacagattagtattgagtggctcagttttatagtggatgagtgttctcctacagcacaaaaaacttttaagtggtcggtgttagcattggagtttgccatggaaattaccagagatttcaatattctagctgtttcggatgaagattttgtacaattaaagaacaaagttgctggatgcatgtccctcttgatatctcattttgacataatgggagcaagatctacggaaatgcaaaagaagaggataatgaactggcgtctggaaaagaacgaaaaccttgaaatgtacggtaaagatgatgccgttctgaatactatcagaaaggacatgttaacacaaatagaggagattgaaaaacatagacaccaactacaaagtgaacagcagtcggtgggccgggtgcttgatgatacagatacagataaccagtatctgacattcctttcttcatcgttttcctctgtttcaataaggtggcagaagggtaaatttattggaggtggttcttttggtagcgtttatgcatcagttaacctagatacaggtggtgtcatggctgtcaaagaaattcgattccaagacgttcagtctattagaaaggttgtgccgcaggtcaaagaagaaatgacagtactggaaatgttatcccatcctaatattgtacagtatttcggtgttgaagttcaccgagacagagtctatatttttatggagtactgtgaaggaggttcgttagctgggctattagagcacggccgtattgaagacgaaatggttattcaggtttatactttgcaaatgttggaaggtgtagcctatcttcataagtctggaattgttcatagggacattaaaccagagaatgttttactggaccatatgggagtgataaaatttgtggattttggagctgctaaggtaatagctcaagaaaggacacaggatagaagaccttcagcaacccgaaagttgaacagtttgattggaacgccgatgtacctttcaccagaagtaattttaggcaatgatcaaggtaaacatggaagtctcgatatttggtctttgggatgttgtgttcttgaaatggctactggtagaagaccatgggctaacattgataacgagtttgcaatcatgtaccagattgccagtggaaatctaccacagttccccggccctgatcaactaagtgaagctgggtgtaaatttttggctaattgtttggaaaaggatccctataaaaggctgactgcggtagagttattgaatgatccttggatcatggcaatacgtgacgaggcattaggagaaagcccttccgaggcctcttcggatcatggcgagtaatataagcggtatgaaactattaatactatattttaatctctgtctctttatcgtataattcacgaacaaatctccagtgtttggagtctgcaggtttatcatccttgtcattcctagttgaaccactgacaacattctttgtagacaagttagccaaatcagccagttttactaatggatcttccgaaccaacagtagatggattgtcaaggtcaatttctttaaaccaacgtgtaccccagttgtgacctccatcaagctctgcctttcggagttctctctggtagttttcaatcttggacttttcagtgtgtatgagatcgtagtcaccagatttaacagcttctgcaaccttagaccaggctttacgagattctaaaggatgttgctcttctaaaggtttaacttgcaacttttgggatggagtcttagtagaatcaaaaaataatttgtcctttgaagaaggagtagaagacccttctcttatgtaggaggtgttggaccattgaccggaaattgtgtatatcgcattttctttcaccttagaactagcagagtccttgtagattctggccttgaaagtgttcttttttccggaaaaatatcccctacctgagtactcgatgacagtaatgtacccattggacgattgaatgtaagattttccttccagttcaacaaaagggtttgcaacaatgattccttcgatatgtaggggaggtagtgttaccaagtattgttcatttaaattgtcatattgaatcagggcatggccgaattgcttcacacttagggaagttgggctcatggaagccttgattcggttataaccttgtaacagtgttttattcttgtcgttgataattgagtaggcagtaaccggaggatgatggctcacctgctccgataagagtattgtttctcccaatctgctatctctggtgttgtcaggccatttacctacaaatacctctcccaggaatggatttaaaggtttcttttcagtccccattgtctcgtttcttgagcagtattgacttctcaatgttgaaataaaccatttggtgacagcaacttgcctttgaagggcagcatcgggacgtttggagtcaatgaagtttggagccagcaacaaatcggtgtgttcactccaatactcgctatattccgttaaagagaccggagataagataaatggaggtgccgtaagcgaggagaggtctccattgtatgaagcgattgatttgataaacgaagtccaagaggtgctgccagctaccgacattgtgggatagttgatgctcggtaatctcccgattataaattgaggagcgactttttaatctgcgcgattgatacgaggaggttagcccggcttagaagatatctacgcagcggattggtctagcccagcgggtgtggttggtagaagtgaactaaggtctatctatatattgccttcactatttcttaactctgagcgccattctttgaaccatgctggaatggcagaatcgactatctgctgcttttcattctcgtccgtaacttccttcaaaaccaggtattgcctatttctcttagcgtaggataacttccacacttggtcgtcctttaccgattcgttcagccattcaacaactgctccgtagaaattgattgaagacatgtaacagttttccttctttggctgctcatttaaggggttgtttttgaccatcaatgggatatcattggtgctaaattcctccacggtcctcaagatgcaattgtcatcccggaagccgtaaatgatctttggaatccccagtaagaaacattgagcccaggtgcggaatagttttttttcaaatgcaatcatatccttgtattggttgatggttctagtcgtcttcagttcgatataacgggagagaggatcgttttcgtcataataatctgctgtgcagtcaacttctccgcctattaaaatcttaatacgacttattccggttctgactatggccccatattgttcaatgttattgcatttgctttttgctctactatcgatctctttcctggtacactcgggccaaggtttgggtaaagtagccattttttcgaacttgtagcctgaaaattgtagctttttatgaaactctgtgtcaccctgtttctgaacatctttgctctttaaatagggtacattgaactgaataaagagttgtccatcaaaactgactacatcaagaacaaaatcttcttctgaatcgtatggtaatgttaagagtttcctcattatacctctccaagtaatgattctatccttcgttttagccccggattctttttctatctccttcaaagccagcaaaatcggatccaatttggataactccacgctgtcgcctagtaaaaaatgcttggacccaacggataggtcaatactattatctatgtcaccgtctgggagatagtagtaagataagtttgatctatctggatgtgtcttatagttcagatcccttgaaaaataagctacttgtttgggttgccttagcatggctttcttgcttcttgctgccagaggcaagatcttttctttgctcatgaaaatggatgatgtttactagtctagggaagatgatcaatctttcagaggaaaaatagttttatcgcgagaagatggaaggaagttagggatgggggagaggtattatggctgaaatttcattaacggtgtttctttttcgatgatattagatcattctatggattgagagtcttttatttgttccactatgtatccagcttgtgcatcattttcgaaatcaaagttatagttggtaatcttaataaaaccttctgcttccaaaaacagttacctaccatattccagtgctgtaaaaagttttctgataatactggatatgccatacaagttaatggagtatccttggtgcccagttgcattctagggtcatcataactttggctttggctacttgagaatgggttgctgtcgaatgttgtcgagcaagtgaacccagaaatcaactgatacaatacacattgtaacctcctatactacaaactacggttcacccaacgactgttcgcaattgacgaacttctctctcaccaatactcttcaacatctattagataagcaacacttgataaaccccaatacccaaaaccttcctttatctcgcgaactgtctgaaataaaaaaattaatctcttactaacactcgttattatagaaccaagatatggctacgctactccctccgccttctaagaagcaaaaaagagcagctcagctgcccgtagaagttgacattattcccaaagatcttcctaatgtgttaatcaagtttcaagcatccgacacaggagactcgatcggtggtagtattagggtcccaggaaatattagtgagagacagttagaagagcttttgaacaacttacacaaaacttccgatgatccagtaccttactctttttccttgctgggcgataaggatgatctggttgatattagagacaacctgtatacttcagtgctgaaaccaggtatcaaatcaactgaagactttctcaccttagtgtacacacccagggcggtcttcaaggtcaggcccatcactcggtcatctgccaccatttcaggacatggctccaccatactgtgttcacaatttgctccacacacaagttcgaagatggtcactggtgcgggagactctacagcaagaatttgggattgtaatacccaaaccattcaacataccctcaaaggtcacaccaactgggttttatgtgtggcatggtcaccactaggggacgtaatagcaactggaagcatggacaatactgtacgattatgggatccgatttccggtaaaccaataggagatgccttgaaaggacatggcaagtgggtttccagtcttagctgggaaccaattcacctggtcaaggttggcagtaggccacgtctttgctccgggtcgaaagatggaacagttaaagtatgggatacagtggctcgtaatgcaatgtacacaatgagtggtcatagctccagtgtagcatgtgtcaaatggtctggatctggagtgatatattctggatctcatgacaagactataaaaggatggagagaaggaagatgcgtggcaactttcagagcgcatgctcattggattaaccatctagctctatccacagattttactatgagagttggtgagtttcaaccaggacccagcatgacagtcaatggcaaccctagtggggcggtcaccgaatcgtccaaggccaaagttcaagaggcttttgataaagtatccaagattggtgggcgttattctgaaaggatggtaactgccagcgatgattttaccatgtatttatgggagcctgaagtttctgataagccaatatgccgtatgacagggcaccaaaaacttgtgaaccacgtctcgttctctccagacggtagatatattgtatcggcatcttttgacaactctgtcaagctgtgggatggaagagacgggaaatttatagccactctacgtggacatgtttcaccagtttatcagacagcttggtccagtgactgtcgactattagtgagttgttccaaggacaccacattaaaagtttgggatattcgcacaaaaaaactgatggttgatcttccaggccatgcagacgaggtttacaccgttgactggagtgtagatggtaagaaggttatcagtggaggtaaagacaaaaaggttagaatctggactcattaagggtctccttacttaattcatactatttagattacgcgacatttcctatcagaaaaccaaaccgtgatgagtagaccgttcaaagtgaacattattgtggcagcgttgatacctgggcatgggattggcttaaaggggaaactaccttggtctctgaaaaatgaaatgaaatatttccgtcttctcacaacaaacacaatctcaccaacttccaaaaatgtcgttatcatgggcagaaatacgtgggaatcaattccctccagattcaggccgttacaaaacagattgaatatcgtgcttaccaggaatgccaatatttctgttgaaaatggtgctgcggttgacgactccgtgctggtggctgattccctgaagaatggattggacattatagaaaagacaggaaacatagaggaagtgttcttgataggaggagctgatctttataaccaatgccttgcatctggtcttgttgaccgtatatttttaacagaagtgaagtccttgaacggacaaattgagactgatgtgtccatcaagattgacccttcccaatggatcaagcaggagtcccaagtcctggagaaatacctccaagaccatggagtgaacggcttccagttagacgggaacaaagagggagagctagtctacgactttactttgctggagcgaagataactaatggcatactttacagtactatacttaataaacttcatgatagttcatcaaacattgcacgcttgcgccctatgtgtactcacgtgatatcttggatttttctcaaacgcagtccattgtgcgtcacatgatctagaagatttctgtcgtgcccgcgcgaaaccatctctactcttgtcaacgaaaaaaacatataatcgttcttactagcactccaacagatagataaaatggctgaggaaaacagatgtatgtactattaaatcgcaaggtgactggtaaatgatgaagatgatcggcttaatgagaagaataattgaaaacatagccagaaagttttgatttctgttaaaccaagctgaaatgatgggttgggaattttttattaagccaaatgaacattcttacaactttaaccaacggatattatatatggctgagccagcgttattccaaaagcacaagtgggaacaggtctctaagttttttctttactttcaagttgagttgaccgcttcatcttcattttctccgactatcaccaccttctcactatattttttagattcacgaggttactaactttgctatagtatacgttaagggtaagcacgtgtctttccaacgttccaagagtgttatccacccaaagacttccttgatcaaaattgagggtgtcgaaaactcaaaggatgctgagttctacattggtaagagaatcgcttacgtctacaaaggtgtaaaggctatcaacggtacaaaggtcagagtcatgtggggaacagtcaccagaactcacggaaactctggtgttgtcagagctaagttcgaacgtaaccttccaggtcagagttttggttccactgtcagaatcatgctttacccatctaacatctaaattggttgttaatttatagtaatacagtcagttttttgtacaagtaatacatttgaggttgaaggtgttttggcaaggtttctctccttccaatggtaaaatttactctctctttctttctgattatgtaatcttgttgtttctttaacgtcttggtcgtgcgcccgcgacactttcagcttacccaatagaacatcgtccaatcttgctttaaacaccatcaactatgattccatttgaagctctgatcccatatgcaatcatgtttgcgggattctgtcttggtggtggtgtaatgaacagtgccatcaccgctgatatcaccaagagagcacgtggtccaaaccaagaaattaagagaaacgttggcgaagatgaaggcccaaggaactacacaaagcctcgttacaacaccgaccaatgggacaaatattttgcagtcagagacctgagattgaccggctctcttagaggccaatctgacaacgccgttgctgaagaatccttcaaaacaaactccatccaaccttacagtaatactagaagaccatgggtgttgagaagacatatcatcatgaagaactctcctaccaagtgggctagaaaatacagcagtagaagagacgagagagagcaagagattaaagatgactacattagaggaatgggtgaacactgatttcatgtagttgtagttatctttcatttatttatttcgtgaacctatattcggacgcttcttcgcttaaagaagtccataaccttcttggctgtcgacgctgagttgtctttatggatgtccttagatgtagcaagacgtgtgttagtattcttcaacacgtttacctcgttactgggtactaacggtctcctgacctctaatggagattcaatctccacaggatccactggtgaactagcacttccgctggtatagaaacttaacaggctaaacctttttctttctggtttagtcttgttttccttgtcttgatgcttacgttgttggagtttgtattgacgcatctcaggttgtttgatctcagaactatcgactgctaactttgtagcaccatcgttcatattcagggtatccattgcttgagatagtgaatcaagcgcaattgactttcttttctcttttttctcggctgcatcttttgcaactactgatttccttacaggggagccattttccagcatcaaagcagcgttatccaatgttgtgcccatgtcagggtgtttggtcttcgagacattatccagaggagctagcacaccactggcttgagatttatccacgaagggctccgtgggcattaaaagactttccttcgtcggggatgaatgatttgacaaagtgctgaatccagttcgtgacctagaggttccgggatgcttattaattggaatgctaatggaactgttgttggcgtagttgaatatcggtagagagctctcgctactttggaactgatacgaagaagagcctcctgggtgataagatgttggtctcggacgattgtggtgagaaggcagtcttgtaggaggcgtctgtagcacctgagaaggtggtaacaaaccttcggtagtgctatcatgcttaataggactttcaacaatagtagaacaattgtggttgcctccagtttcaagtaatggaggagatcgggttgcttcagatagaagtcttttcgtattagatgccacatcagcgttgacaactgcttgtaatgcaatacttgcagatgatagagatcgagcacgagaatgcgtttggtttccttcttcgtcatgggcagagagagctccaggtgctcctggagatttgctggaagcaagttcattgattgaagtagatgaatttggcgttgcaatccccatggcatgtgaagaagatgtttgtgggatggctggattggaatataacatcgtggaaatgttctgtgagctgtaggatcgtattgatggacgatttaacatcagcgatccatttgttccttccattaaagatagacgtctgctcttgtcctgggtagatggggttctttgtcttgttgagcggtaattgcggtcccattcggcaggagttactgacaagtatggggcatgtgaagccagccactgatgagagcgtacagctttcaaattcatcctccttttaggatcagcgactaacattttccgcagcaagtcccttggagcaggttgcaagtattctggaaaggttaacggcgaatgtgtaatgtaataatacaatcttgcgatattatctccatctggattctgagggtcatcatcaaaaggcaaataaccagctaacatggcgtaaagaatgactccacaggaccaaacatccactttgcgggcttcgtagggttcatttgtaactactaactcaggtgcagcgtaacaaggcgatccgcaacttgttttcattagctcactgcctctcaccgcaaaactgttgacaaacccaaagtcggtaatgataatgttcttatgtttatccaacagcaagttctctaatttcaaatctctgtgtacgattccctttgaatgcatataatctacgccgctgactagttgagcgaaaagtttggaggccatgtggtctttcaaatatctgttctctagaatgtagtcaaataattctccgccagaagcgtattccaaaacaataccaatatacttgtcattctgtaatacttcttccaaacgaacaatattgggatgtgctaatcttttcagggcattgatctctctgtgaatcttaagttctctatcggatccctttggaatagaagatcttcttatcagtttaatggccgcctgcgatggttgtttcccgtcttttctccaaccgagtttaacttttccaaactctccttctccgagtgtggaacccagtatataggctccaaaccggacttctcggtgagttttcttggcagttgatatgctccgtcttttggtagttgaatccattttctgcggtgcaacttgtattgatatcaaaatatgatatcaaataaaataaaggaatgtaataggaaagaaaaaattgagaaaactgatgtgtcacaagtgagctttgcctggctcaaagaactgttagtcttgtttgtttgtctagtctgtatggacttgatcagctagactttgctcttgttgtttctttgtgaggaaaattgggctatttaacgacacaaaaatgggggatgggcgttcctgataagctcctttgaatcctttgtttgttgatggaatgtctactattaatagtgtattcctcctgtctttatcactgtttaagttctcggttccacctgaagatgaaagtatgatattaaaatgggaaatggaattgagggcaatccaaccaataaatatctggggaagctggaatttgattgtttatgtttaaagttgggaccaaaaggtaaagtagaattgaaaatcgagatttgttttgattttaaatggggcgtgcacgtaaatggaaataatttttgatgagggttatcttgttgttcctgtgcggctggatatttggaatctacctattgttggtttgctcaccacgaacaccaaatgatgcttatgatgcatataaagtatgcgcgacaggcagaggttgtataccctccccttatatcactcgggacctgaaggccaccgaggaagacgaagaagccccccaatacaaaccctgcaaagcgctcctctgatgttgttcattaggtcatacgcatacataactatttacaagagtttctgtttactttgttaattattcggtacccttgacaactccaactttggcagctctaaggactcttccattcaattcgtaacctggttgctggacgtggaagacagttcctggctctttgtctggttgaggaacttcaaatgttgcctcgtgtctgttgggatcaaacctctcatccacagggtcaattttattgattccgtgtctcaccaatgtcttctcgaagatgttcttggtcatctcaacaccgtcgtacaattgagacacctccttgttagcagcaagggtctcgtccttgacagcactcaatgcatgcccaaagttgtccaaagattctaaaaggtctctggcaaacttttggagagcaaagtcccttgccttttggatttctcttttggtagtctcctgaaggttgcggaaatccgcaactgatctcaagtagcggtcctttaaaagggtgacttcttggtctttttctgccaacttggctttaagttgttcaacctcactgagctcagaagaagcatccttctcgggtgactcggtagattcctccttagcattaggagcctcatccttctttgcgttaaacttcataggagaaacagagaaatatctggtagctggggccgaaaccattcttggggccatgcacactgaagcacgaagcaaagagggcgagttagctctaattgccattaatcttagtgatctttgcattgtgttaattggttcttttgaacagtagtaggtgaaggtaggtgccactttatcgaaaatttgtcgacactcccaatgtggtcaggacacgatctttcgactttcgtggaataaatgttggcaatagagagtgctacagaaggttaactgagaatggtccaattctaatgctatttaatgtaactactcttcccagcactgtctgacaaacttgtccattttgacactcttctttgattggcttatcatccatggatgtttcaacatttgatgaggagaatgacgtttctttcggtctttgaccaaacaataatgcaaaaatgacttgaatgcgggagaccagaatatattttcccctggctcatcctccagggtcggtgtgaagttcaatatcattgacagtaactctatcggcgtcaatggaatgtgatctctttccgaataatatgggaatcttccttgggctacctctaataacgtcaaccctaaagaccaaacatcactagtcactgtatatggttcattcttgatcctttctggcgccatataataagacgttcctgtgaatgttgttgctaaactattaattacctctccgctgacaccaaaatcgcataatttgacttctccattgaaactaagtaaaatattctggggtttgatatcccgatgtataatctttctttcatgaaggtaggacaatccttttagcacgctttccgctatttttcccaataccttttctcctatccttcctccccttgttttgatatttttgtaaatggcatccaatgatttacctcccatatattccatgcagatgtagatcgaagctgatttttcattgataaaggttccatagtactgcacgatattaggcgaattaaagcttcgattaaattttagttctctgatcatttgtctttgaaaatcggggtttgggtctgttgttataatttttagagcaaacaatctactgttgtgctttaatttacactttctgacgctgcctccaataccttcaccaagaacatcaagctctgcaatatcgtcgttattgaacagatatttccaatcatcttcctccaagtcgtctatttctttgtcgtatacgtttacttttgaattccccggtttaccctccgctagactcagactctgaagttcttctaatagcgctggtgattcagagacctccgtattgagagcatttaaagcaactgggctcttgcctcgcgtcctggtggatggtatgcctaatattgctggcttctggtttgttcttggttcaggattcgacgttatagacgttgatgtagagctcgatattgcggcaggaattgacaagccgggcaactttggtcgattcgaaggtgaactagccctctttgaagaaatttcaggtataaacatgggccttctgctctttggtgatcctatcataacctctggagggttagcgtcactggatcttgacattttatgaatcatcaataggaaccagatactcctttcgtgttaagatttagaaagtatcaccgcgaataggtgacatctccaattgccatgcatatgctcctcatctctgactctgcccaagatgactctaacgatttcatgaacaccaatgtcagaaagtcgatttgcaaagctacccaaaccaccgtactttgctgttatcttttcgtcgcaacgtgagtctgttggtgatgacgattacgatgctatgagcgaacgaatgcttgagttggcagtgaaacagcctggctacttgggaatggaaagtgctcgtgatgtcgaaagattcggcgtgactgtgtcctactgggactctctcaaagctatcaaacagtggagagctcattctgagcatttggtcgcccaggaatttggtaagagtcaatggtacaaggattatgaggttcgggtttctgaggtgaagtacgcacatgggaagccacaagagtgatgcacctatgagcagagatgaacctgtaattcagttagatttaaaattatcgggagagtcctgcatgtttatttatatttatttaagtgcttagtagtcactcacaattatttatatcaattattttttctcttggtagcggttgatttcgcctttgaagtcgcttttttcttctttggcttgacttccttaatgagcttgtcatttttgatatcggatttaccttcatccgttggtgtgtcatcttcgacatcgtccatatcatcctgaacaacatcctctaaatctggggtaaccttcactcgcgtagaagagacagagtttccagtagcataaatcactgttggatgggtgtaagaattgtactttctagtaaaagccgtcttaacagaagggggtatcttcttcaatttaagagccatagagtaggatccaattccaaagtccataatagtgtcccaatcttctttcgtgagacaatatgcatcaagcgtagatagtacgtcgtcgattccttcagtgcccttttcaagcagaggatgggaaagttttgtgatcaaaggtgacatgtatgagagtctgaactctatgttgtttgtcaaagtcttcgtagaagaatgatactgtagctcctgtaataatcgatcgtactttagcttcttcgaattttgacccaagtatgatgtgaaattgatccttcctctcaacgaacctgctacaaagcttgaggctctaactgtcgataaaagaccaaagaatggtagtaaggaccactgttgttctccgcctctgatgcaattattcaccagatcagcctcggaaatagaatctgcagcctgggagagtaattctaagtgtttcaaattctcctcgttagggctaacatttgccagctttgttggcactgtgcttctataattctcatgaaccatcaatggagaaaaatcaatatcgtcgaagaaaagccccaatttgtcattcagtgaaaaatttgaacttggggcgtagattcctccggatagaatcctactggtaatgtcaaaaggtttcaatgcaacctcctttttccatgcttgcttaatctccgcagcgttttcaaacccaataattttttgtgtcttggaaaccgtggacaacaggtttataatttgacggatgtcatttttcgttgcttcaaccaactgatcaataacattgggatctaactgtagtttttctctatgcgcaatggtcataattctagattttaattcagaagcacttggtcttctaaatggcaagtccaatgtgactctgtcaaaaggtctcatcttaggtaatgatttgtcattacagattagaattataggagttgaagtaattcgacaaaattgagccaatgctccaacacccccatgatctccgcttgacataccgtcaacttcatccattatcaaacaaaacttcctttggttactttcagcgttgtcttgtgaatgaaagaagccaaccagagaagtattgtccaaaacagttttcacatcgctcatcaacaaagattttgatctaacatctgatgcgttcttttcaataatgtcaaatcctaacgatttggccactaggtgtgctgcggtagtttttccaattcctggtggtccactgataaggcatgctctaaatactccggtcccatctggaccgggatgcttaaaaccagatcgtttattttcaaaccagtttgacagccaattggtcagcttctttatgttcgttttgttaccgcaaacttgattcaagtttgctggtgcatattttactgtccataaagctgaattggtggcctcctgggcactaggatttttttgtgactcggcttcttctttctcagcctgcttgattgataattcttcttcttgtttcttcttttctagggctttggctgctgcttcaccagaaccaccatcagcaggcatagatttgattaaagtgatgaatccatcttcatctatggctttgattttgaaatccttaatttttttcactttcgaaggaccggcttcagaccctaagactaccactgacgttttcttgctgacagatttggtcaccttcgcaccgtatctcttagctaattcttcagcttgagtacgatctatagtgggcatcacacctgtaaataccatggtcaatccgatcaaacaattaggtctaccctgtggtaaatcttcaaggggagtggacgattgaggaagctctgtttgtttctttttgaagtctcttaaattcagctttgcggtatcttgctcttctggtaactctgcatctgggatagtttcaagaattgcttcagcagaaagaccattgaattggttagtagatttttctgctaatttgggagcttcgactccttgggcatcagcattattgatcttaggttctggtttgggactgtccatagattcaacgttgacaacaggtttagatttcggggtagatgatgctttcttctttactggagactttggttttttaggaaattcttcagttggggaattttttctctttctttgtgaaattggactcttcggtttctcaggtgagtcttcgtcaaggatggaaatatacagatcatcatcatcagagtccaaattgatcgcatcacctttgttatttgctgcttggctgtcgccatttgaagagaaaaaggggctctgatttgcttttgaccgcacattctcatcttctgtcggagtctttggttttttcgacactatcttctccgcatcagaaaccttccgctttagtttctgttgagttagtaaactgacaacgtaacgacaaccgtttgatacttactgattgagtggcagtgctttgtttagcattgccaaagaagtctctgatatctaccatggagaatatgtcacttgactaggaaaggtgatttaatttggactaaaacgcgtattcttgatgccccaacgaactttacaattagtaattataaaattaggagactactcagcttaaaatgaagctatcagataagcccttatatgaagcggcagagtcactagatggtcttattgagctgaaagataggtttgtctttagtggaaggttttcaaaaatactacgattatctgtgttttctaatcttagtaaccttgaagcattgtgatacctgcacagcacttgtaatgcataattaactgtgcgcatttgtgaagagtaacaccttcaaaatacattcatatttgttttatcttggtccccaattgacccctatcagcttcaaattggcccatattctccaagaacgcacaacgatctgtttactgtaaatactaatttataacatctctcaatatctaataggaggagtcaatgtgcagaagcgcggtccttacaataagttgtccatttttcaatttgattccaaatgaatgaattcacggattcagcggtcatggaaaatcaagatggatgggatgactggaacgaaactgctgagagtgattctggttttaatgaacctgagttgaatccagatccttcaagcattcaagaggaatcaaaggaacaaaagcccgtggatcaagttgatgactcgcccattagacccttaccagtggaagagaaggtcaataatgccctgcaagaaaccgatgaatttgaaaagactgaggagactgaagttgaaaacaaagatgatcagataactattcaagatgctcctcaaaatgaaaaggagatacaggaaaacgaggaggaatcggtaaatgagaatgaagatatcagcacggttgcggactcagaaccagtcggcatacaacaagatcaagttcaagatgaagatcaaaggccagctgaagaccacctagctgtgaatgaaaccgctcatgaagaaaccagtgaagtcagcaatgaaatccaagattctgttggcgaagaaggatctgtttcagaacacgaaccagggccagtaccaaccgtaaacgtgggatctacgcctatacaaaaatcagttgaaaacttctcttccacgcctgtacaagatgtagttgaacctgcaaccccaacattgactccagaaggaactaaggcttcgaatcctaatactatgtttgaactaaacacaagtgctgcaccttcagaaccaccaatcaaaccaaaagaaattccgtctaatggatccaaggtaactaatactgataatagtattattgaatatttgcaaaaacagttggaagaacagactcaattgagggttaagcacgaaaacaactatcaaacacttttgggtaaactatcttcaatgagaactgttttcagtaaaatgaaacaatcgcaggaagagctggaagtggaaaaagcaaatgtaagaaggcttgaagctgagaagctcgagtttatcaaacaggctgaacaactcaatgaggagtgcggtaaactaaatgatgaagttcaagaaatgaaaaaaattcaggagcaaaatgaaaattttaatgcagagattaatcagaataagcaggagcttgtctctttgacctcagatctaaagcaaaacgtacaagaagtggagaggttgaaatcagagctaaagcgagccaaatctgaaacagaagagtatttaatggctttgagcgaagagaaaatcgtaaagaataatctaaagagtgagattgcagagcagaagcagctacttcagataaaagaagaggaaaaaggttcaattatgaaagaaaactataatctagaagaaaaaatgaaggagctggaagcaaaagtcaaaagtctggaaaatgaaaagaaatctgaagaagcaagcttccagactcgagtcaacatgttgaaagatgaggtagaacaattgaaggctaagcatgaagaagatacggctcagctgaaacagttagaactcaaggatactaggattaccgaattgtcaaacgaggtgaaagagaagcaactacagattggcacattaaggcatgaagcagtggttttgaacgagcatcttaccaaggcattaaagctaattcgtaaagattcatctactgaatcagttgacaaattgttggtttctaacctattcataagttttctgaatatgcctagaggagacaccaagaaatacgaagtcctccaattgattgccaactttcttgggtgggacgagacccagaaggaacatgcaggtctcattcaaaacccaaattccattaagaaacgtggagccaagactgagtcatttgtttccttatggaccgagttcctagagaaagagaccagcacttccaaatagtatagggacccttctattaccagcattcgatagtcgtgtcttgtcccaatgttgacgatcgaatgagagttgactgatttgcagaactcatcaataatactaatcaaaaaatgttcacgctagcagcccgtagattggcaattagattgccacgagtacgattcggatcttcatctgcttacgatgaggcccttgctacaattcgtaacgatctaaagttgaatttccgattcaaggccgatgttcttgagaagaacgtgatcagatctatactggctgaaaccaagaacttggaaatcgacaacaaggacaaggatctggatgagttcaagttgtacgacctcttatccaagatgatcaagcagcgtcaagactctgctgccatttatttgaaggaagggtctccagacagatttcgtcaaacgggctggaatgaactaagagaagttgattacattaccaaatacttggaagccctacctgtagctagtgcagaggagattgaggccaaggttgaaccaattgtccaatctgtcttagaagaggaaggtgaattaaaatctccaaaggagattttctctagaattccatggaaggtggtgaaccaggattggcaggcgagtgaaggtgctgtcaagaacactgttttgaggctgtataacttgtataaaactgacgcataagtgaatgaagaatagactatttattattacaccaaatcattgaaaaatgctgtaagggtggagatttcaagactagtcgatcccccgttggaaacaaccctaggctctccactctctcttgacatttgtgcttctaaccccttgagtctggcccaatgactatagccgtctacattacccttcctgatcttcacctttcaagcccattcgcaccaccatctctctcgcgtatatatcctctctgtgtcctgtaggtctctttcttcccttacttgctaacacaaaaccctagtaatgaacttgatatcccctctattgctggttatagctctagcctatgccgaagacccagtctataaggcagacagtcttcttgaacatgccatgttccaaagtggcgagaaccttggacttcaactgggctctcctgccagtgtagtaactgtttatgtgactcgtactgaaacacttactgttaccgaggctccctggactactactacgagctccttaagtcatcacacaaaaactgaagactctaccttaacttggtcccttgaatcacctctgagttcagttaaaaactcaactgattgccctgaagaccaaccaaagactttagttggatctactaccggacaatggattgaaaccacaactccttatcccactcattctagtgaacatcttatttccagtaaaactggttactctaccgatcttacatctacttattccagtattcactcaactgaacctccttcattgtctcacccaaaaaagacatacactgaggagacctttactgaaactcatactagccatggatcatattcttcagcttcatcttctatatataagaatgaccaagtccccaagaattctacagctccatggtcttaccaggtgcgtcctacacccgttgttgtagacgaggacttcccagatctcttagatgtgcccaactcagctaatccaccaacttcctttagattggtttctctgctaggactaccgttgattctggcaattggtcttttaaccctttaggctacagaaatattctgtagggccacctatctgctctttctctctttccctcttttgctcgagaaattttgcaaggaaaacaatatacactcaacccaactaacatacatgtcagatgtgagtaaccgacccaatggtaaacattagcccaatccaatctttccgatactaacaaaatggcagttaaaacgtaccgtgagaattactacgactcagaacgtactcaaggatataccgcccatagagaaagggttcccgatgaggaaatggtcaatttccgtgtctttacttaatgatcaaggcaaggaaatcccagctaccatctttgacaaagttacttaccacctgcatcccacttttgagaatccagttcgtgtgttcaagcagcctccgttcaagatcgaagagcagggatggggagagtttgacatgaaaatcgctttgaccattgctgaaaaaggaggagaacgcaaaatcagccatgatttgaactttttgaaagaaaaatacattgtggaccacgtaatctctgttccaaccaacaaacctggactattggccctgttagctgagagtgggccggttccttcgtccgagggggccaccactccagggctgtcgagtgtaacagaaaaacgtaaaaccagcttggttggtgatgttaaagcaaaaaaggtcaagactagttctggtgccgtaaaaggtggtgttgatttggagaagttggccgatgggctgactaagttgtccgaagatgacctcttgggggtagttcaaatggttaccgacaacaggtcgcccgagatgaatatcaagaacgatgtggacgagggagagtttacaatggatttgtacagtcttcctgacagtctactgaagagtctgtgggaatacgtcaagaaacatgctgatgtgtagtagaaaaaaataatacaaaataaacgtgctttggatttgaaaagtagtatctctacgcagggagagggttgacctttcgctgttcatgccatttaggtggatggatgatttgggatgaaggacagtaaatcctccaaccacagcttttatctttttactaggaattgaacgcacacgattactgaagatttctttggtttttggcaatatgtggcaaggtagcacccaattgaggacattttggacttatggagcagaactatccgctccgtttttgttaagaaattgtggtagtgaatctgaaagaacaaaaacaggcaatataaacactgctatggtcaagatcacactgagtaagtagcatctatccaggtacatcgtagatgatcatttggatttttcaccacgtcactcacttggtattaatagttgaactcatattgaagacgttcacaagttctaatataatctatgagatctaaactagttgataaagtaactttggattcttgtggtgatcttatgaaaccattgcacagcgactactagggatttgcatcgaataacagtggatgttgacgacaaagagaaatagacggagcagatttattttattattccagttgaaaagcttatttaaatgattcaagccttgaccacaaatcaaatcattcaagtcatatcagaaagtcccttctgatgctggaaagcagcctttgaaggacatttggcaactgatgtgatactctacctgcctaagagctctgtataaggattataggctcctcctcatggggaaaaccaaggctgaacttgcttatctcctcacattcagaggttactaaaggcgtcaagaatccatctgaaaacaatcgggggcatcttgcaccagttggcgaaccaggggaccgataactttcagattaaatgtcaggaaataccgcatgctgagatctgtggaaatatgcaagtcaagcgatatgcaggtgatgagatcgagaaagtgaataatcttaaatctgtttgccttgccaacacagccaatccttgaaccaaatgaaccaagtgagggcatgaaattcctcagtaagcaagaattagcaggatttctgtttcttccctctcaaacgcctaatcttgagagcttggactaacaacgatcaagtaccgaaaaactactctaaacactgactcccactagtgacagaatcaatgaggagtatgggcattgttcttgatttataaatcattctttccaaatctctgtgatgctactaaaaccaactatatggaaatagaaagtatattcagtcatttttgtttgaaaacactgggcattttcattgcctaagctgacaatacacgattcttgttcattgccgtgcaaaaaatgattacttcctaacgctaatctgtaatcagtctaagcccattccatgtagacgtttctctttatggttggagttcagaaaacaaccgattcaagccatacgttttgcgaacaatcaggatttactccacagcaatccttcaaatctcatgcagcttttgcaaaccacttgaagtaacaacctccaaaattccaccaaacagacaatctagttttaatagttctaaaacatcatgtggatctcgagatctgactattattcacgcaattacctaatgacggctcatgaagtcgccccttccattcaagaggggataggaagtagccgtaccaacaaacttagtctgtagcatgcggtctattcattctcaagttaaagacaacgtaaaagcatgcttagcacccttttaatctctttgtcacctggaagagcagcagaaatggggggtctccatctgcaaagtacagaacaatcacctggttgcttcctttcgcgggagcactccacctttggggatgtcttattgtctcatctcttctaccccaaagttacctacctacccagcatacaaaactgttaagagtgctcaatgtcatttagccctagaattgttccaaccactgccttctcggatcagaagccaggtacttccggtctcagaaagaaggtgacggtctttcagcagccaaattacaccgagaatttcctccaagcaatctttgattccatccccgagggtgcgcaggattcggtccttgtaattggtggcgatggaagatattacaacgatacagtcgttcaattgattgccaagattggcttggccaacggtgtcaaacgtatcattgtaggacagaatggtattctatccactccggctacttcccatattatcaggacgtacaaggatgtcaaacctacaggtggaatcatcctgaccgcttctcataatcctggtggaccaactaatgatctgggaatcaaatacaatctcagtaatggtggtccggcaccagaaactgttactgacaaaatgtttgccaaatcattagccttgacggaatacaagattattgagaatctacccaccattgacctttctaaactgggactcagcaaatgtggaccattggaagttgatattattcattcaacagaggcttatgttgaaatgctaaaggatatttttgatttcccactgatcaagtccttcatcaaacgtagatccccagaggggtttaaggttctgtttgatgcattgaatggtgtaactggtccttatggaaagtcgatcttcattgatgaattaggactgccggagtcttcaattcaaaattgtgttcccaaggctgattttggtgggctgcacccggatccaaaccttacctatgcaaagaccttagttgacagagtagacaaggaaaacatcgcgtttggtgctgcctctgatggtgatggtgacagaaatatgatttatggtgcctctacttttgtatctcctggtgattccgtcgcaatcattgcggagcacgctgaatctattccatatttcaagaaacttggagttcacggcttagcaagatctatgccaacaagtggagctttggatttggttgccaaagcaaagggcctcaatgtctatgaagtccctacaggatggaagtttttctgtgctctttttgatgccaaaaagctgtccatttgtggggaagagagtttcggaactggttctgaccatatcagggaaaaagacggtttatgggccattgttgcatggctgaatgtccttgctgcatttgatgctcagcatccagaaattgaaggaggtgccactattgcattagtccagaaaaacttctgggaaacatatggtagaactttctttaccagatacgattatgaaggatgcgagtcgatcccagccaacaaattgattgaattcctacaagagaaggttgatgatacctcttttgttggttcagagctagctccaggctacacagtcaaggaagctgctaacttctcatacaccgacttggatggttctgtctcatcaaagcaaggtttgtttgttaagtttacttccggcttgagatttattgtcagactgtctggtaccggatcttctggtgccacaattcgtttgtacttggagaaacatacatctgacaaatctaagaactctttatctgcatcagagtttttagccgatgatgtccgttttgtgttgaactttttgcaattccagaagtttgtaggtagagaggagcctgatgttcgtacatgataattgaaagaaaattctattgttattatacattctatgtagtccaaagacgggcagtagcatctgctccagatgtgaagacccatgcttctttgggatgccattccatattcaatactcctagactctggattacgcgatgaccagttagcttcttcaaaggaactaacaatggattggacatcagatcatcataaacggtaccgtggaaaatatgaaccgttccatcgtcggaagctgaaccgaataatggtagccctcctttgtggaaagcaacagctctgacagctttctggtgatacctcattgtcttgtatggctctgaggataaatctaaatcatgccatagcactctcttgtcgtaagaggcagtgataacattgtcacctcttggatgtatatcaatagaagccaaccatcttgcctgagatactaatttcttcactaggacctgtttctgtagatcataaattctaatatatctttgtgatacaacaaatagctgaggcttgaaaggatggaacttagcgtccatgatgactcctcttgatttgttgaatggggcctgcgaaatatgtcttgaaagctggtgcaccaaaacagatgtttttccagcattaggcgaggaggtgacaaagtagtcacctttacggtgccatgaaatcttcttgatgacagagaccttcttcatagagacaaccaaggatattcctcgatcagcttgttctggggttggcttaaaccaggaagtgtgttgtttagtaacggcttcggtggtgtcttcgtcgtcagatgcgttggatggacccttggcagccttgcgaatatttccgtgtttagcataaccaaagccatgctcaatcttagacttcgcagcattttcaatatcaaatccaaaaataggaggcacgattaaataaacgtgctctcctgcggcaattgctaaaattcctgagttttcagctgggttccatgctatgcattcgataaaatcttctcccttatggctctctgtaataatcgtagtcttgaaaacttctctaccagatacaacctcccaaactctcacagtaccatcgtcagcaccagtagccaaccaaattcctgagggatgaacggatagggctctgatacgaccgctgtgaccctcgtatatagtagaacaacgaatagggaagggacgcagatcttttggtgatggaagctcgggaattagagaatccgggtcgacattcaacttggcttgtttcactcttggagccaaatataaatctaaacttctctcaaatatctccttaatattgtttgcataaccaggaacctttcttagtgccgtgaacttttgagggatcaactgaagtttacgttcacttgggtcggtttcctcccattcttttctttctttttctgtgaacaaatactcttctggagggttgtaactctcctcatgtgtaggaggcgctaatttaggagctctccaattgttctcctgatcaaccgtattgtcctcggcgtcctgccacagatcataaaccggatcttcaatcttttcttccttgaccttgtcaggatgaacaatccgaccttctctaatagcagtgaccaacttgagaatcttgacttgttcctgttgtgatgggacgaaacgtctctttggttcaggcttgtcagaaagaggcatcacttcgaccttggaggaaaaccattcaacagtgtcttcatatggatcaagcgtttcatcggtcagctcattagattgaattcggcgaatcaactccagctcgtcttgcgtaagattcataaccccaccagtatttctgtctaacaagccagtccaaccggcgggcaagtcaatgctttccaacaattgttctaaagcggagcccttagctggacgcatgattctcttaccattgatgtcataaccaatgtggggaaattcttcataagctgacagaggaatattcccgacagtgttaaattcttccttttcgctgtcatcagactcgtacttagggtcaatttcaggtctaattagtctcaatttaccatctgaataggttgtttctcgtatactagttgaaccttccgagtagcttctaattttaatgttcttgactttgtcggtcaacgaacttgtttcttcctgtggttctgaaggagcatctgactcggaagattcatcgtctccttcttcttgagctagcattttgttcagctcaacgtctgaatctgactccaattcaggttcttcgtctgcctctaatcctgtatcttctttgtcgttctcatctggctcctcctgatgttcatcagcatcatcttcttccccctcatcatcagagccctcatcgattagaccatctaagtcgaactcctcttccgaggaatctagttccacaacatcctctggagaaggttcttcatgagcacgcttcttctcatttttggatcttgctgattccgtccgcttgtttgctgaacgtgttaccatttccaaaggttgcagttttttcttagagaactagtttaactgtaatctaaaaaaaaaatttcagaatactctctttcatactcgaaaaaaaaaaaaaatcgaagaggtgttcaaacatccgacatctaggggtgacgaggagtgaagaaagttatatgaacattcttgccagatgaagtttctcaggcgttgcctaacttttctagggtaagtaattatacgtacagaaaagttgttggtagttttacagaatcattatgctatgcagttcgtaattttcgttattgttcgttcctactatcaattgataatctctccaggtctacaacaaactggctcaacggggcattagtaagctccgttactatctgctggaccttatcgtatccttgagcattttcattcaaagttttgaaatatttctgcaatgacgagcttagctctttgtccaattcaatggtttcattctccagtaaggaacctaccgttgaaagaaatgcttccagcttcaacccacgcaatgtattgttgttctgatttatatccgattcaaaaatttcatgaatctccgatacgggaagtttgttatcgtcgttgaaaaccctctccatacaagtggtaaactcagacttattgagatatcccttggccccgatatcgcattcttgaaaaagttgtttgcaattatttagttgccagtcaggtatatcatatgagtccgtcgagcatgcgtactcttcttctatgaacttgagtctatcgatgatctgtagcttgaaaatgttggtcagccaattttccaactcgttgaactgaagcttgcactcatcatactccatattagtcagtaggtgagcagtgtgatatttttcaagcttttcaaaaagaagtgataactcaagaaacaaagaatcaaacttcttgatttgctcagaaagcttcttgagttcttccacttgatattctaagctatccattgagagaacctcaaaaagtttcttattctgcgtgaaaacatgctgttggaactcgttgacttttgaaaaaaatctagaatacacagtggcttgagcatttctggtaaggtcatcagttattgtggaaaaggtggactcgatttgcaataaagatgtccaaagattgtctatatcgtgaagtgtgatatccggattgtatggagcaaatgcgtatcgactagttttaattttaatcttgcttagtaacgttctcaattcgactctttcttgcagcatgggcaacttctcggaactgctaaagtcaagtagattggatctttctttcactaggatgtcaacaagtttgtcaatcgattgtgtgtctatttcatctagtttctcatattcgtcatatttcagatacaaagtctcaaaatgacggatccaaagtttgattcgttccacaagagcttcagccctggtatcgaaagcaccttgtagtctttttaacgattctgtcaccttgacaaacttcgtaatatgcaattgttcatcgatagtgtattcagtgtcgggagtattcggttcgtcaatactaaagttagctgacgccgaacgagaaatcgaacccaaactcgattcagaggtatgtgcaaacctcatataccattccacaatatacaacatgactgatttctcatccggctcaacttgcaatagatcttgaggctgaatcaactttgggatacacagttcatgctccgccaatgttaagacggtcgtaatcaccagttttctatcagaccaatcttgattggagaactggaatttaccactacaatgagctgcgtacagagcagacagggccttgccatcattccaactggttgaaaaatttgacacatgaacattgtatttactcgttacggattggacccacgccaataagaatgaacgcttatcgccaaagccgcggtctttcgaatcacttgaatgcttgacgatagtataatgagaaataatagtccagattaatcccaataacaatttcaagtttccttccactatatcatcagagccaatgttatgcaactgcaacccattgaacttcatgaactccaagctcacagcaacattttccatcttttgaacagataagaacggtcttgaatgaacaggctgaagactggtatcctcgctcagggcatacagtagtttaagtagtttcaatccgtctgaaaagtcctttcgaatatctttgatgggggcttcatcgatagatctcagtttactattaatccagttggtaaacgttcgggtctgggtttccacccaatcagtcttggccatttaaacggttcttagcaaaaacaagggcataagttttgctcagtttcaggccaaaggatctgatttccggaattgtaagtgaaacacaggatacgtgcagactggaacgggacctttgataaatgaaactactgttcacgcgtttggtaattacctaatcaggaagtcaaagttaattgttataaaaataacttactatgtcccaccacatcaaaccaaaagattaatgagtgaatatttagtgatacattagttagattagtcataccatatcaaaatataagagggtaaaagaatactgaagcaaaaatagaaaaagaaatacttcttactattcttccggtgttccctcaaaataagggtgcgccaaggcctcctgggcagtgagtctctgttggtggtcgtacacaaccagtttgtcaataaggtcaaggatctgttcgttgtcagccaggtgtgagttcttgctgttgataaatgatctccaaggaaccctttcatgttctttcaacactccattgtagtctctgctaagctctattccatatttgttacagtaggccatcagatcatgagttcctagtacttgcgcaatcttgtccaattgatccaaattggagtcacccttgaacattggctctcttcgaaaaacaatagctgccagcatagctcccacggaccataagtctagggagtagtcgtactgctgcagattgatcagcagttcaggccccttatgatatctggacgccactcttacgttcaaattaccgcctggatgataaaactcggctaatccccagtcaattaatcttaattttctttgtcttgggtcaatcatcacattttgaggtttaacgtctctatgaatgatacccatggagtgtgagtagtccaacgcctgcaaaagcttggaaaagtagaatttgatatcatcgtgggcaaacttggggtataaagttctaaaatctgcattggcaactctttcaaatataagagcaggaatcttggaactctgatcttgcaccaaatctaaaagtgccacaatgtttggtcctcctgtcaaattcttcaaaatctttatctctctatgaatttttttcattttcacaggtttcagcaccttgataacacacgatttattgttcaatatgttcattccggtgaagacttcgctatactttcctctcccaattttgtttactatctcatagttgcttatgtccccccaaacaagctggtagttctctagtgtcggttagtatcttcaagttcagtggtacatctattgattgcaaacaacataccatagtcccaatattctctgtctctctttttattggcatcggcgtatacacggctaatgctataaactctctcttcaggcacagacatgatttacaagtcacagtgtgttcaaccgtttttcgtcgcaagtgttggtttttgagagattgttaccgtcgtgtactaggtcaatttagagatggtgaaggaagaggggcaattaggggtcggtcgggttagtggctgatcgggtacaaagatactgttggtccgaagatgatcacttgatggctgaaatgagtaattattcgtttccacacttgaagtttgcagatcttgcaatagttctttacctatgccactatttctattttagttacagtcaacattctaccgtagaagaatctcttcgcgaaacagtcggcccctcccgtcatatattccttggaattgccaggttccttcaggcatgccaaacataaatgttgaacttggcccgaaacaaaagttaattcctcctagaatagcaaccgacattctctcgctggaatgtagtagcctgaatattgatgtgccaacgaaatcgttttttctgcagggattcgctcaaatttcacgggtctcgccatggttgattgtggaggaaccatttactatcttcaccagagatgaaccgaccaaaagattcttcaaatggatgatatctgtcaccaagttcatagggaaaaagtctattcgtggtcttttattatctacaggttcagtaacgaactcacctgtcttaatggtttaccttgagaaacaggcagaacgagtgattgtaaggggcatacacgtacaagcagataacaaattcattcagacagttcaagacttctccaggtatcactcggatgaacatagaggaaaaattgtatttgcagatactatagtcaaagcaccatccactacagctgatgatcctttggaaagaatgctgaagaagaaaacagacccagtaacccccaagcctatcatgccagccactagcccttcgaaagaccctgttactttcaatagcaatattcgtaagctgatcgaaaaagtaattcttagtgaattcaggctaaggcaaattttcaaatctacactgacagctaccgagtataaaagcctttatactcatacccacagagccactgttttttctttcaggaattacataaaagacttgaaaactccttctttggaaaaaattcagtcggtagttagtgacctattgaacattttcacagaagagccacgataacttctggtaaaacacattcacgaaatgaaaagcttgcctaaaagctatttaatatacacaaagatccttttaatagactggaccctacccaaatacccttaatagtgcctgccgagcatctatctcatcttccttttccctatcttcatcattatcgtcactactgcttgtcatatttagtagatcagaattggaaaaccctcccaatagagggtcagatcctagcttcagactttgattgtgctttttgggcctcatgggattccttgtcaacgtagtcgtcttgtaagaaacttgtttcacaaaactaagcttttctttgatgacagcctttccatctgatgttactgtgagagatatgcatggctccattttattttccttcagtgccggtttgcggggagttctggatataaactgggcaagattgtcggaaacctgagtcatgggagacgataaaagcaaggaaggattgacgttcggtgtcatctccaagacatctggaaaatgactgtgactctgcattggcggtgtaacaagctgatttatattgcccatgtcgtcacccaaaacactctgaaggattgcatgtgtctttggcagactgaactggttgaaatcaatttgttctttgtttgtagatctaatagaagacgtcggcgtaatggtactatcgctacttctttgtctcttcctgggagtttttagtttggagcctactctcataaggggagagctgaagttgggagatccatttctcagtgcagctgctgagcttgtagaggcgttgctagtagagatggatgtgaacctcgtggaatatccttgagcatctggaatcatggtggccatgttaggtggtctaccacggcgttttttcgtcggagtgggagaaggggtcattaccagttggctctgcattctcttaggagagatcttgtagtgatgtgagggagttgcttgagtgtaatcttgtacaaaggacattgaatggacaaggaagaaagatgggggtagatttggaattttaagtttttaacaggaatttcctaattgagaaactcttcctaatgtgtgatattgttagggcgaattgacgcgtaattaattagacgtgaccttatttcgatgaagtgttggcagatgagattcacagattgtatttttagaacattggctactcagagttgaactttttgtgacacttcgattttggaaatgctagtttcagctttctaagaggtagcaacagctctagtttatgtttcttgctgtcaaatagcagttagttgcttgcaccgatatcaagcaccaatggaatataaaatacgagctacttatgttaattgaattaacaggaatatttaaaggaaacgcttttttagtgacattaggtatagtggaacttctctagtctttctgatatgtccagctgatgctcgtctcacaagttagctcagtggttcaagtggtaaaattgacgtaaccattcttgccaaaaaaatgcaaggtgtaattgaaactcatgccaacatgtagctattgcgaacactgtaatgactagcaagaattggttggaatagcaataactgtagcactcaagcgtttcttcagacgattgggtcaaggtaagctcttttccaaacccaattgaacctgtaatctgttaactaacccttataatgtttaccagtaagtcaaatacaataatcgtagcagagttgggcaaattcaaaagatcgcaatggatgcctctagtcttgatcttttttgagccatgggatcctcgtttgcgagctaggccaattcacagcatgatccttttaggtatcctcgaactattgggaattcctcctacaatctttttgttctgcatcttcatccaccatttcattatcaaatcgtgcaaaagcaatccagcaacaagatcaagaacacgatcgggaatggcaagaagattttccagtccttccccccagtcttctactggggctgactccagcaaaacagaccaccgtaaaaggcttcgtatatctcgttaattctttgataaagtccactggtgatccaaacaatgatatagtcgaaattggaatgggtaaaggttatatctctcgtattttggcaagttccttctacaattacaaaattttgggaatagacgtcaacggtgaaaagttacgctccaacttgaggatccatcgattgatcaactcagacaaacatacggatctcaccattgaggcacctacgaatctaccaagacaacagatttcaaacaaccttatggctgtaaatgctttgctggatgatcgaccgtctcaattgaataatgttatcatgtcgaatttaccttttttctccttgggtaaacctgtcggaacaatggtccaaatctgtattgtggggatgaatctttgtggggatctttcctacaaggtagttgagaatatgtgctcttctgttgaaaatgtttcatacagtataaaagctgcatcattagttccttgctgcgcccatctacttacgacttttccaatatccaagaatctaaagagacaatttcaagataagccattcacgttatctcagagattagttgccttagacttgtgctactacattcaagaacacctcccaaatgtcaaacctttcttgaaagagttctgcgcaaaatctgccaatggaggtaacaatgtaatggttcaagccatcctattgtgattatttataattataatacacctccataataacattgaaccattctgtcaataattctttccaatcctgatcattttctggccaattctgatcttcctggatactgattaccagcctcttccacaggtaccattcgtttgtggacatgtactcgtaaacagaatctgttactttacaaccaaaatataccagaccagagttttccttcgcaggtactaaatcttcaatctgtaggctgtttaactgaagtttgtacccgctcacatatgataaggatttcaaaattgcttcttcaatggaactgctaatttttttgttacttgtgaaggaagtgagctccaatcggtgattgtccatgtcgaagagaatcgttccttgcgatgtcacaaaggtctcggaaatacatccagcaaccaccgagttggaagtcggattttctgcaatgcatggtgttttttcagttgtggggccggaatgatgtcctggtgctatatctgaagatgtttcaacctgctgatatactggctgagacaaacatgaattaatgagggtaagtgtagtaactatcggaatcctcataataaatttaaagggcaaatgaagttctagggtagcttaactcgtatttatgcaatcgcatttagattgtctgcaaaacttcttctatccgtatactgggacagatctttccatatgcgtgcattcttgtggttaaatgagtttgtgatcattcaagttgctaatatcttgcaattgtacccctgcttgtctcatcgttccgccagatctagtaaacatgttaagagaatgcttggttgtaaaccccgaaacgaccaatccactatcatcaatcttatcaggtggtcgcgcgaggagaaaagttttagattgagtcctccccagacccacctcattcgtcttcatatcagagctaatgactgtttcttccatagaaaatgctctaacccaccatatcagacagatcgtagagacgcattttgacaagaatcatttcaaggttttttcgttcgttttcagcttgataacgtgcctttgtgcggcttcggttcttattatcagcatattcacaccatggcttatccaatatctaaattacaaccaattcgtcattaatattatcggagcattcatagccataggaatgtacttgcctctcccctatctgggctacttagcagacgtccatgggccggttattttggctgtgctgagcctattcatgttttttccaggctacatggtggcctcattggttgtcagagacaatttacattacatatatttatgcatttcatatggtctgattggctgcgctacttcatgtttatacttcagctcgctgttaacctgtgccaaagtttttcccaaccacaagtcgttgagcatcacggctccagtcgcatgttatggcctaagctcgcttttgttgtcaggcctgttagattcggtgaactggttttattatgtgaatggagacttgaacctgtaccggtgtttcagattttttgcattcttttatttcgtcctaggagttatcaactgggtctcatccgtcattgtcactatagaacgagatttaatctttgaagaagaacaaattccgttgatagaacccgatgatattcataaaagagactttagcgtttttttaaaagatcattcaatgtacctctttttgtttgcattctttctcatagtgggaccattagaaacttgcatcactaatattggctcaattactacagttatagatcctaatggtaggaaagccattcctttgcaagtttcactccatgctattttttcaacaacctccagaattttggtgggtggatctttggattatcttcccaagattggggttactcctgttcatttgatgattgtgctggtcttgtcggggactttagctttcacattaataacccaaggatcacacatggatttgatcagtattttccttggattttcttatggagggctttttgccatcactcccaatattctggtgtctatatggggaatcggcatatttggttcatcgtggggtttatttatgttagctccagctgctggaagtactctcttcggtctgttatatgctttgaactttgacacaatgtgtaaagttgaatcaaggttttgtctatggaaagtattttccgcgttggcactatgcacagttaccagtgctatcataatatttttctgcaataaagtttgggccaagagaaatgccttcaagtgttagtaacaactttacaactgctcgctatgaagttgattacgagtctgctacatagcatgtttgcaagtagatgtttttggaggcctttatacaaccaaattttttcatttattctttatattgtcacacaccctggatcactctgaacaggttaatatcaaaataagtaagtctcagactgcttcacctattcaacacctttttttttaagccaaataacttgtggtaaagaaagggtaaccagcatcataccaaatccaacaccaattgaaagtccaaaccttgtgttatatagggcggctaatataatgggtgctactaattttccaacgcctgcaatagctccaactgaaggcatcaatcgaaccttgacgtttgaatctatgtacagggaaaatattgatggaatcgcagacgccaagatgttatatcccaacatggtgatcgacagccctgcaacaaaaaatatgccagaattcgttggtggcattgacccatgtttcaatgcttcggaagctccgatcatgaacgcttgcccgaccattgagatgagcaatgccaagagtgaaagaagaacttgattttcgtataaaggatctctattatctgtttcgatttgtttctccatttgttcggcttcagtaatacccgactcgatttcagtggtttctttggcactactggaaaatgtccgtaaatgtaccagctttggtgcgaagtaacttccagctgtacccaatagagttgcaaccattaatgctagaccttgaattttggtcccccagttgagatgaagtgttaagaatattggcataaagtagatcacttcacacataataaaggacgaaagaaacatgctccataacaggattaagcatgaaataagtacttgcgttttagctccaaagaattttcttatggcttcagagaatccatgttgtcttgtttctttcaccttagggttttctaaaatcacaatcaagagcactaatatcacaagaataatgaaactcgaagcgaatgtcggtgcattgtatgagttaatacgatatcctttaacatcaaagttacagaacccaaaaagtatgacgattaattgagccacactcatgaagataccagctgatgttctgtatattgctagaagcttgaacaccgtggctctgtcttgggtaatagctgtaatataactgaacactaatgcgccggaagcagaggctgcaccgcaaattatacgtcctccaagtatggcgttcaacgaaattgcaccaccacacgaataaaggaagttccccacaaaggacaggaaataaagaaacacaataacccatttgatggaccctacccattcagcgatattgcctataattaaggaaaccaaaatctgcaccgctgcagacacagcttgcatcacaaataggaaaatatccgggttacttgctccgctctacaatcgtcaatataagtgctttcggacttcatttcgtcgggatactcacgttttgaatgtaatgtactacgctcgagaggtatacgcaagagtcaaaactgaactggacagcaattaacactaccgccaagtattttgaatatagttgtctggaatcttgcattgtcttccttctctctaaccttaaaggaagatttgattacgagtgggcagacagttgggttaatagacgaatctttatatcagtgtgtctcggagaatcatgtccaaatcgggaaaagaagctccgaatcaggtgtctggatatcgggagtcttatgaaacaaaaagcctttgtaatctggcaataatgtttagacgtgctgttggaaagggattacgtttaattgataatcagttacattttgtcttggttttgggagtcatgttgtgtagtaatgacgcagtggaacttcgttttttttttttttagtgagcggctgatcgtgcatttaatccgaaaagcttgacagatccaaaattgtctaaaacggtggtaaaaacacttcaatctatccaattttctcggtgtttcccagaactttatcgccgattgtccattgacgaaagctttttttcattagaccaacactttgttgtcgacgttactcttaagacgcaagacttactcgtctatgtaggtttagtattgtaacacttcaatatctaattcaagagctcctagtttgaacccagacattcactgccagacttatttttggttcagttgacgttaaaccaaacatatgggtaagaagtgactagaaatgatggcccgtaccaataaagtgaaaagcaaggctgtcaagtcagcttgtctagattgcaagagacaaaagttgaaatgtgacggcaataagccctgcagcagatgcattcaaatggaaataccgaaaacatgtaaatatattgcagatggaagaaaagacaaaagaacttttgaaaatggttcaaggaattttgttttcaaagatcaagtttttcgtcgcagtgacagtctttccaaaaccagaaaagacaatcaaaacaaaatggtagcaagtaacttggacggcggagaatcgaactcaaggtttttctcggaagagttctgttcagaaagtaatcaagttggaaaaaacctcccctgcagagattacgaactcgatttcgatttcaatgacttcaatacagaagcagaggatatgaataggtttttggagttgttaggagatgattctctactccatgatcaggaactttatcctcatcatcagaatatctcgttttcagtagtttcaggaacaaattcgaccgaggttaccgaacctgaaaaactattcagtcaacgaaatcacttgattgaaattctgtttgaaaatgagattcatgttcctccaggaatatcaaagcaacatcttcttgatttagaaaaaacctatgatgatttgagggagataggaggcaatagtgaccagaagtttttactctgcactgcgctttgtcttggtgcactgactatcagaaaaagagagttactaaaccaatcaaccttggagaaacctgccacgatattacagaacagcattcccaagataagctcagatgcatataactactacaacattgcaaaagcactgattcttgacgtactatcatctccaacaattgatggattttgtggtttagctttaatggctaattttatgactatgatgatttccttagagggtcaactatatctgaccacaaatgcactccaaattgggatggctttagacttgcatagaagggaaaagtgtaatgaactggttgaatcgcataccaacgggcttggtttgatattactattctggaatgtttggtgttcttcttgcatgttatcgactttccatgggagacaacctttgattgtgccagagaatatcagtacaccacaaccatgtgagctgcttcctgaaaataaactaaatgaacttgtcatgaatttcatgcaagtacgaattcaattggcagcactacaaagcaagattcttgtggaagcatatggctctggttttacggatgaagcattcacaaagctagagaaagaacttgagtacatttcagcccaagtggaaagtaataaaagttgtcccacgtttgaaaaacatgcattctatagaagtcgacttttgatgttggaactatcatgcctgagggctcaaacagttttacttctatatcgtccaaaattgactactggaaagtccctccgggctgtcaatgtggcaaagtcaataatcctcgatatatggagtcaatatacgaaacagtatcccagcaacaaaaaagaaatgctggaacacctagattggaatttttgctatcccttgcgaactgcgacactgacgttgtggatctcgtgtgctatcctccttgaatataaacacatgattgaattcatgagaaccagtgatccatttgaatacattctggcattagaagtattggaaggactagttcaaatacttccaattgagcaacagcttttagatctgctaaaatctcccaacgattcggttatagggacggacggctgtacaggcaatttttggacgactatgtctgatcaaaagctgcaaaataagtaggattcttcacttgtccggctatgtgatggtcattattgagggttttataagacgtatcagtttagaaagtgaatctttaaactttaaagtcgagattggtaaatgatacttaatcacaaacttcaaaaatgccccactttttctttgcaaatcaatttctaggctgagcttcgttcaacgttaacgagtagtctagtagccttccgagttgaagatcatagctcacaattcataacgtcaaactcgaacctctaacttaaagtaagcttccaccaaatcgtgcacccactacaaatcgcgacttgttccctccacttcggggtatcttatacaatcatcgaagccgctaaaacaatagttggcgaaattgaacattaaatcaatctctttaaggcaaatgttgaaacaaataagccgtcagttcaaacaatttcctgtgagccgcagatgtcttcacggatcttctttcagattgggagctacagtgtttgacatgccagcaatgtcccctaccatggagaagggaggtgttgtctcctggaaaatcaaagagggagaaaaatttagtggtggcgatgtgctgttggaagttgagacagacaaagcccagattgaggtagaggcacaagacgatggtgtgctcgcaaagatactggtaccagcgggtaccaatgacatcccagtgggaaaaccaattgcctttctggccgagcaggatgacgacttgagtactctagagtatcctaaactggaagaaactgcctctaagaagatagaatcaaaaccagagaaagcagaggagaaaattgaaccaccgcaaccaaaggaggagaagaataccagcggcagtgacagtggtaaactgggtaatccgaaacagactttattaccctcggtggaactgctcctacacgaaaatggattgagcaaagaagatgctcttgccaaaattcaggcaacaggaccctccggaagaattttgaagggtgacgtattggcatatctgggcaaaatttcacccgaattgaatgtcaaaatttccgagtacattaataacaagtctcacttagatctgtctaagatacaaatcagggaaaccaaggcaagcgaacaatctccatcatcttcaggagataaaccagccaaacctgaaaaacctgctaagaaagagcctctaaagatcgagaaggaattgacactatctcaagcttacagtaaggaggccctgcaaagattattaactattgcagaacaacatgcatacagtgccaagctgtaccaagaggattcagaagtgattgatccactgtttgaggagatcgttgctccacctagaaatgccgaacgattcaaaacacaatttatcgtcacgccctcagacaatagtgtttccacattgaagcttaccttattagtcaacgagagtatattggatgccaagcaaagagctcagttattccttgatgaagtcaaggatcaattgacgcaagataatggtggcgtttcgtcgtctccccaacttgaagagttattctgagttgcaacaagtctaagtagtaagtaattaaaccatcatgatcctatgatcgtgatcattcattaaagcacggtgtggcaattattgctagggagatcgtcactgtatggtggcagaattatctctacaagatgtctcaaagtccccacaaagcttggaccctctcatctgtaatgcattttcctgtaactccccttagccacacgtcaagggctctgaatccgttgaaaagctgtggcgtctgccacctttaacgtcttcatgagggatgtgcacgtgatattgtctttcccttctctaaagcttcgaaaaaaacgcatctcaatgcgagaagcagatcgatatatataaagaactagtccattgaaagatctctcaatttcactggaaaccaactcagaaagaaatgccttctcctcacggtggtgtgctacaagaccttattaagcgtgacgcttctatcaaggaagatttgttgaaggaagtccctcagcttcaaagtattgtgctaactggtagacaactctgtgatttagagttaatcctaaatggaggtttcagtcctttgacaggatttctgaccgagaaggattatcgctccgttgttgacgatttgagactcgccagtggtgatgtttggtctattccaatcaccctggacgtcagcaagaccgaggctagtaagttccgtgtcggcgaaagagtggtgttgagagatcttcgtaacgacaatgctctgagtattctgaccatcgaggatatatacgaacctgataagaacgttgaggctaagaaagtcttccgcggtgatccagaacacccagctgtcaagtacctctttgatgttgccggtgatgtgtatattggtggcgctttgcaagctctacaattgcctactcattacgactacaccgccctgagaaaaacgccagcccaattgaggtctgagtttgagagccgtaattgggaccgtgttgtcgctttccaaacccgtaacccaatgcacagagcacaccgtgagttgacagttcgtgccgccagagctaacttggccaatgtcctgattcatccagttgttggtctgacgaaaccaggtgacattgaccaccacactcgtgtcaaagtttaccaagagatcattaagaagtatccaaacggtatggctcagttgtccctgttgccattggctatgcgtatggctggtgaccgtgaggctgtttggcatgctatcatccgtaagaactacggtgcttcacacttcattgttggacgtgatcacgctggacccggtaagaactccgctggtgttgacttctacggaccttatgatgcacaggaattggtagagaaatacaaagatgagttggacatccaagttgttcctttccgtatggttacttatcttccagatgaggatcgttacgctccaattgacacagtcaaggagggtacccgtaccctaaacatttcgggaactgagctgcgtaaacgtctcagagatggtacccacattccagaatggttctcttacccagaagtcgttaagattttgagagaatccaatccacctcgtccaaaacaaggtttcactttgtacttgaccggattgccaaactccggagttgacgccttgtccaacgctttagttgctacattcaatcaattcgaaggcgcccgccacattactctgctagatggcaagaacgtcaacgaatccgcattgccatttgttgcccatgagttgacacgctctggggctggtgtcatcattgctgaccctaccaaggctccttccgctgctgagattgattctattcgcaaggaagtatccaaggcgggctcctttatcgtgatttcattgactactcctttgaatcaagtctctcagcatgatcgtaaaggatactactccacttctcgtaaagatgttgacaactacgttttcccagaagatgctgagatcaagatcgacttggccaaagaaggtgccatcgttggtatccaaaaggtggtcttgtatttggaagaacaggggttcttccagttctagatagtagactttataatgatagattgagattatgcgaatctttgaatcgaggggaatggtaacatctgacatcttctatctcacgtctgacacgtcttgtttctcctagcgatcgatcactcctgtcgaccctctgcccccgaaagattcggtcaaaaagcaaaggcaaactatcctcactatttacatcgcagtccatttttttattcaaacaatttgctgattaacgcaattgcaaacggaccaatcacactccggctcccagaatctaggcatcttttctacacttaaaaactgaaaaactccgttcacgtgcatggtcgtgtcccttgcaattattccgtaggtatctctccactgggaaacaaaacaatcctatccgacaaacaatcgtcagaaccattaccacccgttgaatcctctgctgttaacccctaatttcggtgctcaatagctttttcaaatactaagtgataacatactcattatttgaagtttgattttagtgagaaacgagactacccaaacatttgagcgcattcaaatttttgccatctgacaaccgagaattgagaatttgagaaccattcaacgattacgtaatgtccacagttattccaaacccttcgaatccttcgaagcctttgatatgccgtcgttgtaagaagaagagatccactctggagcctccagaagatctaaaatacaagacctgccagccatgtcgtgaattggagcgtaaacaaaagagattgatgaagttgaaaaatagacctcctgaagaacaggaacgattccttctggaagaagagaaccgctctaaacagcagcagcaacaaagactgttaggtaacactactacgaacagccatcgtcctattgccaataatagtgctgctgctgccgcgtatgccctgcataatcaaatgatttctccttccatccttcatgacagtaactctgccacctctgctgctgcagctgctttggatcagacgcactatgacattgctttgctgaagcaagagttagagaaaagtaatagccacaaccctgatgacgattccggtcataatggaggccatttgttggacgactccgttgatatttccaagattgacagtgaattgatcagctatgacaagaagctgattaatgacttcacttacaacggagaagaaatgggtataatttcaaattatgggcccaacactggtactggctccggaattcagagtactcattccaatgtgcaaggtggaccctcccaaggtaccgctccgggagctcctatcaagtgcgaagtatgcgaatctccaacaacaaacagatacaataaattatgtgattcttgttccacagatccaactactaattcaaatgttttaaccgatttgggtaaatatctaaaagaaattagctacaacagaaatttagacgtgaagaatctcatttattatcagactatacccgtcagtgacctcttggatgccgacgagggcaaggaattcaaagatgagattgatattctcaccaaaatcaacaagtcaaaaattgaagctgcttacaaccagatttacacaacttatgttgttccgaccattgagtcatcgaccttccattttaccaaaacaagctccaatctcagttacaagcctttccccaagatcctacgtgttgagtacaggtgtcaacaggaccttaatccacctcaaggtgaatcagagaaaatagaccagaatactgcagaaccatcaaagggtaagactacttgtcagtccaatatttttgtctcctacgatttgttttcgggtatgctaatgataaagtatacacacaacacccatgcagttgcttgaaggtaattgttaccttttattgttttttttgtttatgttatgtaacactatagtttgaatcgtttgagatattcactgaaaagtgaatctaatcaattgtagttcaaagagatcgaaacggttgtcccgaaactttttcagggtgtcgctccactaggtcagggctgtagcagaaaatcggcccctcagatgtctagctatagtttacataattactttctacagtaatgccattgactaggttagaagactaaactagataccgcatattccctataccttctctcttcatcccaataatcctcgtcctcttcaatgtcttctagattgtcttccccgtcttcatcgtcttcatcattgtcattttctttttgatcttcataatcactttttcgaattccattgttggctattcggtttggagttcccggctttagaattccagtattatcgttgatcttcccttcatctgagagctctattaacttaccttttacatcttctggggccacaccctggtcaagtaatattccggctaagcctgcgactattggagcagacatcgaagttccagacatgcggacagcgactccattgagaagtcctacacttacaattgtgtcccctcctgcaaaaagatcgacacaggctccccagttggaaaatctagttatttcatcgttgtgatcacctatagctccaacggtgattgcatatggagagtttgcaggggatgtgttacaggcatccacgaaggcattgccagctgctgctactatgactaaaccgttcttgaatgcctcttcaatcgctttttcaaggattgaattttttggtgcacctagagacaagttagcaacacctggcttacgactggctttcatatgcttgactgcgaattcaatcgcctgtaggacctctgaaagcgaaccgctcccattaccagagagagcttttacggatatcaagttgatatttttggccactccaaaagttttggagccaataagaccagctacgtgggttccatgaccaacagagtcatctttcccagtgcctgtaaaatcagcaccaaatgatgctctgccctcaaattcatctagatttaccctgatacccgtgtctatcacgtatacattgacgccttctccagtccagtcaccatcgtagaaaaattccggtccaagaagacgatcttgtgctcttacggcaccttctttggataacctagccaggtgatcaggagcgggggactgcaattcgatatcgcaagatgagacgataatgtcaggagttatgtctgcaatcaacgaattcttttttagttttctacaagttctgttgtgaattcaccaacaaaaccttcgaacgttccaaaagagatcttttttttgattcggtcccttaaaccatgaagagagattcggttctcagcagatgcatctgcttcatcctgtttgaacaagaggtctagtgtgtgaggcttcttcagacgaacaaaatattttgctgcttcagtaggataaatttgccccaagaaaatatacaagagaagcagtaaggaagcaaactgcatagctatgtaacagggacagaagcaaaattaggagcggtatggcttacaaggaatttatcactttgttgagacaaaaattactaggaaagttctccctttttatacgtctcgagaaagagtagagtgagagtacaaatacattaccagatgagcagtgactcagatcattgaacaattataaacaggtccttaaaggtatataaacataaatatataaaaattaattcaacagtagcaaagtattgtgttttctatgacttgatcttagataaaattgattccttttcggtttcaggaagaaggttgatcaattcagccaaactcttggaagtagtatccatatcagttctgacaagagtagccagagttcttctaacatgctcagccctgagctccttgatattggcgtcaagagctttacggttttcttccaaccaaatggcaaccttctggtcatcttccaaatcaatcgatgttggcaaccaagaattgatcctcgagatcttgtccaatctggtagcagaagcagataggaattcggtaatacgcttaatgaggtattcctcgttcaaacgacgacggactctccagaagaagaaacgacgagaattaacccattccagttcctttttaatgacacccttggccaacatacgaccagatctgtcatgaagatcagcaaattgaatagagatttgtgcataaattggcaacaattgcttctctctctgctcaatttgtttcttgatctcggaaacatccttttctgaaagactagtatcgctaaccttggatttaagctcagcatatttggcatccaatcgttccatagtagcaaggagtttgtccttacggtatttgatacctaccataccttctggttccaaaacacctgctcttgattcgacgtctgcatacatttccatcatgtcttcattgatggtagggtctacaacaacccaagatccacctctcaactcagcagtgggaggaatgtaagtgaagataggctgcttgaagtcgactaaagcatccacaatgaaagaaccgtatttcaaaacttcattgtacatgtctctttgaccaccagagaaacctctccagttggccaaaatcatcaagggtagctgttcaccattgttgaaatcgttgatagcttgtgcagtcttgaaggcactgttagggtaccagacttgaccagcttcttgaatcatcatttcggttgagtctggattggcgggatcagctggaatcaggttttctgtgactctagtttcaacaccaatgactcccataggaataccacctaaacgggctcttccgacgactacacctttagcccatccactcaaagtttcagtgaaggacccagagtcaaacaatccagattcgaactcaccatcaggagtttcacgtccactgatcatccatctgacgtcgtacggctcatttcttgtaggcttatagtccacatctctgtcccatttgtcatgaagtgattctaaaataggaacaggcatgtttctcttagcaggcacataagctaaccaatccataatcttttcgacacctgcgagatcatcattggcggttaagtgtgaaacaccgttcttgtacataatctgggtaccaccaagttgcaggttggaagagtacacttccctacccaacaacttattaatagcaggggcaccagtcaaaattattggttgtccttcaatttgaatggctcgttgacccaatctgaccaagtaagcaccaataccaacagatctacaggtgaccaatgtgatagtgaagatgtccttgtacgcccgagatgtagcaccagcgatcaaaccggaacctcttagacattcaacacccagtccatcactagctccaatgatggcagttataacgtggcgttcttcgccttcttcaactattctttgagtggtaacgctgttagactttccggacttttccaatagagtaagatcttccgatgtgaggtataagtattcaaatcccttgcttggtttaccttcttccttccaggctactttgaataatggaagaagttcttcagcaactccaattctagcacccgagttggctgacagataaattcgaggaatgcccaattttcttgcaagttgtgtggccttgttgaaatattcatcttcttgagggccaaaggatccgatcttgaaggtgatatcattagcaattatgatgaaatggcgaccgcgtggatactcaggagtttttgcggttaccttgaaggccaccatacccacaacgttggcgccgggttctctgcttacttcagttagttcacctgaatcatcgacgatcaattcattggccacaaacacatcagaaggaactctcgcagtaggagagtattttttccattgggagagcgtagcttgacggaataattcagggaaatcatacacgtaagtagtacccataagatgagctttgtaacgttttggttgaagccattctttggttgggtatggtgttgaaattggtctaaggtgcattgaacctggtgtaggaccaagacttttgaaaacccattccccatgatcatttttcacctcttgatacatttcagatttcacaacgtatcctgaaacgttgttaattaaagcacgaagtgggaatgggataccagtctcagggtccgtgcacataatacggatttcagcagcagaaacacgtagtctccacagcctacgtccaaacctttctaagaaaccaccgaacgctgcttcaacgtcatctggcgtgacattgaaaacagcagagaaattgatgaatatatggttcaaatcagtgttggaggtatcaataatctcaagagcgtccaaaatgtcactcataagacgattagcttcgctgataaggtattcagagatagtcacatcctctctgattctgcttgttctgatgatacccctagtaaaaaatctcctgtcaatgcatgaagtatttttggcaactgcctcatacacatgaatatttctattctcagttggaacaggtttaatattgaaattggacaatcttcttagttccagctggaacgcaagagcaggctctatgtgacggattgtctcgtcttcaaaatagtctggaaatttgaaggtatagtattttggataagttccaaccttgtctcccaagacaaaggtaactcttcgaacgccactagccctgaggtcgtctttcaactcagaaagaacgctgctaatcttgtcaacgatctcagcctcactgttgtagccagaaacattggcaatgaaaacattgcatacgttagtaggttgctcaggagccacattagttctgtcaggagctggtccattgttacgtggacgtttagggaagacatcaatggcagatgacaaggactcctcaatgtcatctaagtggtttgtgggaattatgatacctgttctcaaaggttgagaatcattcttgttgatcatgaaggtcaaatcggagacagaaactgctctatccattgaaatagaggatcggttactggaggagtttctcatagcttcaggcacggaattgtaagcagctgttgataacagcggcaattggaacttccattccacaattgggagagcagaatcacctacgaaatgatgtttaacttctctcaccgagtaagccctgtaagctcttcgcagatacacctcggctgctgctgcaaatatatacttgtttgggctaacaacaaattgtgtcaaaacatcgaatacaatgtacttggaatcaattacgtcttgtataacgtccaagttaggcagtttgtagtttccattgaagctctctccgtactgagtttgtacaactgaagatcgaaggatatgctcgagctggtctgaacgttctttgatagagggaagggaacattgaatcaaaatctctctagcttttaacgaaacctttgctgtaaatctagaatctagctcaacaatctttttcaaaggtttcttcaaaatggttgcagcttggagatcattttggcagatagtttgataaatttccagaatagctctgattaaatggttcttagctccaactctggaatgtgacaagacgacatcgatgaccttgtcaagggacgatttgttctcatcacgtagctgtaaaataacatcttcctcccttttatcggcaaacaagctctctatgtcgtagtattgggtgatcaaatcggcgaatacattgtgttcatgaacttcaagtccatgttcgtagcttttggcaacagcagtaagaggcgcaatgacctgggagaaaagtggatcaggattaacagcctgctccttgtccaaaagcttgagcaagtgcttagctggaaagtctgcaccacgttgatgcgatctctcaatcaaactggtcaattgttcgtccaaatgaattggtaaccttgaatgaagtgcagatatcgaatgattccattccgaataaggaagttcagggttcttcaacacatccaatagactctgcagagtatcgttcatcacaacttgattatcataccctgctaaaatgtttttcagcacggagagaagagaaatgaacttataaactggtttgttgctatggataaatggctgtttcatatcagggattgtaccatcgaatggcaaagcatgcttcaccttgctgggatcatccaatgcaagaatagcaaggatgtctccagcggcaaccgaagatcctggctgcttcaataacctgatagttccattctcctgactgaccaaaggcatacacatcttcattacttcaacttcagcgtaaggttgtccaattttgacgtgatcaccgtgttccacaagatatttgataagtttacctggagatggagtacgaagttcagttggctcatgctcaacttctaaaatgcaagatttaccatccaccgacaacctagtatttccgacttcttcctgcaagtaatagacagaatgggatttaccatcaagtgctaccaataaactgccatccttcaaatgggttacacttacagtaatcatacatccgttgacaaagacgttgtatttgtcaaatgcagcctgaaccacagtaaacttgtacttctttccttcataaataaattcaattgggaaaatagtacgaagaagttctttgcctgggatttgacctttttccaagctggcaacatactctttgcggcaaagatcccattgaatgtacgctttagtgacagcaccacataaaattgctgtggtttcatcaggtctttcagcagtcagcttcttcgagatcagttcgtccaaccaaccagtagtgatggtgttgttctcgaaatcagctgtttccaacagttttattaagtactcaattgtagttctaaagtcaccacgaatagaaagctctttcaaggcgacgaccatattttttctggcgatttgacggttttcgccaaacgagaatatatgaccaaattgagagtcactgaaagaatgaattgaggatttgtttcctacactgaagtaaccccaaacgctagaagaagatctgaaatttagctcatatagagcaccaccagaaggcttaaaaccttcaccaggatcttcagatgtgatacgacatgcaatagtgtgaccctttggaatgggttttctttgactcttcaagctttcttcagttttgaattcaaagtcaatttctgtagcgccatttggttcaagtccgtaaagtaccctgatatctctgattctattcaaaggaatacccattgcaattagcaactgggcaactggaagattgacacctgtggccatttctgtggttggatgctcaacttgaagacgagggttcagttccaagaagtagaacttgtcctcagcgtgtgaatatagatactcaacggtaccggcagaaacgtatccaaccaattgacccagtctgacagcggcttgttccatttgcctgaaagtgtcttgtttggcaatggtaactggtgcctcttctatgatcttttggtgtcttctttgaacggaacaatctcttccaaaaagggagatgttggttccatattgatcagcaagtaattgaacttccaaatgcctggcatctccagcaagcttcatgataaaaattggggaacctggaatttcattagcagcttgatcataaagagaaagaaaatcttcctccctgtcaacttttctaattcctttaccaccaccaccttcggaagctttaatcatcacagggaaaccaatagccttggcttttgccaaaccgtcctgtggatcggaacagcatcctttggcgtacgtttcttcatcaacggaaaccaaattgcttacggggtcgattataacctgatcgacaccagttcctgaccaaggaatacatgggactttagcatgttgtgcgacaatagtagaggaaatcttgtcaccaagagatcgcatggcagagcccggagggccaatgaagataatcttcttaggagaagcggccagttgctcaggcaaatggggattttcggaggcaaaaccccaaccagcccaaacagcatgagcatcagtagattctgctatttctacaatgaggtcgacgttcgcatagttgttgtttgcagttcctcctgggaccatgacatactggtcagccattcgaatatattcagcattagcttcaagatcctctggggtagccataacaataaattgaatggctctatcgttaccaaacgtttcatacgcccatttcctgacggaacgaatttctttcacggcagctataccgttgtttgcgatcagcactctcgtgatgaccgagtggccaccatggtccctgacaaagtctctgaccttggagggagcagcgacttcaaccgagttgagaccaaggaaatgcggcggtagctttgaatgacggagagagtggttaacactactcattgttctgcgatgtagttgtatgttgttcaacctatatctaaataaaaggttagaaaaaagaacattacgcatggaattgtggaggtattagcgttttcagctaactttccgcttttggtccagattagaacggttgaatttgacagatatgatgaagactgttatgcaatgcagaggaaagggtgttgggccacagagggagccaagaagtgcgctccaagctccttcgcgaaagaaatacaccttcccagctagaaggtgggtagggcgagagccttccatgaactgctcatccgatcattgccctgttgggtagaagagcagaataatgtggaccagaccctctccacacattgaaaaaaaacagttttcactcaattcatagtacattctgtctaattgaatcaattatcaagccaataaagtaacctttcaatctaagcccaaaaaaacggaaaaactcaaaatgttatacatacccttgtgtatatgtgaaaaatggtccaaattgtgaggttgtgaatgcactgaaattagcaggttttgtgattcggaaagctttcaatagagcaaccgggttcgacaaacggtacaatttggtgtattaactggtaggagaagtgttcacagcagctatagagacgagacatcgcctttataaaacgcgattcagagacacgagaaatggtcgtgttgcacacgacgttgggccaacaaaaaattcaacaaaacgcagtgcgagtgatgtcaacggcaggtagtttgcggctggttacccaggtttaatctacagaatgctgttggatgttgtttgaagatagtgccccgactcaaacatttgcaagaagagcgatgttaggatgaaaaatgaaggggtacaacaacaaccttgtagtaattggtgattggtgattctggtgtgggtggatagcagcaaattgggtttcagaggatatacttccgcaattacctcaatgagggactccaagtacctcttttgctcacttcacacagcttcatttccttttgcctcgtaaaattttacaacagcttcacttgtcttgtcaattacgtacagttggtcttgcacttactttagttctcgcccaccaactaacctctctccttccagcagctcccgccactcttttctagcaccttcccccctaccaacaaacaattacttctcgctggccgtgaaatgaaaaaatttcaacatttatatatttattatacaacatcatggtgtggccttttggaggaaacaacaacaaagagcaggaagctgcacctgaatcaagccagcaactccaacaaacgctgggcttcgatcctagcaccatctccgatgtttccaatatcatcaagagtcctggtgtgtttgatacaaactccctccacccgttggccggcttagacaaagacctcgagtacttagatttggaagatgaacaactgtccccattggaaggttctcagggtttgattgcatctcgtggatggtctgacgatttatgttacggaacaggaaccgcctatttgctaggtcttggaactggtggcctctacggattccgtgagggggtggccaatctacccaaaggtgccgatgtcagtggtaagttaaaactgaacactattttgaatcacgtcacaagaagaggtcctttcttagggaattctgctggtgtcctagccgtgacttacaacatcataaactcaactctggattccttccgtggtaagcacgacacatacaactctctggctgctggagctttggcaggagctattttcaaatcttccaagggaattaaaccaatggctatatcctcaggattgatggtgcttgctgcgggcgcctggtgtggactcaaagagcttctgtcgtaaacgcctacaacgcattgtaccatagataattaacataagtgtgtatataatttaacgcctcttggctgtgtgaccttccggtgatggagatcttttacgaattaaagtttcttctgcgtcatctatgctggtggtgtctgtgttgacatctagcggcgtattttctttggatgatggggcttcccaggtcgccacttcaaacagtttcattaaatcattatgttcttttgcagaagacaagtctcttctaatgggatcccctccaggcacaattctccctaaacagtatttgctgtttcctttccaattagcaaatcggtctgcaaactctagaaactctttacatacctccctccaaggcagagggacttttcggaaacaagtagggtttaactccgcttctgaagcaaccatagctccaacatccatgccatatttctcttgtattgcaatgaaatcattgcgatcttttataccaccattaatcaccaaactaactttgttcgatctgcagtgatccaggataccttccaggtagtctctgatgggagcttctctattacgcatattcttggtacgacaatgcacagtcaaattgctgatccctgtcttgactaacctttcaaccagttccaaggtcttttgttcgttctcaagtactctaattttaacacttattggcttcccattggggcgtccaacttcggttaccagtctagttaaaatctcctccaacaacgcaggagtactcaataacgcagctcccattccactgtgtatactaaagtgcttcggacaccctgcgttaacatcaataccactaacatcgttcaccacaatcttagctgcacgtaccgccaattccggattagccgtgcccatttgaaatatcagctttcccttttctgctggtggatatacacgaaacacaagattggttactccaggaacttttgtgctccctccctgacttagaaaatcgatagttccaagtttcctattttcaactctttcgcactgaagaatcttcttatcgatggtttcgggaccccaaacgagatcagcaccgtgtttaagagccaacagtcttgtgggaagctctccaacacgtaccatcggtgctagaacaaactttcccctgaaatcaaccatttctggtgatcttatcaatcttctcttgaagctggggacaaaaaaaaaattgatatcgttttctcgaactccacccaaacatcctcatcattgggcccaggggggacggacccttggaatttcatccctcgcgctgatattttcactcgtctcacctttaatcttagataccagtgcttccacgtatcgactttgtcgcgggttacaaagataagttatcttcccaataattcttcacacctaagtaacacagcagaattcacttgagaggtgcagaggatgaactttgccaaatatgaccgcagtgaagacttgtcggttcgactgttggatcaacaggctgagccagagtttgagggcaaaagtattccagaaggagccacgcaacgagttccttcttctccaccagagcctttcgactctccgccgacagcaaaactgaaaccgaaaataatacggatgttcttcaagtatctgaagtttcttgggccagggataatggttagtgtggccaatatggatcccggaaactacagcacagccgtatctgctggtgccaagtttgaatacaaactattggttacagtttttgtcagtaacatcatggccatattcctgcaaagcttatgcacaaaactcggatgcgttacaggtcttgacttagcacagaattgcagagctcatctaccaaaaaaactaaatctgctgatgtatataatggctgagctggcaattatagccacagacttggccgaggttgttggaacggcagtctcactaaatatcctgtttggcatccctttattttggggtgttgttttgactgtgattgacgtgctggtcgtgctgatggcctatagaccgaatgggccgttgcttattatacgtgttttcgaagggttcgttggccttttggtgctggccaccgttatctgctttactgtagaattggtcggtattagcgataccactgactggcgagaggtctttgttggctacttgccctcaaaaacagtattcaaaggcgaaggtctctacctgagtctggctattctaggagctacttgtatgcctcactcactctttttgggctcaggattagtgcaaccaagattaagagatttcgatgaaaaacatggctaccttcccaaaaaatcacttgaagaaataggttcctctcggaacgttgtggaaagattctttgcaaacgaggaagaggaagcacatagtccttataaaccatcgttggaggccatcaacgattccatgacctatgcagtgacagagcttgttgtttcattacttacagttgcactatttgtcaatagtgctattttgattgtagcaggttccacattaaccgacaaggaaatcaccagtgacgacgcagcagatcttttcactatatatgaactattatcagagcatttaaccaagactgctgggctagtatttgcattggctttgttattctctggccaaagtgctggaataacgtgtaccttagcaggtcagatggtttgtgagggatttcttcgttggaatatgcacccagctgcccgacgactaatagtaagaggcatcgcaattgccccttgccttctactggtgcttgtaagcggcagagaaggactatccagtgctttgaatatgtctcaagttgttctttcgtttttattgcctccattagctgcaccattaatttggtttacctgtaacaagaacataatgaaagttcctatatttgacaggaatgccccagaggaatccatagaattacaaaacttgtcgtcttcagaaagactaaatcagaaccctgagctatctggctctacagatcacatcgcctacaaagacatgagtaatggcgtactaacctcagcgaccgctgtttcaatttgggtggtaatcagtttcttgaacatgtttcttctggcaaacttgctttggggtagcggaactatttagcccattagacacgcttatgttaataatattagatactgaaaattgtctggacggtacttttgtaggcgggatctttgttcatgaaccctctggcctgccctcgaatatctagttttctcatcgccttattctgtctgggcaagtaagtgtgcaatacatatcattccgctccactcaatgaacgattcggacgatgattacttggaggtggatgagggcatagaggagaacgatctttcctttgataaaaaaggtgtggcccgccgaacccgtaaggaaaatcaaaaacagaaaaccaccgctaatattgcactcaaaggttccaatgggggatactcatgggaggatgagtatcatagatcctgggacattgtgcaagaggatgaagcagggtcactggaaggaatcgtaactggcattatggaggctcacaagaagcgatttctgaagaatgtaacaccttttcaaagaggtatcatacgatcaatggtgttggtaattgacttcagtaaagtcatgagtgaaaaggatctacgacctaatagagcggctctcacgattagcaacgcaatagaatttgtcaacaactttttcgaccaaaatccaatatcacagttaggaatagtgctcatgagaaatggaatagcaactttagtcagcgaagtcagtggtaacccaaacaatcatgtcgaagctttaagaagtataagaagattggaaccaacaggagatccttcattgcagaatgcttttgagatggcccgaggtcttctactacataccccgtcccactcaactcgagaaattttgatgatctttggtgctctgttcacatctgacccaggagatatacatacaacgatagactctctcgtaaaagagaaaataagagtgaaaattatagggcttacggcccaggtggcaatttgtaaagagatctgtcgaagaactaattatggagatgatactctttacgcagtgattctgaatgagggccacttcaaagacctcttattagatgcagtgactccattagccatctctaaaagtgcccaggtagaaatgcgtggcttcactttgatcaaggcaggctttccaactcgaatttcggaagcaataccctcattctgtgcttgccattcaaaattgatacatggaggatatatttgtcctggctgcaaatccaaagtctgcatgttgccaacagtatgcccctgttgcaacctgatgttaattctctctacccacttggcaagatcataccatcacctttttcctcttaagttatttcaagaagttcctctagctgaaagctacatctctacaaactgcttcagttgtcttaccgaatttccgcaaggaatgagtgaatcagagcgatccaactcagacaacagagccaaaaaagagttccatactagttcaagataccagtgtcctgactgtaataagcatttctgtgttgattgcgatgtttttgtacatgatgtactacacaactgtcccggatgtggctgctgattgaatcttcatgttattttcaaagattttaacagaatgatgaccatgcgttcatctcagtgatcccaaatcattcaaatcatccaataattttattattttttgttctgcaccactacatctctcgtcaaacaagagttgaattatttcaagaacgttatacgcatatatacatatcattgaacgcataatcattcatagtcctcatgctgaaccccaacctcatatgacctgctagctttatcaaaagcgataatgcctttccgcaccgaacgttaccctacctagcgcgactgttatcggacaaatactggatagcttcacctaccaaaccaaccaagcagagtcagccagaccagtaacttttcgtttttccctaaaagatataaaccaactctatcgaagcgaagcggctgttttctaatagttgtcgaaaagtatcaacatgtccaaatcatttgttcgtactatcaagaatgtggccaatggttacacctcggcgcaggttatggttcgtaatgcaacctcaaacgaacctcatggcccaacgattgctcagatggcagacgtagctaaccacacctatgaaagtgccgagtttcttcccataatggatattatagacaaaagaatgaacgacaagggaaagaattggcgtcatgttgccaaatcattgactttgttagactacttagttagatacgggtccaacaacgtggtgatatggagtaaagacaatttgtatgtgatcaaaacattaagagagtttcagcatgtcgacgacagtggcacagatcagggtgttttaattagagttaaggctaaagagttgactgcgttgttgcaagatgaggagagacttcgtcaggaaagagaaattgctcgtgaaaaacgtggcagaagaagtggacgtcgtcgtggcgatgatgatgattttgatcaatcttctcgagctgaatctcgtaatcctgactcaccgtatgatgaagaactacaacgtgctctagatgctagtaaggagaccgcagaagaagaagaaagacgtagacgtctacagtcaaactctgatgaaagtcttcaaaaagctcttcaattaagtaaagaagaggaagaaatgcgtcagaagaacaataatttgattgatttgggacaacctgccccagtatctggcccagtaattattggctatgatgtatttgggaaccctatttaccaaagtcaaactatggctacaggtgttgatgttttgcaacagcagcaacagcaacagcagcagctagcataccaacaagccctattggagcagcaacaacaggctgctcagcaacaggcttatttggaacaacaagcttatcagcaggcgttagcagagcagcaagctgctcaacaagcctacttgttccagcaacagcaacaacaattgcaacaacaacagcagcaacaacagcagttacctttacagacaggatccaacaatccattttcctttggtgggccttcccaggaagattattctaacaatgttgctgctcagcaaactttccaaccgcagcagcaacagtttgagcaacagccccagcagccgcaacagccccagcgtgttcagacccaaagaactggatctcaagctcataacgataaatactctgaactcaataatttgctagctcaaggaactggcatagacacttttggaaacacgggagatacccgcgtgcctgctcagcacaccaaaactggtacatttattaattctcagggaacggggtataaacaagaaaacttttcatcagcaaatccttttgtgggaactcagtatactggaatcagctctacgaacattatccctgcttacactggatatggatttggaaaccagaaccagagtcaatcccagagtcaaagtcaaagcggaagccgtaatagccgtgcgaacagtaccagtctaatcgatatataaagtaggccgaaacaataaaataagtcaggaaatgatgttggaattatattcctctatatgctatcatcgtctcaagaacttgcggtaaacgacattatcagtttcttctttgtagtcatagtgtaggttggaaagaaactgttggaatgcttcttcatctgttgaaggtaccgatataccagctaataccttgccaacgtcgtggccatggttacggtagtggaacaaagtcaggttccaatttgaagcaattccgtccaagaatttcgtcaaagctccaggacgttctgggaactcgaatgagaataacctctcatctggtagatcagcaactcctcctaccaggtatcttccgtgtagcttggcaatttcgttcttactgatgtccaaagcctcaaatccagcagctttaaattcactcattagttgggctacctccttggaacgatcaatcacactgaaggaggtataaatgttagcaaggccgtcgtgagcattattaaatcggtaagcaaactcggtaacttgccttggatgaatgatcgattgcaatttacggaaagtgcctggaacatctggaatttgaattgacatgaacacttcttttccttcacctaacacggcacgttcagcaacaaatctcagacggtcaaaattaatattggcaccggataaaataggaacgtaagtagcagagctgtggttcacttctggatgattagcgatatatcttttcataccagcaaccgacatagctccagaaggctctacaatagtcctactgtcttcaaagacgtccttgatggctgcacagatctcatcagtatcaacacgaacaacctcatcgactgtatccttcaatatttcaaaagtttcttctccaagaatcttcactgcggtaccatcggcaaaaggaccaactgaggaaagctcaactcgtttctttgcttttaaactctggtatagtgcatctgcatcaaaagtctcaacgccaactatacgaacatgaggtgctaatcttttcaagtaggacgctacacccgcaagcagaccaccacctccaacaggaacaaaaatagcattaaccttatcaatattcaactgtctcaaaagttccatggcaatagttccctgaccagcaatcacataaggatggtcaaatggggggatatcaatgagcccttcctcttgggcaatacgtgcacattccttcttagctgcatcaaaatctgcaccatgaagcaccactcgcgctcccatgcgggccactgactgatacttgatactaggagtggcagttggcatcacaatagtggcaggtattcccagctttttggcgctaaatgcaattccctgagcatggttgcctgcagagcaacccacaacacctttactacgcttctctggcgacagttgggcgatcatgttgtaagctccacgtagcttgaacgagaatactggaaggaggtcttctcttttcaaaacaacgttactattggttttctgtgaaaggttaacggcgtgtgtgataggactttcgtctgtaacatcatagactctgcttgtaagaatgagtttgacataatctggatgtccattcggaagacgatcggcctgcctcaagtcggcgtacttcgtgtgagagcgacggacccttggcaacattgaagccaagggcaaaacaaaagaggctccagttgctgttgtaagcaaacgcggagcacttaacatttgggtatatgtgactaattggaagcttagcacgagtcaagctctgaacatttgaggtactgccgcgaatgaaaaaaaaaaagcgataaagaaatatcagcatcacgtgcacgacacgacgttttccttggttcaatccgcaaatatcttgctaggcttagatctcttggccctcccttccattacacccttcgcgctccttaattctcaaagttaaaacttctttcccttccttctattcaacaaaatatgtggagacctcttgttcttgtactggctcttctgcgggtgctaagccctgccaaaggcctggagttggagctttccgatttaagctcgctacaacacgcaacctcgttggttgcagatggtttaatggactattacgaaggatttcatttaggaggaacaataggtatgttcaccaatccttactattggtggcagtctggagctgcatttggttcgatgctggactattggtggtacatggaaaatgatacctatcacgatgccattatgcaggctatagtttaccaggctggagacaacgcggactttatgcctttaaatcaaacaactacagagggaaacgatgatcaaggattttggggtatcactgcgatggctgccgttgaaagaaacttcaccaaccccccagaagatgaaccacaatggttgtatctggttcaagctactgttaacaccatgtgggaaagatgggatcttgagcattgtaatggaggcctaaggtggcagattttccagtggaatgctggttacaattacaaaaacaccgtttcaaatgcctgtcttttccaattgagtgcccgtttggcacgatacacagcaaatgatacttacatcacacttgctgaagaggcctttgactggatgtatggggctgggttcctaactgaaggtgattggtggttcgtttacgatggagcatttgtggatgataattgtacagaaattgtcatgttacagtggacatataatgcagggctgatggtgtctgggtgtgcataccttgctaactatacaggcgacgagatgtggttagaccgtaccgaaaacttcctacatggaattcaagttttcaccaatcaaagtgttttctttgaagcagcatgtcaaggatctggaaactgtaacacggatcaaagatcttttaaagcttatctagcgcgtttccttggtcttactgcacaaatggttccatccactgcagaaactattatgaactggatgaatacatctgcggtggcagtagctcaatcatgttctggaggtacagatggacacacttgtggtatgaactggctggccgatggttgggacggcttttatggattaggagaacaaatgtcggctctggagaccttacaaaacactcgtgcacttgtcagacctgctccttacaccgcacaaactggtggttcttcgcagggagatcctgctgctggattaggagtgaagacggaggctgtgccaccgttgaaattaactaatgcggacgttgctggtgccgccattatcacagccattataggactatcagttattgccggtgccatttggttactcttatagttaagtattgtttcaactatgtgttattattaagatacaaaagtctatctacaagaagaaaatgtgcgtataagggggaggggtcataagggtgttattggagttgaacttagttggtctccattgctgctggttcttcaactttttttggttccaatgctttagctttcttcttatttctcttgattctgtggtcatcgacgccctcctcggcttctcgttgttcctcctcagccagtaacaccttccagccatctctattcgatttttcagctaatgaggtatgatctacagcatgttgttcttcgtagaaagaaagaccaattgaacctaataacagacctacagtcaggaattgggcatacattctagcttgaacaaacttttgagttttagtcaaaatggggtctctatcgacgaacacccacgatccgtacatagacaacgcccatagaccagtgataatcttatatttgtgctcggacagtgtatccacaaccttctgcccaatggacatggagttccatctcttatgctcttgaagcacgactctctgcgtatattcggagctatacatttgttcgtcaaatgcagcggaagacttctcggcgaacacagctgttgccagagttggaggaataattgctactgctgttctgatagaccatggaagcttgaataatcttgggaactttcgaggggcaataccatagatggctaaagagactgaagttcctatgatggcacctttgactccaccccagaacacggcggtgttatgtgcatttatctcttcctctgtgactaatttcattctctgtgcggctctttgtttccaactgataaaggagagtctgttctatgcgccctgattcagatgttcttaaatagttcgagagggaatttcttttgtcggataggaatcacttgcacggatcatatcctattggatcaaaccccgtggcgcgagttttggattgtccacccaactggaaggagtgaaatcgttcccagaaggccactaactcccttccagccagtagcatatccctgaggaatggtttcgggcttttaaccagagccccctagcagcgtggtcccatttttgcttttctttcgcagagaagccggtttagggcaggagcggcagaaatatgggccaaaatctttaggcacgaacatatgagctaattccattgatttcattcaccatgttaggtttttctttcatttcactcatgaattttctactacactagatatccgatactacaaaacatcatgaagaattatggtctctttacgttacaaacaaatacctataaaaaagcaatctagttttgttcagcctgcttttctttctcggcctgttccttcaagaccttttggacaatcttttgctcttcgatcaggaaagctctgatgattctttccttgacacagttaccacatctggaaccaccgtaaggtctgctcacagatttgtcactcttcttagctctggagaattctcttggtctaagagcaacgacacctggcagactgataccacagtcaccacactttggggtagtacctctcttcttggtgtgttgagctctcagaacaccacctggggtcttaatgaccttgatctggttggacttggtgttgtctaaaaaagtgttagtaaatcgaatgtgaaaaattatagaaaagtgaaaagtcatagactgtgagcaaattggaatgaaaaatattctttttaaagagtttactggatcaatttccaataactggcttcgtcgaatgtcaatagaggcgttaaaattcaaaaagaattctcttcgatcagcagttcgaaactggaaaaaactgttctgacgtttcaactccttctctacttcatggtccaacgtctttcacacaaatgcaagcactaatacatacaaggatttcttcttctgtaagtaactctttgagccatctttgtcaaccgtatgtatagatagaggtgttctagatagtacaagatttttcgaactgagaacgaggaagggaaaattttcgtggtgtacgagggtcaaaaaaattagaaccctttgtaatcgcacgtgatttgggttcgtattcacttgccattacaccagatgagtagctacgcaatgattacgttatcatgtgaggaggtctaattaagggcaagtgataagctattcacatagagttataagactattgatttaataaactgggcttcttttttgggatttgatacaagagtatgaagtgatattgtcacgtaaattcagtctagtttctttcgaccttctcctgcttattgcttctcgacggcaattgcctcaacctcgacttccacacccaacggcaattgcttaacagcaacacaagatcttgctggtttgtgagagctgaaaactttggtgtaggcctcattgaaagctccaaagttggccatgtcagttaagaaaacattgaccttgacgatgttttccaatgaagagttagaatcgttgaggattcctacgacattcttcaaacattgagcagctttatcgccgatagtgccttctactggctttccttcgggagtgtaaggaatttggcccgaaacgtagacaaatccattggctttgacagcgtgagaataaggccctgctgctggaggagcgttggtagaggtgatcttattaggttagtaaatttgctttagtagccatcgaatttagcactcaatgcgcaatgaaataaacatacagtggtgaccattctggaaaatgtgtgtgcttttggtaaagaggtggagatacgggcaatcttattaaagagcaaagacatcaaaaacagagagagataaggagggagactaccggctcctttagaatgccacgttagatttgaaaaatcgcaccttccacgaccttatcgggtcttctggaatgggaactttagatagatcgaaactgtgagttataccttcacatatagaatttatcttcacatgtctagggccgccaagttgacgtttggaataagtacagcatttgctgtgggaacggccattggggtttattacttacaagagcaagaaagagaagtaagtgaactcgttttttgaagggctgaaaagtttctacagttcaacctaagaatttactaaccaagcaggctttgaaacaaggacccattaaagaccaaaagaggctggactcccgagctgaaatgaccagtaaacaaagagctaacttgcgggaattcgaattgcaaaagaaattgaaagaagaattggaggccacacaacctttaacgggggacgtcattcagggtttggaaaagggaaaagagtaaacatggagaaagatgaaaaaaaataagcattatgtaatgggtattttagtacgcatttttctcccactcttcactgccacatgcacaatccaaacccttgctctttctctatcgggagcgggcaatgccgaaaacatcaggtattcttcaattttgcaaaaaaaagtgatcatcaaactacagcaactttcaactgtacataatttgagaagctgagccagccaattggacattcttaccttgccctgtaaagttttatcgctctgttatacattcctttctccctcccccacctcctatgtcctatctcaggtcgtgtattcgcaaatactgcacttgaccctgtgggctcctctgctctcaacaaaccaaatcacttcggaaccaggacttccatacacctaggattaagagctgataacaaccgctcgccatctgcatcaagcgaacgctcacagtattgatacactatcacgtttcttcgaaatcaatcgcacaccaattttctttcattgcaactttgttatcattgcgttaactacttacactatcagctcatgacatcgagtagatgagttacaatcaacaaggaaatacactaaaaggtgtgcccatacccaataagaacaagcgttcggataatcatacggtacacggagcgtctagctcatcgttgcaccatgattcgtttagcccatctgctcagccgccattttacaacccaaacgaaatatctcattcacagaactccctaagccgccagagttcaagtctgctgacatccaaccttcagaatcgcaggactcagcctgcctttctagagccagaattgtactccaattcccccaatgagcaagcagccaggtttcaaccttacgtcactcataacaatcacaactcaccaaatgtcgtaagttcttcttacatgtcccaaatggcgattcaaagaccttcatcggaagctgtctctacttctgtcctccccaatggaggtgttggcagtttccagcctgctgtagcagctcctactaccaacttatccacagacaatgccttttcaaagccgataccggtggtgacacctcaacatcctggcagtgggttccatccaacgttgcattcacaccttgcttcgagtcaatttattaatcctcaaaactatggccatctgtcgcagtcagttcctaatcggcattttggagagtttgaagttatgaatcgatccaagcagcagccatttaacccgatgcaatcgaactatcaggcccaatcccctcaactacttccgcaagaagcaccacaaccgcaacagcagcaaaatgtcaatgaattggatcctaatgacgatgaggtcctaaacattgcagagttccctatacaggatcttttgctaatgttgagttctctactacaacagatagtggaggcaaatgacctcctccatccgggatactacaagaaagcccaagataaagagcacttaatgaacggaaacaacaagtatattgtatcagttctagcctttcacggcagaaacatccccacaatctcattgcacgactatctgaaaaggattctaaagtattgccccgctactaacgatgtgtttttaagtttgttggtgtactttgatagaattgccaagagggccaacgcaggtgaattcaaagatctccactcgctctacgatggttctaacgaagaacaggcattcgttatggacagttacaacattcacagattaatcattgctggtatcactgtagcatccaagttctttagtgatgtcttctacaagaataacagatacggcaaagttggaggattgcctttagaagagctgaactacctagagctgcaatttcttatgttgctagactttaagctaatgatcaaactcgaggaattatacaaatatggtaaccttctcctcaagttttggaagcgggaacaattgaagaagaaagagaaggagataccttgaaatcaagttgcgtccggtatacgtaacgtctcacgatgatcaaagataatacttaatcttcatggtctactgaataactcatttaaacaattgactaattgtacattatattgaacttatgcatcctattaacgtaatcttctggcttctctctcagactccatcagacacagaatatcgttctctctaactggtcctttgacgtttctgacaatagttctagaggagtcgtccaaaaactcaactctgacttgggtgacaccaccacgggatccggttcttccgaggaccttgatgaccttggctaatgtaactggagttttagtatccattttaagatgtgtgtttctgtaggttctgggttggaaaaaaattttagacaccagaagagaggagtgaactggtttgcgtgggtttagactgtgtaaggcactactctgtcgaagttttagataggggttacccgctccgatgcatgggaagcgattagcccggctgttgcccgtttggtttttgaagggtaattttcaatatctctgtttgagtcatcaatttcatattcaaagattcaaaaacaaaatctggtccaaggagcgcatttaggattatggagttggcgaatcacttgaacgatagactattatttgctgttcctaaaagtatgtagcatgtcgtttttttttaaaagggttttttccctattctccactcactttatactaacaactatttttttcagagggcagattgtatgagaaatgcgttgaattacttaggggatcagatattcagtttcgaagatccagtagattggatatagctttgtgcactaacctgcccctggcattggttttccttccagctgctgacattcccacgtttgtaggagagggtaaatgtgatttgggtataactggtattgaccaggttcaggaaagtgacgtagatgtcatacctttattagacttgaatttcggtaagtgcaagttgcagattcaagttcccgagaatggtgacttgaaagaacctaaacagctaattggtaaagaaattgtttcctcctttactagcttaaccaccaggtactttgaacaactggaaggagttaagcctggtgagccactaaagacaaaaatcaaatatgttggagggtctgttgaggcctcttgtgccctaggagttgccgatgctattgtggatcttgttgagagtggagaaaccatgaaagcggcagggctgatcgatattgaaactgttctttctacttccgcttacctgatctcttcgaagcatcctcaacacccagaactgatggatactatcaaggagagaattgaaggtgtactgactgctcagaagtatgtcttgtgtaattacaacgcacctagaggtaaccttcctcagctgctaaaactgactccaggcaagagagctgctaccgtttctccattagatgaagaagattgggtgggagtgtcctcgatggtagagaagaaagatgttggaagaatcatggacgaattaaagaaacaaggtgccagtgacattcttgtctttgagatcagtaattgtagagcatagatagaataatattcaagaccaacggcttctcttcggaagctccaagtagcttatagtgatgagtaccggcatatatttataggcttaaaatttcgagggttcactatattcgtttagtgggaagagttcctttcactcttgttatctatattgtcagcgtggactgtttataactgtaccaacttagtttctttcaactccaggttaagagacataaatgtcctttgatgctgacaataatcagtggaattcaaggaaggacaatcccgacctcaatctgttcattaatgaagagttcgaatcgtccttaaatcaagcgctagactcaattgtcaatgagaaccctttctttgaccaagaaactataaatagatcgaatgacaaagttggaaatgagtccattagcttacatgatattgagcaggcagaccaaaataaaccgtcctttgagagcgatattgatggttcggcgccgttgataagagacgacaaattgccaaagaaacaaagctgggggctgagcaattttttttcaagaagaaatagcatatgtttaccactacatgaaaatgattcaagtgttgttaagaccgaaagatctattgcagtgggaacaccccatcttcaatactgcttcaatggaatctccaatgccaagtacaatgcatttacctttttcccagtcatcctatacgagcaattcaaattttttttcaatttatactttactttagtggctctctctcaagcgataccgcaacttcgcattggatatctttcttcgtatgtcgtcccacttttgtttgtactcatagtgaccatgtcaaaagaggcgatggatgatattcaacgccgaagaagggatagagaacagaacaatgaaccatatgaggttctgtccagcccatcaccagttttgtccaaaaacttaaaatgtggtcacttggttcgattgcataagggaatgagagtgcccgcagatatggttcttgtccagtcaagcgaatccaccggagagtcatttatcaagacagatcagctggatggtgagactgattggaagcttcggattgtttctccagttacacaatcgttaccaatgactgaacttcaaaatgtcgccatcactgcaagcgcaccctcaaaatcaattcactcctttcttggaagattgacctacaatgggcaatcatatggtcttacgatagacaacacaatgtggtgtaatactgtattagcttctggttcagcaattggttgtataatttacacaggtaaagatactcgacaatcgatgaacacaactcagcccaaactgaaaacgggcttgttagaactggaaatcaatagtttgtccaagatcttatgtgtttgtgtgtttgcattatctgtcatcttagtgctattccaaggaatagctgatgattggtacgtcgatatcatgcggtttctcattctattctccactattatcccagtgtctctgagagttaaccttgatcttggaaagtcagtccatgctcatcaaatagaaactgatagctcaatacctgaaaccgttgttagaactagtacaataccggaagacctgggaagaattgaatacctattaagtgacaaaactggaactcttactcaaaatgatatggaaatgaaaaaactacacctaggaacagtctcttatgctggtgataccatggatattatttctgatcatgttaaaggtcttaataacgctaaaacatcgaggaaagatcttggtatgagaataagagatttggttacaactcttgctatctgccacaatgtcacccccacgatagaagatggtgttcttagttaccaagcggcatcccctgatgaaattgctattgtaaagttcacagagagtgttggtttgattttaataaaaagagaccgtcactcaatcagtttgaggcatgaatcaactggcgaaacactagattacgagattcttcagatgtttccgttcaattccgactccaaaagaatgggaataattgtgcgtgaccagcaacgagaagaaatttggtttatgcaaaagggcgctgacactgttatgagaacgatcgtccatcaaaatgattggctggatgaagaaacatctaatatggcaagggagggactgagaacattagtgatcgcaaggaagaagctcaccgatcatggatacgaaatattcaagaagaagtatgaggaagcctcgctcctgatggttaatcgggaccaaaacatggccaaggttatctccactcatttagaaagtgatctggaattacttggattaacgggtgtggaggacaagttgcaacgcgacgttaaagcttcggtcgaactgcttcggaatgctggagttaagatttggatgctgactggtgataaggtcgaaaccgctaaatgtgttgctatcagcgccagactagtttccagaggccagtatgttcacacggttaccaaattgtccagaatggataccgcattacaatcgatagaatatctcaagtccaatcaatctgtggctcttttgatcgatggggagtctctgggaatcttcttgcaatactaccaacaagaattttttgacatagtgattcatttgcctgctgttattgcatgccgatgcactcctcaacaaaaggccgatatcgccattcttctacgggatagaacgcataaaagagtttgctgtattggtgatggtggtaatgatgttagcatgattcaatgtgctgacgttggagtcggaattgttggcaaagaaggtaaacaagcttctttggctgcagatttttccatcactcaattctgccatttgacgaagttgctactttggcatggtcgaaattcttataagacaagtgcaaagctcgcccaattcgtcattcatagaggtttgattatctcagtgtgtcaagctgtttattccatttgctcttcctttgaacccttggctttatatcaaggttggctaatggtaggatatgccaccgtttacactatggctccggtattttcactcgtccttgatagggatgttgatgaggctttggcgaacttgtaccctgaactttacaaagagctcacagaagcaaaatcgctatcctatagaacattttttatatggactttagtctcactgtaccagggttgtgccattcaatttctttcccaatttttctgtggattgggtacagatgattttacgactttggttaccctcagttttacatccttggttatcaacgaacttgtcatggttgcaattgccatcaacacatggaacaaagtcatgttcattaccttgttggttacatttgccatttacatattatctgttccatttctgggagagtacttcaacctagattatactacttcaggaaagtttttctatcaaaccttaattattttggtcatttctttgatgccaatatggtcagttaaagtaataaaccgaaaattgagaccccccaattatgctaaggtccaactgtcatagaaaaaccgtaaggctaccctggaaatgaggaatattatactatttagtttttacattttatacattattgtgaccgcagagactcttggacctcttcttccatcagatcttcctcggtgtcgttttcatcctcttcatcttcatcttcatctgacagtgattcgctcttcgtatggtcaaccttctttctttggaaatctttgatatgggcctcgttcatcagtttactaacatgttccaacataggtctcagagtttgagttctgctcaatggagcaccttcagttgatgtcgtagacttggccctggttgcagtagacatcttacgagaaatagcagtagtgcggtggctttcgatatcagacgctttcctaggaatcgtcacaataggagctggttccctaaccttacgttttattgttggataaggaagtggagtttctctggaagctctaaaaagatgcacatttgtacagtgctcattctccattctgaaaaacatccagacaaatcttctgaaaatctctgctaacgcaataaaaaagcttgtaaacgcagattgttggatttgctcagaaaacagtgcatagaaaatccactggaaacgtagcagagtattcagaactacagctccataatagatagctggttctttaaaaattaggtcatctcgcaaaaatatatgtttcgaattggcttgcatcaacgaccaatccatgaatacgtcccaaaaactgcaacccaccgagttaacagttgcaaacgtaataaacattgctcgattgctcatggttggctcaatacgataaatactgagcgtcatgttgtaaaatgttgataatgcgtactttgccaagtttgcaagatgagggaaccaatcgccagtatccgcaaaacgcctgaaacactgaagtaatctccaaatgcttggaagtgatgccaagaaacccatgaccctggaatgggatgatccacaagttgtagaatctgtaccatctaaagcacctttccacttggaactataaagacagatgtaaaacgatatgttacccaatgtataggttaaagagcaaaagatgtcgcccaaaaaaaagtcttgaaactcaacaggatagaatcccgaccatatcaatctccaaagcccaatgagtaaccatctccgagcagaggcgtaaaagatattgaaaggacaaaaaataatgaacaggccaaaagaaactaagaaccaaggccagtctctgcccgctatttgatcgggccaaaagtttctaaaactcaaccatccaaatatagcaaccatgaacaaaaacaaagagggaaacacaaggtattgtctataatccaaagcatccttagtaaattcaaatatgaacttgtagttgactttgtatttggaccaggtcatacaattgataccaatgagcaaacccattaaagatatgagaagaaagcctccccaaatttgcatcataaattttccctccaaaagttccctagtgatagttttataagctgcagtgtatatggcatcgatgagaagaggtatggtcattccaagaagcagcgagctaaaaaatacttgcatattgtatgatctaggggtctcactttggcgaagtttactaatggccactttcctatttccatgctcaaatgtcttagcatacaaagcttccaaagcttgcattatattatctaaaacatcacttttgttgaagtaagcctcgtcgatcttcaccatgaaagcagggagttcttgggtgttcatggttttatcatatttcttgatcatctttctgaaagctgttcggtttaaaagtcggtaggattttagaatttctaaaccacggtaaagttctaacatggccgttttgatttgtcttctagcaacaaaatatggaacaattttgggtttctttctttttccataatcctgcttgttgtaatgtgggtcttgagggcccttcaaacgacgaggattggcagcagcattggaactttcctcattagaggaatccgtaacatcgtcaattgcgttttcgttgacctgagcattactttcataatcatcttctgttgaatccaccgcatcatcatattcatcgtcatcttcttcttcgtagtattgcttttcggtcctctcacctttcacccaatcccaactgggcaaagaggggaactcaaaatgattgatttcagagatcttcttacgaacatgaaaggcaaaggtatccaagtaaaatgccagacgatacgcgccaaatctgggatcctggattggtttatcgtccaactggtttctaattgctgatatcctctgcttattcttgtacttttgctgtcgaagctgagcaacttggtcctgcagcaccagcaatcgactcaagtacttagtttcctttcgcttgtagaaagtattaattttatcgaactcatcatcgatccactccatgaactcattatttgaatcttgctctaaattctgcaatgccacgtcaaaatctgggttgaagtttggactagaattgccagaaattcctgagatgttcgcaagtctttctatgaaagactttctcctggtcgatgaagcagcctgattttgtggagtataagcgattggctccaacaaaggagtagtatcagttacgactcttttgtcttgttgatctggctgttcggcaccactgtgagattcaatcgctggtgggggaagcttggaaaaaggaagattcggcttactttgagaagaattttgtgaaacagtgggcagactactgttgagttgagtaggaagctgcgtctcagctcccttcaatttttctctattcaaaacataattcttgtacagctttttcagctttttcttgccctgcttgtaatcaaaatattgagacttccactcgggtaccaaatcatcatttagcgtttgaccaaatttcattaagattcgaaattagaccactattgcgaatgttaagtagaatcatgattccccagaattacggctgatgcacgtgtcgcgaccgaagggaaaaaaatttccacaggaacaataaggcccatcaaggaaaatactcaggctaccggtaaatcctgcagaaagtgattatttcttagctgtatggaatatgtagaacgggaaataactgaatcaaaaggaaaaggttaaagttaagaaagaatttcgatacactattttctttattttttattcaagtaggtttctccttcctcaatcttcttagctactcagagccgaggacatctggataagacgtttcacaccaacgctccagtttcctgcctcgttgttatgaatggtagtaatttgaatcagtaacgattcagcagtcttaaagtcatggtcagctagagactttgaaagattagacaacagtgtaatcgtaggagcggttaacagctcattgttattcaaatgatcaaacaagatattcaatctcttctcagcgtctacgagttgtttggtaaatctttctggaatcttaggcttaacattttccaactccttactcaggtactcataaatagggaaagcctcatcacttatatgtgatctatctccactgggaaatctggtctgttgttgtgcagggggcccaccttgagatccttgagatccttgtgatacttggtgttgtacagacggcgcgggtggaggtacctgctgaactagttcaggaggtggtggcggttgcacatgttgagctagtgccggaggtggtggtggttgaaattgttgcacactgggcgatcttagtgatggcgcatatccagcagtgctatttgctctacttgctgctctcttggggtaattctgtgaggaaagtcctcccattttctcaggcattggtggcggaggtacaaatccatttagtggaccgtttgcttggccatatgatgcattttgattgttgttagcataagggttgttggcaacagggatagctggtgcgcctccgtgcactcctccattcccattcactgagctacctacgtatggattaggaggtggaacggagaatgagcctccacgagaagacccttgtctttctgctttaggtgcataagggtttgagggagcttgatagctaccttgtctttgaaaacttcctgcttgttgaggggcaggagaaaattgacctcctgacacattatttacggttgaagagtgtccattctctgtttgagagggagctggtgcgtaacggttgggcctggcgtgtggtttagaaactggagatctaacagatgctgctctctgacgaggggacaaaattgcagggtgggggttgttctgtgcgctgaatggtcgtgaaggagtttcaaacgtgctctttggaacacttgatgtggctgtagctgtaggaggtggaggcacaaaagaacttgcttgtggaggtggtggaatcacgttcatttgagaaggtgttctagagggtggctgaatcgtctggttgccttgtgttccataaggagaagcggtcgaagctggtgtagttcttctgctgctgttgaagttattgggcaaatcattccagccactacctccttgtctggattttgttgtaggtggttttggaacttcaggaatggtattgttcaccccaggggctggagaataagaaccattagtattctgctttggagcgtacggattgtttgcaatggaactggcagcagttcttgctgaaggaatagcataagcagaggctggcgcttgcgttaatggctggattgaaggccttgattgtgccaaagtttgcccttgcactggtagctgattcaagtaaggattcacgttaggtgaaggaacagactgcgtggttccggacactgaacctcttgacttgaaccttgcacctgagaaggaagtcgaagcctgacttccaacatagccactacgaggaccagctctactggaaagagtttttcctgatgctgttgagattcgctttatctcaagtttaatgtcttcatcctcggtagataagttctccaataagttcaaggccaaatcaaattgcccttgagatgacaccaaagaagcaaactctaggaatgaattgttcaacgtattaacgccctgcccactgaacttattgctgatccttaatgcatacttgaatgcggcaattttttcaacaaactcagtcaacacaatattatgagcttcataagatgagagctgagggttttcagatttgagaacctcttcacgagaactcaactcggcattccaaattgtagacgccttgttgagcgcaccaccagcaaggaagcaaagcagagcatcagagcgtctatctgaaagggaactggctaatagcctatcacctagttccacaatgaactttgaaaactcttctttctccgtagagtaagcaaaaatagcagctgctatatccctccaaccagagatagtaccattagcaacgaggtcattaacatcgttagcagtagcactgtaaatcaatcttggtagagaggacttttgcgtttggttaaaataggcattcctaactttagcctgtaatgattcagatgcacctaaagccaatactagagcctcctggattagtccctggctgagagctatttcagtggctttttcaagatcgcctaataagagggaggctgccaggcctgtttgatccttaagagaggagacatcaaactcaccagttggagagtatgatggaatgttgacagaaactgaattcttttccctttcaagattgttgaaaaagtcttcatcagtttgctcaatgttttcaaatatgtcttgtccgttttcaaccttttgttcagacttgtcatgtttcaatacggaaggatccacaatctgaaatctgaaataatctttcacatcatccgcttttaatagatcgttcaataattgccagtcgtggttatttgcttcggtacgaagtttttcgtcgacaagagtttggtaatcgtttgtgctgatggtgcttgcaagaagggaagtggacttggccagcgtatcgttagttgtgaaattatcaattacaacaattgactggttatcagaggccttggaaacttttacaatctttccaccaaatccaaatgaaacgctggaaggcactttaagccaggccggagtttgacgttgtaaaaaattaggatgtttcttatcgctgttggacaggtctgcccagaattcgtcatcgttgatagcttttgcttgttgagcctctgcaggtgtagtatcctgtaaggtctgcaccgttatcttaccatcaaatgaactggttgcaaaaatgtcaggaagcttggaagaaaagcgggtcttgaaggcccaattagtggtggttgggtattccgctaacaaagagcctctgatgggattccacaatagggtagagttatcctttccagaagaaagtaatagttctgagtcccacgaacaccaatccagggacaatacacccttttgatgaccttcaagagtagctacaggtacattagtattccttaaatcccaagtcattatcaatggtacagcgtccgaatcagaagctgttattacacttgtcgaattagtaggatgccatgcaacggtgcttaagttagctctttgacctgatggagcagtgtaactcaagttcaatagttctttcttggtctttaaatcccaaatggatgcgtagcctgaggttccagcagaggccaaaatatgacgtatcttggagttccaagcaatggagtttatgtcattaataggggtagtagaagcacccggtgaaataggctctgaaagatgatttatatcccaaatgaataattggccattggaagcaccagatgcaaatatctgtgactctgtaggattgaaagatattgttttaacaggcgcagtgtgtttctttagctctattaaactgtcagatgatccattcagcaatgatgaggaatcccacaattgaattgttccattatcaaaagcacctgcaagtagtcctctctggtacttagagattggattactccacgcaagatcatgaaatcttgcaccaacattggttcggaatatgggagctgaggtgttcaggacatcccaaagttccaatgacgaagtggtagagaatgagtcgtcaacagccccagccaaggtccctgtagccaagacattagagtctacagacgaccatgcaaatgttgaagtactttttatttcacttattttcaccatgatggggttgtatttggacgagtatagacgtgttagtttgattgccagttggtggtgacgatgtgtggtggacgacagatcgaggaggtgttcgattaggtaattagccgagatgttaggattttgaatgtgagatgaggtagattatcgcatctgctaggaaagtaacttgaaagcactacgacgaactctgaggaagatgagctccaatagcaaagtacaagaaattgatgacgagcctgatgaatggttagtgtgattgggttactattttagacttttctgtgctaacagtttagggatcaaagaataaataaaacaggatgcgcaggttagttgaagaatttgtataatgtggagaagctcggaactaacaacagccttttttagaagagaacctgcaattgcaattgtgtcatgctgatactggagactggagaaaatgcattaacgaggtaggaactgttttttttcagatactcgaagacctttactaactttgatatagatgaatgcttttagagaatgttgggacaaattcaacaacaaccaaagaactcagacgaagaacaataacctgaaggacttctaggtcatagtcttatttttccatttcaacaacagactgtgtctaccatgtaaataaattgaagctaatgaagcgataattttcttgactctattcactatgtacaattagtcatgaacgacgcaagaacgattggtatgcatcattattaatttgtatgttcccaatactcttcagttgtttttttccttccttttggcgaactaataacttctttctccgggaaacatcgcttgcatggagcttggctagaacatcttttcgtcgagcttttatcgtttctcttgctactattttgttatttgctcttgcttgaatgataacgtcaaattgttggatcttgagaaactctttaaatcgctttacaaattcctgaccattcctttcgacttgggatttatgcataacggttgcaagtgcgtcaataccattcccgttaactagcagttccagcttaacgatgtctgaaggttggtacccactatcttcataatctaaagacgcataacccttagttgcagactttaatttgccaaaaaaatcgtctactaaatgcgctaatgggagatcgtacgttgctaatacttgcccattgttgaggtattgaatgtccaattgcatggccctatttgcctcacaaagcttcataacggttcctagatactcattgggaaaagtcattgtgatctcgacaaacggttcataaagagcagcaactttgtttttgtcgttgattcctggaaaatcatctggattggtaacaatcttctccgtaccatctctatatacaactttatacggcactgtgggagaagttataatcaacttggcgccatattcattttctagccgttctttgaacacagaggcatgaagcgatcccaaaaatcctaatctccagccttggcccaatgcgttggatgtctctctctgtaaagtaacagaccgatcattggtgaccagatgttccaaactttcctccattcgtttaaactcccctccatcggcagggaaagctcccacaaaaaccattgactttggctcttcgaagcccggcagtgcttctactggtttgccactaacgtgaaaagtgtctccaactagggcctctgcagaatttttcattcctggaacaatatatcctacttggcctgccgagaggacatcaatggcaaatctatcaggatacataacgccaacctctttgacatcatacttccttaaggttgagcaagactggatcttctgtccttttttcagggtaccatcaactatactgactagaagaacaactccaatgtacgaatcgtaccacgaatctaccagcaatgccttaaatggtgcagttttatttccttgaggagctggaatgtgttcaattactgctggaaggacatattgaacgttgagtccagacttagcagaaacatgaatgacattttctcttggcaaatcaaaagtttcctcaatctggtcttctgttctttctatgttagccgtatctagatcaattttattgattacgggcaaaagttcaagtcccattgactttgccatttgatagtttgctacggtttgggccttacaaccttcgctggcgtcaactaacaataatgctcccccacaggcagcatacgatctggatacctcaagtctaaaatccacatgacctggagaatcgaccagattcaataaataatcttcaccctcgtgatgatataccatggagcatgtttgggctttcactgtgatgccccgttctcgttctacgtctaatttgtccaacacttgtttattcgatcctggttgaagcactcctgtaagttcaagcagtcgatcactgatggtggatttgccatggtcaatatgtgcagcgatgacgaagcttctgtaattttccattggaatcttggagattctatcattgagctgggatgggtttagggtcggagtggggttgttttttgtatctattggatactttaggtagtacttgtactcatgatccacatactcgtcatgattggaagagtaacttcggaatactctgaaccaagaggtatacagtgaaactgcaggaaaactcgctttggaacggtacagaccttttgtcagtctgtacatgatttccaaatggtaattttgggctagtgaaaaaaaaaaaaatcagaatcaaaactgagacaataagagaatgaaacttgtgtgaaatacagtgagaaatcacaaaaactcaagacaaaggcaattcaagggtgggtttctggaattcaagtagctaatcatggaagtctaaaaagaaaagaacgtacgggtacggaaattttataagaaagagagtacagctctcagtccagaaatttatcactgaagcttttttccccttcgaaattgagactagcagcctgaccccaatcagtttgagattaacttgaacgtacagttctgctgtttattccactttcgtttctcacatattactttcatcgctatgggtgccattggaatggaaatctttgacgacgatcactcgtcaattgctttagcagatcttgttcatcaagaggaccccatcaagcagattcaggacacccttaaggaaccaattccagatgcagacaacggcgcttattttgaagtggacgagacagcggagaaagttgttgctgctattttcttagcaaatttactagactttgattctgttttgccaaaatctgagcaggagtatccttcatatgtagttcgtgatttgaagaaggtctacgctcaagttcaagggtcctctgagttacaagtcttaagagagaactctcagcttttgaaagagatggccaggaagtggctcaaattcatttctgaagatgaagaaaggtcagaagtatgtagtttatggcgagaagttccaagctactatgaggagtggaaaaagcatattgattggatatcgaatgttctgcaatagaccttgtggctatttttttttttactgtctgatagtctgagatgactgtgaacggtcacagtttacagagaaaggaagtttctagcattaaatcaaacattaatctattgtcacatttctttgtgagacatatataggataacaaaaaggaaatcaaaagattcccatttgccagagggaacaaatccaaagtgcattactcttgagtcccaaacttttttcaagtgcacattcggttcagaaaccattcggccacacaatacaaacaagtgtcttggttttctgtcctgaagacatgtccattaaaataactgagtgatctgtaggtcgcataaatgtctctcaaacttgaagaaattccctcccactcattcaacaataccttgcttgggttctcttatataatctagtctcgtctatcagttcgtatcaatgtgaattggtttaaattacagttcagtgaaactcatgcatatcaaaaggaaagatctcaaataccattcaacgtttaaagcatactttagtcggaatgcttcagtattactactacgctgtctcctcgaagaaacatcttgctcacaaatctttctctggttacctttgtgccattattaatatcagtccaaaactcctttacgttttccagaaccatattgcaatgtctatcaaaagctttcactttagcaattaatttgtgatcatttctcagggatattattactgtggattgtgtattggtggccgtggtgagtattgacattggtccatattggaattcgtatgcctccagctgttgaagttcagagtctgttaactccgcttttggacggttaacaagatcactaaagttgttagtatccaaattcgcaaaactccaactgtctagaataacttacgccatgttgatagacggtataattacaagagaaggaaaaaccctatggttaagctcgctaaatgttgaaaaggtaactttgctcgaaggagagcttcccaaaaggacatactctcgaaggacatgcgaagcgactcccaccaactcatctccatacacctaaagctacacactatggcaatgattaagcaaatactgagagatgtattgatcaacaagaatgctattatgtttcaaacaacaatgcgggcaaaacattctgtaaggttgcaatcttttcacactggactggcttgcaaacaggataaatatagtcccagcgacaccaagaaagtattgagtttctacgataacatcaacagcattttaaatgaaatcaactcttcagatgatagttacgatcacacacagtacttcagaaattctcaagacgttcaagaccagtctcaagatcacaatcaatctcaatcagaccaagcgatagagaacctgaatgttctgaatgaagtgatcgatgagcagcatgtggacgtcaagaaggcagcagagaactttttggatacgtatggaatttactctcagttgtgcaacgctgggttcacggattcgcagtcaaaaatcattctatctttactgacagaggaactaaactcacaggttcactatctatcgaaaaacttctctccacagcaggacttggagaatgacacttatttatttgaggcagctcagtcagaactttctgtagagatcaatgggtatcgtgattctaatttaagtgacttgatgaacagttccatttttttgaagcgtctattcaactcgttggaagactcgctcaacattcagtatcaactgatagacaattcgatgaaactagaaatcgatcagtttaagcatgagaataatcttacaaataaaaaactaaacatacgaaatcacgacctgaataacagaattggaaccgagctgatgtcaggtataaaatcagaaattgaatctctgcggtgggccatcactagggcgggagtattagcactgctatcaatggtgtttagcattttggtctgttttaacgtctcgcaacgatctgcgagtaaagaagagactgaaatggcagcagataagcaaatagacacacagttacgaagagcccatcttccagccgaaacagtgcataatgaatacgaagcagactgggaagaggatcaagaagtgtcatgagatactgatttaatattaaatggtgctacattttatgtttaagatcttttgcagccagttctctaaatcgtctttgtggaatccctttgacccatttattgaatccaacaatagcttctgtgacgttcgaatgttccatttgtttcagcaacgtagcattgatgagcttcttattatctaatactgattgtttcaccaacttgttaaaccggaattctagttcacgttctaccttaacattaaactcttgaacgtcctgcatatcgtaaagctcgttcaagaatcccaatctgtacagttcgcttgctgtaattggcttggacatcaaaatggcctcattggctttagccacacccaatttgacaaccaaggaggccgatgctgagccttcgcacaccagaccaaggttagagaatggagtcaatagaaatactttttcattcatagcataaaccagatcgcatgtcgccaccagggcgcttgtcaatccaataactggtccattcaacgctgcaacaagaacttttgaatgattaagaaatagttgagtcaaccaaacgtttctactcacaaacttgctcaaccagtatgagtataaatcttcggcgccttctgcatcaggatcaaaactggatattctggggtctgaaatgttagcacctgcactgaaataccttccagaagatctgattagtgtgattatagtgtctgggtccctatcagccttttcaatcagcttaccgagttccaagtattgttggttatccagggcattcaactgctctggttggttcagggtgataattgagatcagtccggattctgatttcgaaaatgtaagtggttgtgacattgaggctgttgatcaaggtgctctgtactggccggaaactgtgtcccttatattgattcgcatgtggggtaggctggaagacactatgcatttcacatgcttagtgaaaaataaaaagcgaggtaacgatgaactgaacttgagagtcgtagctcttgaaattgaggactatatgtgaagataatctgatgaagatcatccgacgcagatgaagcgttgcattcgttacacacggcctatgaaaaatataaatcgttcagtttgatatctaagcaatgagaacaatcgcacaattcggctctcgtaaatgaaagcagaatttattcaaactgctaccgagaagcacttaactacgttaattactcttgggtggaacattaggaacagcctttcgtacaggcttgaaatctcccagagatttgaccacgactggatgttgaatgacgtccttgaaccaggcctcaattagcggatgtttcttgaaccaattgacgtcccagatgtattcagctccccatatgaaggactgaacagtaaacaaatcagccaaagtaatctcatcgccaacaagatacttcgtctgcttcaactgagtctcgtacacagcaacatacgactccaaatctttaattgcctggtcaacaccatccttagagtagggacgatttccaattagtggatacaatgcttgaatcaaagcagacacgacctcaaaattggtgaaagataaccacttaatagtttgagcattatccaagctagaagatccgaataacccttggttttgaggaatcagagatgtgatgtagaccagtaccgccagcgtttcatgtagtgtaaaatcagggcccttgagagcaggaactcttttcaagggaaatgtctttgcgaaatctgggtctgcagtatcagagatcttgatatcaaggctgaaatattcaatcaagtccttacataaagctgctcttggagagccgcgtaataggtaaattgttccttgcgacatgttgttgaatgggacttataaactaataattgcttcaacgaatagcatagtatacgtgagcgtctacttatagttgtacttggagatgaactagtggcgttcttttggaattagtaatcgtgtcattgctgcctttggaaatatcagatgttttccagaaccagagtcacatagtcacgcaagagaacaccattttggaaatcgtattgtagcggttgtttagttgcatattacattacgtatcacgtttcaacgttgaaattcgttaaaaaaatccacagaagatccaaactttttggtatgtcttccgacatctcaccgatacattacaacattcatattgtcgtgggagcgaggctctaatagaagatgtctgcttaaatatcatcatctattacccggcccttaccagccatatccaaagactaaattcgcacctcttgacttcccaagttcccatttcatcaagtttttccctcccaacatataataattgccatcaaaatgaacggagaatcctggtaagcaaataaacataaagagtgatgttggctggaattttcgctttgtgctgtttggaattcatgtatcatcagtgaaatttcttttttttatttctttctttccaaggtttactccgatgatttcctttctttgaatgcttagatacagcggcaacgtccaaacactccaccttgtaactaccaagccctttggttttttgactcttttgattcatttactaacgtttaggctttttatcctcgctgtcatactcaatgccttgaacctgttctcccaggtttatttcacaatcatgtacagtgatctggaatgtgactacattaatcctatcgagctctgcaaaaagctcaacaactacattgttccagaagctgcccttcacggctttctttcggttttgttcttgatcaactggtacccatattcatttatactgaaccttccattgctggcttacaacattaataagatcgttaagaaagaacacctgttagatgccacagaaattttccgtactctttctcgtcacaaaaaagagagcttcatcaagttgggtttccatcttctgatgttcttttattacctttaccgcatgatcattgcgctaattgctgaagacagctaaatacacacattaacttatatacgttccaattttccgttcaaacgccgtagtttctgcaccaggccggaatcactgtccattatcttttgcaccttggaaattctccccataacatgctcccattgtccggctgtcttgcgagctggcttccagtgggttgggtcagtcaatgagttgcccacctctcttaattgtgattcaacattcatggcgtcattgaatgtctttttgtgagatttgaagtcggctcttttcttttctatttgttgccttagcagggaatgttgatgtctaagttccaatagtttttttcttgtgttttgtttcgattggtgtacttgagacactttcttggataacgatgttcttgttttattgagatctgctattaaagagaattgtgcattcgttaaatttccaaactttgatagggcaagtcgttcaatatgtgcattggttggataagcttggagaaatcttgaacaaataagctgtaaaagatcaattgtcgactttgaattcgataaactggactttctctgtcttttcttggtagctgagacctggggcttggttttttggctacttttggtaggaggaataacatcctctaagggtgaagattgtcctgtgtttgcatcatttggtgttcttatatctggagtcacttcttcagaaacttgctggagaatatgcaaaggagacatttgttccacttttttgagctcttttgatcttgactcttgtttgatcaagcgtttgttgcgaccaccagctgtgatctgtgcaggggataacaaacgatcattctttgtaatttgtgattcagaagagccaatatcaggcaaagaatctccaatgacaaaatcttccactttaactcgtctaccagcacccctaatgcgagattctattctcctctcccgatcttcagttaccattatttagtgtacgcttacgacgagggtttgagcccgatacaggagaagaccttcataatagtccttcgcgcctcaaactgatgaactgccaaattgcacgaactgtgtagctgtatattcttcattttctggcaattgcactcaattcttacactgttgacttttgaggctctcctcttgcatattgattggtttgaagcctgtgaagccatttgattgttcttttagattcttcctggtttcattagtccaccgctaacaattgctgagctcagcaacatcgcgccccgtttctgtttctttgttgtgcaccttgcaaacacacgtccttctttattgccatcattaaattggaactaaacggcagaacctccaattatctcactatccagccaaggtcatgtcgcttgaacatctcggtgttacagactcgctggcacaggtggatcctgatgctccgaccgaagcaaagtttgtccaatcccaagagcaaggtgcaggatcatcaaattctccaccaccatcttccaagtcgtcgccatcgctagcttcacgtacgttatggatgggcgacctcgaaccatggtgggtggaagagaacatcattcaattatggcagcagttaggtcagtccgtacgggtaaaattgattagatcgagacacaaccgttctcctaatccaaactcgtcgttgcctccacctcagaacgctggatattgttttgtagaatttgaacgacacgaggacgcgctgcaagcgctggcgttgaatggcagtattgtgcctcgctcgtcgggtcgattgttcagactcaattgggcctcagggccaacattgcaatcccaaattcctccaactcctcagtactcattatttgtgggggacctctctccttcaactacagaggcccacctattagctttatttcagcctaattacagctcaattcagagcgtaagagtaatgaccgaccccgctacaggaagctctcgttgcttcggatttgtaagattcactgaagaagaagatcgtcaaagagctctccatgaaatgagtggtatctggctaggtggaagaccaataagagttgcattagcaacccctcgaggagctggacaccagccagttcaaatgcaacaacatctgcaatacgccccttccgcacctatggttccacagtttgctagcaacaatagttcttctcgtaacatctacaatgatccaacaaattcaactgtgtttgtaggtggattggctgctggtgtatccgaagagacacttttcactttgtttgaaccttttggttctatttcaagtatcaagatcccaagaggtaaaggatgtggattcgtgaagttttcaaccagagaagaggcagagaatgccatctcaggaatgcatggattccttattggtggttctcgtgtaagacttagttggggacgctcctctttacccaaccaacacacacattcgcacccgcatccgcaacatctaatgatgtcgcccggtgtttttgacccaatgggaagaaatggtggcatgtacggaattcctcctggtgttgctcctggtgttcttccaggtatgactcctatttactatcctacagattctcaagtttatagtgagatggatccgggacagtattcgggcccctatatggttcaaagtccagtgggaagttctattggagcccccaacatcagtggtaacggttcgatgggggccacatctaaggaagtaccagcgtcttcttctgctacgactagctccccttcgaagtctttggaagactttgaagaaacagtaactagtccaatattatcagccaaggaaccagctcctcctagttccccgaacacgaatttatcaggtgctaattctccagaactggcttctcctaccgtatctccttgaatctatcaatgaccgagatgctgttatcacatgtattactacgtaacctaaaagttctctagcggaacgactattatgtcctgacgttgaggtactttggggtaaaaactcagaagcctattcagtgctgtgtcgtcaaattggccccattcttcaattgtaaacaggtcagtcacctgagtgttccaagccattcgttctttgatggtgggagtatcctctcctggagctaccctatgccttaattctccacgcattttccccaaattgtccactgcagtttttgcatccaagctggcaagtagaggttccagcttatcgtgcttaagtttatgacacaatcttggagactttccgtttgaactaatcataatttgtatactcccctgtcttactactgacccaaagtagaaatcacattgtttgggtttgtcggcgatgtttacttgcattcgcccagctttacaccaatagtatatttgcttggaaagatttttatcatctattgcggttagaaccaatgcaaattgttcctgcttaactgcctgttctatttgctccatctcttcgggcccaaaatggtctacaccagaaaattggtccagctttctggacgcttcaccttcatacattttcaaatcatctttgaggaactttcttctatgaactttgtataataaccccaatttttcatactgttcaatggtaggatctatcttgggagcaaccactgtaacttttgcatcggcttgaagaagtagttcaattcgagaaagggcaactgctcctccacccacaagaagtacatgacgatttcttacttgccaagccaacatcaaagaaccgttgggctctgggatttcgattgacatgatggattagttccaaaactggtgttaatggcattttaatccgcctggggttaatggaatctttcgcgcagttaaatgtgatgataagatggagcacgctgatggtgaaaaagagaatgaatatataagttgacacctctgaaatccctaaattggtcgaagaattcagcttggattgcaagaaacagacggagtgtgagaaacgagctgtcggtaaggaagggatgtaactttatcggtgatcacttcacacccagagttgttagtcaatgcggactttcagttgaaacatttcaatcactgcggaaaattcgggggtccatcactcaatataatttgagtaattaacgtggaggttgtacttagtatgtatcactcaaatacatccgttcttacgtgtagttactcgttttggactaattatactcttgcaacacacgaagtgttgtgagtgatgctcagctgttatccgggtaacgatattttgccttccaattcgtgacatggtaaatatcagaacgcgattgattgtttttttctctgcttaccaatcacttgtcctagattagctacgtattctcctagtaatgtctgtctgggtaaagtattcttccaataatacgcattggaatggacttatccgtgttctcccatgtcgctcaaccatctggtctaagcccgcagtacagccccaattcatccaatttgatggcgacgtggcaagctgccttatgggttacccggataactaatcgcgataaaacttggatgttgctacttttaactcctcttctcaccatagtccaaggtcgaagaactacaatatggatgtgcaatggcaagcaatgatagtcggcaaagaagaagactcttccaggaaaaaaactgttttgccactgaaagcaagtttgccacccaaggctaagctctgattgctatttgttattatctacttcccttccttgacgcccccctaaattacttgataggaggagcccgccacccagcacgcgcgatgtgtttgtgttctttaagtaaatctcggtacgttgaggtctcctgtcttccccgtctcgaaaacagtatttaagtaaacaactccccaacccccctcgatcgaacaagaaaaaatctgaaatacttgcttgttttcagttaccctctctgcacgtgactctgaaattacatatcctcagaacttatgtcactgccagaaactcaagtcatcacggacactctgtccctgaatgatgaggtgaagtctgagcgcaatggctctgttacagatcagtcattgccgactcccaagccagaggatgcacatgaccttaattctcatgctgctacttctgcagaggccactgctccaagcaaacatggactagatgatgaatccgaattgggtttggattcgaagcgtccaaagattgatgaaactgaagcagggacctctaatggtgctgtttccacccacaacccagatggtaaggctacctcctctgaagaatctaatagtcttcccatggaaccggctcctaaaccacccccagaaccagatatgaacaatctacccgaatctccaatgccaaaacatcaaaacaagtatgcagccaacacaatcaaagccatcaagaggttaaaggatgctaagccattcctgctgcccgtggacacggagaaattgggtattccactttattataattatataaaaagacctatggacttatcaacaattgaacgaaagattagtgtgagtgcttatgaaagtcctgatattatagttgaagatttcaatctgatggttgataattgtcgtaagtttaatggagaggatactcccattacgcgtatggctaaaaacatacaggccagcttcgaaaagcacatgctaaacatgcccccaaagaatctacctgacaatggagttgcctctagtaagagaaaaagaaacaaggaagttccggaaataagacgagacagcattcgtgacggaagacccaaacgagagattcaccctccgaagccaaaggatataccatacgatatcaggcctcgcaagaagaagtacgttcaggagctacgtttctgtaatcaagtgatgaaagaattgatgtccaagaagcatcaaaattactccttccccttcttacaaccagtagaccctgttgcccttgactgtcccacctatttcgatattgtcaaggaaccaatggatttgggaactatacaagccaagcttgccaacagtgaatatgaaaatgcagatcaatttgaacgagaagttcgcttggtttttaccaactgctataagtttaacccagaaggctctccagttaatgttatgggtcacacaatggagaatgttttcaataaagagtgggagaagaaacctgcacctgcaccgagcccacaagttctttccgactatgattccgaggctgaagatgagggcgacatcgagattgatgagtcattattgacaaacccagctattgaatacctggagactcaaatcgagaggatgagggctgatgttgaaaagatgaaaagacaactgtatgatgaagtaatgagcgttgctatcaaaaacagaaagaaatctaagagatccaagaaaaagtcttccatctcttacccaacccatataacatatgaaatgaagaaagaattgagcgaaaagattaattacctgtctgaaactaaattggcaaaggtgatttctattatccaagagacccttcccgaattgcaaaagtcaggtcaagaagaaattgaactagatattgatcaacttgattctgctacactattgaagctgtataactttgttgtcaagaaggagaaggctttctctgacagtggaagtaacacgaagaatggatcgcgtggaagatcttcgggatccgcgtcgaagtcaggacggtctgcgtccagtaagaggagccgtatcaagaagagtttaagtgttgaagaacagaacaagaagattgctaacattagacaaaaactcgaagaatttcagactcatggatctccccccaaaaccaactatgctgcagatgaagatgagagttcagaagatgacgatcaaagctctgatgaaagctctgaggaagagtgatcgtagtgtcttcttaactctttgtatatatagactttttgtcaccttcgttgattgggagctattgtttgaattagggtcttgcattcacagttataactatgtattataatttttgtactattatttaagagcatcgtcaacaggaagtagtgataggatgaatacactctggaaataaaagcacgaaaaaactcaaatgtaactttcaaaaaaaatgctccacgggaggttcgaactctcgaccttcagatagcacacctatgcagtatgagactgacgctctaccgactgagctagtgaagcttgatgacttctataagtttgaaatcaaactaaaagcgttattcttgttcaagacaccttttgttgatagttcaaattgacaacaaaacttgtacccagagctttagttttgtagacttcaagcagcatacagctacttagatacgttgtataaatcctcgagcaagactaaagtgaaaactatacgagcatccaattcactcaacattattgtagtacaaggtgcagcgccagattcaagttatcaaatgaggaattccatatatcacttattaaacaatttcaagcgaattggtactgaaggacgtttggccgagtggtctaaggcgcccgactcaagtggtctcacttcctgcgtttcgcaggtgtaatcgggtctcgtaagaggcatgagttcgaacctcatagcgttcatcattttttttttaacttgatttcagttgattgcagagagagttgcatctttaccagtattcagaatttagctaggtagggctggtgacgttcttatctccttcatggaattgaccattcagatgaaactctctttcaatgcttcaaagctttgaaatcttagtgagacagaacttctttcatctcatcgaatcaccaactggtaaccttataaacttgcataggttgtaattttcagagctaaattcgttctttttatttagttgtggtaaggattgcctttctgactattctgatatcctacaatcgcagatatagagactaaaccgttttatagagccaaacatgcgaataataacaaaccaaatgggggagtaatccaacggatcacttttgatgatattgctagcccacacattatagtccaattgaggacgtttggccgagtggtctaaggcgcccgactcaagtggtctcacttcctgcgtttcgtaggtgtaatcgggtctcgtaagaggcatgagttcgaacctcatagcgttcattattttttgtttttcatttgtaatggtttcttttaactttccgttcttcaaagctaccaatctatacaaaccggtacgtacaattcggcataacactataggttttgcggtatcgaaaatgtgtcattgacaggtttaggtgtagtcaattgttttttactcctcttgacaactagtaaactacaacttcagagagtagtaaagccattcaataatttatcacagtcctgataagactctaattgaatcatgtaatttcagttaatgaaatctttcatgctagtgtttcaaagcttcccaaaaactgatcaagacttaattccagatctaatcttatctcactgataacagaaatagctcctctcgagttattctctcccaatttaagctatatacaaaacttaattcccttgaacgttacaataatcaagctcgcctactcgctatctactcgctatccactatctttccatcaacctctccaacatctgttcaagccaactgatagaatactagctccacgtagaatctcattatgaccgctcccgcacgaccgtacgttcgcgccctatgcaacaaataaccttgctgagctctcaacctctcatactatcatacacccactgaacattgcgtttatcatctatcgacacttacaaggaattgaactaaattgtggcacctgtgatatcaacgaaaggaacgcacaaacagttataagaaaatgtcaaataacttaaacaacaacaattcaaatccacctatcgctcccggacccaatcaagtagggtatacatcctcgttgagatcaccagcttccccagctttgagggcccgtcaagcttcaatcgtggaactattgtcaactcctccaccaatagagccctctgatgcttcgattgacaacacattgaatctatctaggactgcttccaatttgtctcggaatccgtcatcgtcctcccaaactagctcgatgtttgcgcagcagcaccaacaacagcagcatcaacaactttccacaccaggagcgggatcctccaacagttcaggcttaatggactggcagaatattgaattgagtgcattggtggaagaaaacaaactgatatttattaacgagaacatctctgtagaagaggcctttgataccctggtgaaaaataacttaacatctttacccgtggagaaatatcgcaatgatctggattgcttaacgtttgactatgccgatctcaactcttacctgctattagtgttgaataggattcgctcagagagattattatcgattaattacgaaccaagagaagaaattcctgacttgattcaaaaggctcaaaaaggtgaacaggtacctgtaaagtttgtcatccagctaattaacaagaacccattcattaaactgcacgagtcagaaacgctatctacagtggttgagatattaggaaatggtgtgcacagaattgccatcatgaatgacacccaaataacaggaattttatcccagagaagattaatcaaatacttatgggacaatgctcgtaaatttcattctttggatccactactgggtgccagtcttgctcaattgaatataggaagtaccaatgttgtctctatttacggtgatcaattgttgatagaggctttatccaagatgcacgaactgatgattagttcaatggctgtggttgataaacaccacaatttactaggtaacatttctgttactgacgtcaaacatgtatcaaagtcttctcaatcgccactgctgtacaagagctgtctacactttgtgtcctacattctgaatctcaaaggtttagaaaacggtaaagattcttttcctattttccatgtgactccaaactcctcattatcgaggacaatggcaaaactggtggctacaaagtcacatcgattatggattgttaaccctgttggggttgaggacccgataattgccggatctagtattcctctatctccttcatcatctctcaatggtattagcagcagcaataacagcaacctatcaatatttactccagaaaaagatatgggtcgtccgggaaagttgattggagtggtttctatcacggatattctttcccttttggcaagacgactgggaaaatcccatgttgatccctctactgcaagaaaacaaagacgcagatcttcttcaagttcaagcaggagtgtcgcttcaagatccagtctggagcagttcagaaagagtgttagcgatgcttccgataggtagagtctgagtttttcttccattctatcttatatgtaatgtattagttttctcttgaagatgtttatacaatagtttattagtctgtatagatgcttggcatgatatcagttgtggctagttgaatataagtcttcaagcgtttgaatagacaggagtctgctgtaacggttggctaagcacacatttttgccaacatttacctttagcacggactgtttggtattacaaaggaatgtccaatctgaggtgtttattgtgttagtggtcttctagataattggcaggtgaaacaagagaacatacgacgtttaacgtagggtcgtcgctcacgttgccagcctgagtacagatttgataaccacaggagaatgcgcgatctgatccaagtgatacatacgacatctttgacatatcagggatgaacctgcataaggggcactctgctttactacattaactcttaatgtggttccacaaaagttaaagcacccgttcaaatatcatcttgtttcatgattcacaggaaaatcaggtgacgtactgtagcaggacgtcagcatcacctttgaacctgtttttgtgtgtatctgtattcactggtgatacgccccagaatttgtacgttcagtgccagaatattctttttattattcttgacgtgcaggctgcagttactcttctagatcttatggataggctgcgaagacaatagggtatccggggagactctaagaacactctccagctgagaacctcgctttgggaagaaaagcggctattcgttatcacgtcacccaggattgttttgttgattaatttctccaaagaggatgtgagccacgttcaaaagaatccaagaacaggttggaacaagtagacatggtatagctatgcatgacagaccgctctacaacgaaccaaacttttacttgaccttttcaatcatactggtcagtcaattggaacagaccccgaccgttctacatgaggcggttaatgtatatcagatcgtggtcaatcctctaatatccatcggactgaatgtctgatcattgtcaatagactgaaatgggttcttgagatgggttctatatacttgactatctattccgtgcctaagcagcgttctttaatgctcttcttttttgaacagcttcagcaagttctctcaacatagcgtcggtagtttcccacgagacacagccgtcagtgacagaaacaccatacttaagagcctttcttccttcagctggaatggattgcttaccttcattgatgttggattcgatcattactccaataatacggtcttcaccagcagcgacctgatcggcaaccaccttggagacctttggttggtttctgtaatccttgttggagtttccgtgggaacagtcaatcatcagaacaccgtcagcaggtaactttgcctttgcctcggccacagattcaggatcgtagttcgtacccttcttacctcctctaagaatgacgaaacagtattcattaccctttgtggtcgtgatggcagcaataccgtgcttcgtgacacccatgaagtgatgagcatgagaagcagcttgaacagcatcaagagcaacatccaaggtaccatcagttccattcttgaatccgatggggaagctaagtcctgatgccagctctctgtgaagctgtgactcagttgttctggcaccgatggcaccgaaagatagcaaatcagccaagtattgaggggaaattgtgtccaacatttcactggcaataggcataccgctgttggtcaggtcaacaaacaactttctactaatcttaagacccttattgatgctgaaactgttgtccaaatctgggtcattgatcaaacctttccatccgacggtagttcttggtttttccaagtaggccctcatgatgataaccagttcatctttgagctcttcgctcaaagccttcaacctggcaacgtactcgagagcggcgtcactgtcatggatggaacatggtccgacaactaccaataatctgtcatctttcagggaaactacgttcatggcatcttttctccctttaaccacggtttgaagagcaactttggtggcaggaatctcctgttgaagcagagcaggggaaaccaatgggtcatatcccgctatacgtacatcgtcgtattcttcttgaactggtgtggactataaagttagtaaaaagtctcagtgttatcttttattgatagggaacttacggtcatttttgttagcagtattgaaataaaatggggaaaagtgtttttatattaaagcgatgaaaaatagaattttttagaccctcaccatataattttcaaagatgtgtcatagtgcaccgattttttccggatgatgacataagcagaactcgtgggactgagatgagacatggggttcaagctacaaataactggagtaccatttatacactcggaatacgaacttttgctctccaaaatcatcgtacccatcttgttgatgcgactccactagctgaaaacccttgtcttccattaatgcccatagtttgtcccgctccttttggaatccagatctaatgggcacttggagcaggatgtgtgcctcagtagatttcctaagaaatttctctgaaatgtctgctacccaacgaggttgattcgtagaatacactggatctgagaaaataagggtgttatagcctttcaaagagttgggattttctttgatgaatgggtccggccgagtccaatccagctcatgacaatcggcttgggcactggcatgattcaacttgatgttttccttcaaatttgggaggatttccgggagatctgacaatgttacgtgataccccaggtgggccacaacgattcctatcaaccctgttccagcgcctaattccattattggttctttgagatatctttgatcatcattaattaatctctgggacagtatgaaggatgatccccaggtttttaatcccaaattgtccgatgttaaagaaggttcttttagctgaatactctcacatccagttctttcatagagattttttaggactattttgcggacgaagtccggtatagaagttctgccacatctttccgaaagtcttgagcttgcagccttgtagatgtcttccacatcaggatcctgtagccaattcaaaggggatgacaggattgttgttaaatatctgacgatatccctagagtctgtgaatgtcgacccaatttgacaaaatgaatcgagcgatgcaatgcggggagaatgaatggttaaccaaggtagaatatcacttatatcttctatggtgagatctctatttgataaaaattgagagggtgtcaaattttcaacgccaggtccaaaattgcactgttgttctagttttagtatccgtagtatggcaaccaagacattttttggaggcttgagagaaatatgaggcaaatcaaggacatctatagtcgtagttctatcatcaggtaaagcagcgtcttcattttcttttaacgtactggcgtcaactttttttttgtccgaagtcacagatagctcatctcgaagacagcttatccttccgcagggttcaaagaagtccaagacatcaaagccagtcatggcctagatttaatccctgaggaaaagatgagatgagatcttggactggtaaatttctcccaagacgcgcatcgaacacgaaatcaccaaatcaaactctacccttcgacctcgtctaaacaaagtttgaatgatcgggaaaggacaaaatgtcacttcctaaaaagtataaaaacacgtttctaccgtcagaggtcgaatttcaggctgaggatcaaccaattttaattatccctagatatgccctcaaagatcgtcagttaataggagtaagtgaacaatcctttaaagtactttgacaagttgccttttactaaccgttgaatgatagactagtattccagttttgaaacccatgaagagagctgaagtgccattgtggttgggatttatattgaagcaacaagatagatgtaacatagtaacccctagttggttatccataaactttctgaaaaaggcctaccaagaagaagtgacatatactaccagattctttagaatgccttggaattggctagagatatccaagatgattttagataaagcttcggacgacatgaccgagcctccccatcaaatcagggccctaatacaagatctgagggaagtcagactgataaaagctagaagaggtctgaaagaactaaatgaatcttacatgcaattggacaacttgagtttaatggaaattaatgagctgaggccgatggttgttggagttatggaccaattgagaaagctgcaagtcggcactaatgaggacgaagaagtgagcgatgaggagggcccactgagttatgatatatgatatatatttagaaacggttcgcacagaatagtggccagcaaaacatcatttttcggtggagttttgactggtttatgaagcccttaattgtgaaaaggtgtaagaaagtgtgcatctcgaatttactccatagtccattagcctccaccttccctttaaccgtgtatttgtgaatggtgttcactatgtttcctagggcattaccatcctgtcgccgtcagtcaggccgtatgttcataagcgtaagtaattgaaaccttttgacaccgcagcgatctcccactaaccagtagtccatgttgagtatcaaagatttcacctcaaatctcacaagacatgctagaaacaccgaggagaaaaggaacatggttctaactatcctcaactccactgctaccaagagagaagttcgaaactacttgaagaagtatcctctattaaaggatgtggatatctacagtaagggccaaatggatcggagctccgttagcaaacgtaacaagtactccagcatgattgacaatctcatgttgaagcattcgaccaataatgaaaacaacaaaattgaagactttcacttgaatcgcccaaggtctgatctaatcagtaaatctaagctggagatcaaactcactgacacccttcgtattgctattgtgaagatcaggcagtttagggatattgaccccacagctttgaaaggtatcgcctttactttgtacaaactaataaaacttggggtgagtcccatagtgttattggatacagataaagaagttcaggctttgaatggagaatcggacgccatggtacaaaaaagcattgccaattaccatcagcaggccctgagtttcataaatatcattgaaaaatgtttccataaatatgaggatgacaacgagctctccgcaagggccatcagaggtttgttcgaacaaaaatttgatgaagacagattttcaatgaccctaccagagctattactaattcctatatctcagggtatagtccctgttgtttatcctgtgggatatatggataagggctccaaaaatgtatttctatcctccgaggcagtcctccaatgtttagctactgacttgaaatccttgaatgatagacatagattggaccatgacaaggagaacttattcacaattgaaaagtacattttcattgacccattgggaggtatcccatctttggagaggtacaaaagtgcacatgtatatatcaatctattacaagagtatgaagacattgtgtcggagctttacatagggttcttaaagactggagaaagggaccagcatttgaagaacttaaacttgcttcagaaattgttgcaggtaaccacagatgcatcaggaatagttactactcctcaaatcgccatgttgaatcagaccgaccgattcaccaatccaataatttacaatgtcttaaccgataggccgacaatatcatcgtcattaccggttgatttgaaaaagacccctttgctaaacacttcaatcattaggagaggcgtaccggttgaagtttatgtggacgaatcatctgacaaaagtgggctgtgcctagactctcttctgaaacgaggagctttagacttagaaaagcttaagaatgtgatcgatttgtcgtttcgaaaggacttgaatatgaaaaagtacctagccagagtaaagaacaatgttgcagctatcttaatcgctggagattacgaaggcgtgatcatagttacttgggaggtaacggatgaagaaaagccgcagaaaatagcttatttagataagtttgcagtgtctcctaaggcccaaggatcgacaggggttgccgatgttcttttcaagtcattattgtccaattttgagaacgaattgttctggagatctcgatctaataatccagtgaacaaatggtactttgaacggagcaaaggttctcttactgttactggcacaaattggaaatgcttctacaccggcaagaactatccttcattggatagaatgaagggctatttcaacatctgtgagagaatccaaccttcctggaatggataaagacgagatcaattagaacctgttttggcaataaccgaggattaggaacaaagtccgggtaattatgcgactctctctttttcatatgcaggtcgagcaagaatcttgtttttcgtggtgggactgggcagcaattaacaaccaatcggcacttgcaataagtcgattagcgcatggtgggggacagtagatagctgctgaaatttttgggtgcggacaatttcaagagtctgaggccctgctctcactagcagtcagaatcatctgcctcacatacagtctcctgatgctgctacttacttggcaagcgatgatgtttacacaattgcagctttttagttgctgtcatggctctagaattccttggccttttatcagcatctcaggcaacaatgtgaaatgcgcaccttcagatttttatattggtggacggaaatggtaggaagtagtgaagaaaaggtagcgcgagggcattgtccccccatgcgaagaaaaattactagcataaaaaaatggaaacaagtgacctccgcagcatgtctgcccactttatactgaaactacattcttgctaatggatcgtaaaacactatcacctggtatgtcgtaatggacttgatggcgtgtactttgctttactgagttctagttgcctgctcagtgccgaagaacatggggctccatgtgtattgtattctcttatctagaacaatcgaagcatgcaaaatgcagtgcataataattcgatgcttattcatagtcactgacaagttacctccagcgaatagcacacgcattaatagtaacagacgcaaggcctataaacaaatagtcattcacttgtttccttcttcattcttgctaccaaaaatattcaaatcagttttatcctgacagcaacactttctataatagttttcgtcgaacccttcacattggtcatccttcctaggtgacagtatgtcccccgacgattatcacgcaacccgaaatacagctacgaggtcagcttcggcctcagatgtgggccagttaaccaatatgcaccctaaccattcaactgtttcagtggcgtcttcctccaaagaggacgacaagaaagatcgcaagtcaaagaacgtgattgccaagggtctcaggaaacttggtcaacgggctactacgttccatctggcaagaagcgattccagcaccagtaacctaccaagccgaaataacagtttgccacctaccgatggattcacgacaccaacagagttctcggcttttccccaaccacttacctctattattagtggggcttcccacgtacctagaaagtcagaggaccccacttcatcaaaagcaagagtcgtgaaaggtttccaacaggaagtttttcatgaactaactcgccagtatggtgaatatagatcgtacatgaagagtagcagacatgaagacatcgatagatttgcgctcacacgtaacgaacagtggttgaattggttttacagcaagttgaaaagtacccagcgcaaactagatcttgaaattgaagcagtaaaaacaaagttggatgaaaaaaacgctccattggttcaggattgtatcacggattccaaatcaaactctcaaaaagctacatcaaatgttggatctcatagaatgggctggggttccagtcatgatattctccatgaactagacgagctttgcagtagcactgtccacaattcgcacccagccccccatcctcctgtccaagctcctgctcctcaagttcctgctcctccgctaccgcttcaatcgcaatcagtccagccggtctgggacaaccaatttcaattatttcaattgtggtttatcagcatttttaagaaacttataagatccaactctattttatcccccaaggttattcagcttctcaagcacaggtacccctttttccactctgctagacagagccatagcatcagccctcatcacactttggtcaaagcttccgatggagtgactagtgttccattaggaattcccgaatggcataatacttctttttcttcttcggggactggttacaattcaaaaccgcaggttggtttcttacaatcagcccagtttggccatacagaaattgttgccagacagaattcgtccatgaatctgaactatgacttttctttactctacgatgaacctgacattgatctaatatcaatcaagaaatgtgacgagtacgttgttttttgggatgcttctggccatgggtacatcaaatcctccgacggctccgaaacgtctatgaataaattagctgcatcacaatgtaaagattcgatggatgcgtctttcgttgttggacaagagagttcccatctactggacagatttactttactaggcaccccctcctttcaatcaattcccctaaaggacagttcattggatgtcttactgatccatgatatacttctcaagatcaaagctgccgatctcgcaaaactgctcaaggaggtcaaaagagttcttaaagaggatggagttctacaaatcttggcatttactggcacattaggttgtgcaaaaccaagttcgattgaagcaacaccagaacaactagccaacaatattatatgggaccaaatcaccagacatgctgatatgttgggattcaacttgcaaattgacacattaatcaacaaacatttagtaaaagcaggttttcaaaacaatgtcagcgccctaatttcagtccccaaatactcacctgtgccacaaatctctagttcatacgatagaggaagcgttgttgatgacattatcagcattccaacgcccaaatcatcgtcccgaaaaagttcagctcaaactgaaaggacatcgaccaattccagactctcgtcctcctcctcgtttatcacctgtaaaaaagattccattgcgacagaaccttctcctaatgaaagttataaaaatttagctgatggcgtatgtggctatactaacaattctttcaatgggcttatggaaatgttctgtacatatgcagacttttactggctctatgagtttggaggtctggacatccaacggacaaagaaaatgttttctggaaaggaagagaagcttcttcaaagcttcgaaatattgagagattatattgattataaactctacgatgtcaatcatttccttgaagaatcggagaaccccagatctagaaggagacctcggttcgaaggtttcactcatgtagacatgattataagtcaataaaggctctaattttactatctacagtatattatcacgtagctactcggcgattccctcattcttttcattggggatgacaacctcgcgtacttcttgagagtctttgataccattggctgtcaagaagttgaaaataggagttccattgaatccgtcaatgaagccaaagaatccgtgaaaagtgttgtctttgacttcctccgcgtaaattttatcataaatatgtttcatcttgaactcattcatctctttctcaaatggagtgaaagtcaattcgttatatccaaaggccttaagtctcgtattataaccttcgtagacgggttgctcaagtagcaaaccaagcgcaggtgctttaggaatgttaatcctagaagattgaaaagcttcagtgattcttcctaggggacatccagttctaacaaccaaagcagccattgcgatcatttttctgatctgatgaagcatgaaagattgtccatgaatcttgattgacacccattccgttccctcaatgacaaaaggttccgatacggtaatctccttcatatacctgttagcagacgcatctttgaaatgttttcccaaagtgaagttatgaaagttgtggtgtccaatgtacatttgcatggccttattgactagttccagcctctctttggagatacgatattctctccttgcttgattttcggtttgcttgatctttctgacgatctcttccaaaagcatgtccggctcatcgtctgaatcattatttttttctttatttatagtggcttcctgtgcatcttgaatatccttgtcggtaattccactcgcatgcagtttctctaaaacgtctgcccaccattttgaaccctccgggtcatcccttgtcacgccaggagtctcctcattggcttccttgatctgtctggcaaggggagaattgggtttaggaggtaagaaggaaaatgttggcatcagatactcatagattcgtgatgaacacatcttacggcaatcgaagtttttgttagttctctcataaccccaaacacggatagttgggggcagctttgagttaatcttctctaaaatatcctcatcttcaataatcatcttgagtgaaatgacattaccggcagcgtgaacgcccttatcggttctagctgctctcatgaaactggattttttcaaatcattggagttgtctcttgaaattgcaccactttccacaaaagcttcgaaaagatcaccttcaatagttttttggggtggatttaattgcataccatgatagcccgttccacaatatccaattaaacaagcaacctttttctttggtcgtctaggttcagatggcaatgggttcccgtctgaatctaaaacacgtctataagttctgttagtaagagtcctccagcttagaaactctctgatcgaagtgatttcgattcagtgaaacatacccactgttctttcctctcctcccacggaagttctccatctcttctctgcctcttgttattcctgtcacctctctctgcctttctggaacgagcccatttggcttgctggccacgtttataaactgacttatcaatgtcttgctcatcttccacgactctaggagctggtttagtttgctcaacattggtaggctgttctgcaggcgaagtagacatgatgaagttctatttggtacagaaaattttctggcagtgatttacaagagatgcatatccggggagagctcggaaagtcttcgaggtaggaagagtgaacatactgggataaggatcatgaaagacaaaaggttttgatagttggataccgacagcagaacacaattctaacctcacatacaagagccattaaatacatctgttccacaagaagtatacgtgataatcgggggtttgctctcttacttagttcagattaacagtctcccatgaaaatttccggacgaaatccgaccttttcgatgtacaataatttccaaagaaaaaaataatcttgaaaaatttccttgcattaaactaaatgagacctttaacagaagaagagaccaaagttgtcttcgaaaagctagccaattatattggaagaaacatttccttcctggtcaacaacaaagaggaccctcatgtttttcgtcttcagaaggatagagtctactatgtcagtgaaaacgtagccaagtttgccggttctgtggcaagacaaaaccttatgtccttaggaacttgtttgggaaagttcaccaagactggaaagtttagattacacatcacagcattagagtacatctcacagtacgcaaaatacaagctctgggtcaaacccaatggagaaatgcctttcttatatggaaacaatgttctaaaggctcatattggtaaaatgagtgaagatatccctgaacatgctggacttgtgatttattctatggccgacgttcctttgggatttggagtatctgctaggtcaacgactgaagccagaaatctgcaacccacagctattgtcgcttatagacagggtgatattggagaatatttgagagatgaggatactttgttcacgtaagaaaaaagtcaagaaataaatagtagagatcaagtaaggtatagtgaacaacttttaatatgtatattaagattttcttcgaattggtcagctaaagtttcattttcttcctttctttttggaacttttctttggcagagtctttttcaagccacttatttcactagtattactagtgacagtaccctgagtggtatttctaattttctttccctttttgggtctgtaataactgcggtcctttaaaggtaaccatctttcctcatccagacgcttatacttttccttggcttcatgtttgggcttcaatctagtacgacgtttcttgttagttgagctgataatcgtggtcggtcttttgctggactcaaaagtatcaaatccttcactaataagcttatccgtgtctatgcctaggaccaagtcgtccaattcggagaagttggtcgtggtagtgttattgttggatgcattagatgaagagttcaagtacgtggataccaactcatcattagggtaaatactatgcagtttctcaaatagtcgattggccaaaactgcatcgtgattgagggttttgaaggcaatatctttgaaaaacttacgttgttgagtgctggaaatctctgattctagcaaaagatccgctactttcttcaggagttcaacttgcaatcttccgctttgaagcttatcgtaaatcaaatacaaagataccacaatagatggttctagtaaattcttttcgtcgttcgacaccacagtttcaagaacagttcttgcattattgatgttaccaacgttgatagccagctgtgcagttaaaagagcatttggaacctcttgctggccagggcgtctcatgaaataattataaatcattgaggcttctagcttggtgttcaaatctaaaaattccgaagtagcatcataaaagagcttgagatcactttgagatgggatctttccaagctcgagtgccaataatgattcatttctggtcaacgcaaccctttgggacactgtcaacttgtctttattaatgtctatcgaattagggaatcctaactcacgataaagaatatgaaagttggtatcatttcttccgtattcatcaatccttaatgacagtaagttatttctgtaaataagatctaaaagagagtcctttggtttagaaagacttctcagcgcagtcaaggattcttcctttttacccttaagttgtttgacgtaagcaatttgtaacagaataggaacaatctctgcttctcgtgtgtccaaaggcagatcttttgtattttcttcacatatggctttggcttcttccaagagatccaatgcagattcatagtcaccaatctttacctggtaaagggcatcgttgaatttgcaatcgtatgagtcgtctattggtcgagatacaggctgttcaacgacaccatccaattccaaaagctggctaatgacagctctttcattgacactcaagtctacaacttcatccaatgggttcttagatagctctcggtaaatcttgagtgccttttcgttctccccgatcttgtaatagtattgggctttgaggtgttcaaatgctcttccttggaaagctgaatcctttagtagagtttcaaaattcttcgagtctccgttcttgtagtacacatatccaattaatagcaagaattccttcattccatcatatacgatatgatccttactttttgatatgaggcgacctgcgttgtgatattggtccaggttgatcgaagccaccaaacctagcttcaatgtgtcaaggtcaagagggtggcccaaatctataatgcgctttgctttctcatatgcttctttgtactgcctcttctcagaatggattgccaattccgataccagctctgaaagagacgacatcttgaatgaaatgggagtcctggagggtttgatttttcgtccgatcagtttttctgccatgcgcggtgttcataacagccaaagatctctgaacatgagcactcatataagatctgataaaaatctaccgtctgtaagtgaaaactggtaattttccatagaataccaggagcagaactaaaaacgattcaccctcttgttttcttgttaggatgtcaagttgtcatttctgaaatacgattggtactttaaatccaagccagtcgaaacagtctctattcctctaagattgaaaactgttcctcatacaaaataaaaaactacaaagggaacagaactagagaatcatactatccatgaacagaaatatcagccttcgtctgaagagctgcacaagtgttagatttgcctcgtataatgcatcgagcaaatcttttcagaaaaggaaacaactagaaacgccaactgccgatattccatacaagatcggcagttatgctagtttgaaacttccagaagaagaaaaagtatctggactgcaccggctggtaggacagattgatagttttgcacaactaaagttagtccctccggttagagatgctttgatcaagcaaatcaagcaaagcacggtcttgagaagtcagaacttcatttcttccacaaaaaaggtaaagactgaggacgaaatgaatggcctcatcataaggccaacacctatccaagtggagaccatcaaggtagtcaattctatcaggcgaactaataaaaacgagctgaaagtattcacattggcggctgaaactgggtcaggtaagacatgggcgtatttggctccgcttttccataaactgaaaattgaagaattggaaagtggtacccgcatggaaaaatctcaaatcagatccgttgtcttagtgccgacccatgagttggtgtatcaagtatccgaagtggtggaatctgtatgcaaagatcttgatttgagtgcttatcgatgggatgtagactcaaatttcaaggattttattggggcttatcgtaacaagattgacgtactagtgaccaccccagctaagctaatgtccctggaaaagtatgatgatgttgggtcattgaaaagccttttgacaggacttaatttttgtgttgttgatgaagcagacacgctaatggataaatcttggattaacgatacacatgctgccctcaaaaacatgagatcactcaaagacgttctatttgtgagtgccactatacccagtgagtttaataaagttaccaagaaatttttcccagactcgatccctattaccactccttctcttcacagactacccaaagcaatcgagttcagaaacattaatgccagtgttccgccctacaaagggtccaagattaaggcattagcccaggcactgtatgccattcatagtgacggaactgaacttgggtacgaaaaaagagtaattgttttctgcaatgaaaagaaagaatgcatgaaaatttcccatcgtctagaaactgagtttgggcatgatgtgtcttgtatctcgtctgaggacgctgtggatgttcgtcggagtaaaatcttaccattcctgcgacatcctcaattgttggaagagggtcaaaagcagacaatgaaggttttggtatgcaccgatcttcttgctagaggactgaattttagcggaatcagaaacgtgatcctgtacgatgttcccaagacatctgtagacctcgtccatagggcaggaagaactggaaggatgaatcaaggaggaagagtttttatgatagtgactaacaaggacaactcgcatgtgaaaggccttccgaccgtcgtcagatataagagaagattggcgtgaaagccatgtataaatagtgtaaatagcagagcacgtacccaataactggtggatacttacttaccagtagatgttggatgttggatatcacgagcgcgctggaaatacgtcaacagtgatttgattctgttttgccctaaacactctcctcctcccaatataacgatgtctggcaacgcaggtttgaagcctagatctttggcagagagtggtgtgaagccatttaggagtcgagatgtgagtattctctttagctctaccgttttcctttttcaatgctaaaactaacccgtttagactatcaacaaaagtagacttcaaatatccagaagaacaagcacaagcacaggaaccggtttaaatgctcgcaaaagtatacgaaagtccatctatgggaatcaaattacgataaatgattttgagatcggaaaaaaattagggaaaggaaagtttggaaaggtctattgtgctagacacaagaagtcgggatttatctgtgctctgaagattatggataagaaggagttgattaatttcaaggtagagaaacaatttcgaagagaagtggagattcagagctctgtgaaacatgtcaactgtataaagctgtatggacatttccacgatactgatagagtttatttaattctagaatttgccattcatggagaattgtacaagctgctcaagaaaaaaggaaagcttgatgaggtcacatcgtcacgttatatttatcaaattgcagacgcactgtcatatttacacgatcgtcacataattcacagagatatcaaaccagagaacattctattaggttttgataatacggtcaagatttctgactttggctggagtgtctattctaatcagagtatgaaaaggactactatgtgtggaaccctagactatttaccacctgagatggttgaagctagggagcataactacaaagtggatgtctgggcgcttggcatattaatgtatgaattcttggtaggaaaacctccatttgaagaagagtttaagagctctacttataaaagaattgctcaagtggacttgcaggttccctctcatgtttccccagaagctaaagatttaattcaaaaactcctgagatacacacctgaaaagcgaatcaatttgaaagacattgagacgcatccttggatagttaaaaataaaccacactgggatgaaatcaacttggaggaaggagtttagcatagcaagaaattatcattagggtatatcagcatccattaaaagtatttagtttctatagcttcttatgactacttgaagataccaatttcgatgaaccagaagggtaggcgtaaaagtgaatggcctacattagtaaattgacctgttcatttgccacaaaacattgtcttacgttgatgagaactgaaagaataatcagttaaacatttacctcaagtaacaagcttacttgaaagcaattagttctgcctctatggccaagttggtaaggcacctcactagtaatgaggagatcatcagttcaaatctgattggaggcaagtttttatttttcttcttaaaaaaccagattggccagtagagcgttctaaatattggcaggtgattggaatgggctgaaggtgaagtccatttatctataactatagtcttccaccatcatttttcatgaatttgattacataattttattaggggcgtgaaaatgcgccccaacccatattgctctcccttgcaattattaatcatccgtcaaaaatggtcaatgtcgccgttattggaggaacaggcctctgtggctcagcctttgtgaagctcctgtcttcagcaccatcagttgagaaagtcacagcttttacacgatcacctcttccagaaaacctacaatcccctaaaattgaaaatattgtcaaggatagcaaggagtggacttcttcaattgaaagtcttgagaacactgacatttttgtgtcagggtttggaacaaccagacatgtggatcccacttatgaaatagacactggtgtcaatattgagtcagccaaggctgctagaaaagctggtgtcaatacttttgttttagtttcgtcttttggtgctagtgccggcagtcgattcccttatatgaaaatgaagggacaaattgaagatgagatcataggactgaagtttccaagaacggtaattctaagacctggcttactgcttggtgaccgtgagaagcccaaatcaggcaagtttcttctaacacttggaaaatctctcaggggaactttcctagatcgatttgtaaggggaacttatggtgacgaagttgccaaagctggactgtacgaggctttcaaaccgctgacccctggcgctgagcctgaagtgatcattgtggaaactcctgttgccactgctcagaagtacgaataaacagacaatctgtggttggttgacggcctgagatggaggaccaggaatgtcacccttctttctgtgacattatgtagcctaggccctatggaacttgtatagtaaacatggttatttaacatggtagtatgatagtaagcttttacacctatacaccattatctgggtacttacccagatagtgatgaatctctccagtacttaaatcctctcgtagttcatttggaagaagccatttccgattactgtttgatggttataaagccaaaaaccaataacagaagaaagatcagtattgattttaacgacgatgaagggtcaagttcattagatcacccaggcacaagggagtcaccgtctacctcatctacctcatcgcctacaagaccagtgtttaagaagataaagaaacaagaagcgcaaaggatcaaggggttccccagtaagcatcagagtcaggtaaataagttaactagcctgaataacgtgaagaataacggagatggggcaaatagaccctctaccatgttgaagccaaaactgtcgcttcaggaactggcttcaaaagagaaacaaacttataagaatgataatggataccaacagggctcacttttgaataaagaagacgaggacaatgataacttttccgacacctctttggatagggaatggtacactaacgagagagcgaatcactatgaagatctagaactggagactaacaataaagccaccaggaatagaacttctctagatacgtttgacccctttgaagacgatcctgaagactatgaaaatcatcgacaacagcaaattgtatcacatcatttgataccccctttcttagaagatgagcagatcattgccaaccaaaaggcagaaatatcagttatacgagaccccgagggtcacctagctgccgcagctaggagaggtagcaatctagtgaatgagcgaagagtccagtcagttatcatgaagaagaacaatgaagtcagcgctgtcaagggtacaaagctgggaaatgtcatgggtattaaagacaaagaagagaagatagaacataagaactttattgaagcgatggaagattcaagctctcctcttgatatcgcagaacaaagacgttgtctgcctgcattcactgttcgtgaggatttgattcgaaccataagagagaatcagatagtagtcgtaattggtgaaacaggtagtggtaaaactacgcaattaacacagtttttatatgaggaaggattctataagagagggataattggttgtactcagcctagaagggtggctgccatgtctgttgctaaaagagtcagcgaagagatgggagtcaaactcggaaatgaagtgggtttcactatcagatttgaggacaggacgagccccaggacaatgatcaaatatatgactgatggtgtactccttcgtgagacactgctagattctggactagagaaatactcctgtattatcatggatgaagctcacgagagatcgttgaatactgatattcttctcggattattcaaaaagatcctgactaagcgaagagatctaagactaataataacttcagctactatgaatgcttccagattctccgagttttttggaaatgctgacacttttactattcctggaagaacgtttccggtagatatccaattctccaaatatccagtagcagactatgtcgatgcggctataaagcaagtactgaaaattcattatggtaaaaaaccaggtgatattttagtattcatgactggtcaggaagatatcgaagcaacttgtcaggtactacaagaaagaatagaagagatagaagaagatgctgaaaacaagaatcctctgtcaatactacccatatattcttctttgccagcagatctgcaagctaaagtgtttggaagatctgaagttcgaaagtgcattgtggcaacgaatattgccgaaacttctctgactgtcgatgggattgtatttgttgtagatgcggggctctgtaagctgaaagtttacagttcgaagctggggatggacatacttcaattagcacccatatcatttgctcaagcaaaccaaagatctggtagagcaggcagaacgggaccaggtgtggcatatcggctttatactctaacagaggcagaaaaagagatgtacgtacaaccaattccagaaattcaaagaaccaatctagctaacacgttgctactgattaaatcattaggagtagataatttgttagactttccattcattgatccacctccccacgccacgatctattcttcattgtatgacttgtggtgtttagatgccatagataatctcggtgcacttacagacttgggtcataaaatgacctccttcccgatggaaccagtgctttccaaaatgttaatcaaatctcatgagttcaagtgttctactgagatgtgtataattgttgccatgctgtccgtccccaatgtgttttatcgaccaaaggagagacaaaaagaaagtgacagaagtagggaaagattcttcattcctgagagcgatcatcttactttactgaatgtttacaaccagtggttgaaccacagaaactcagctcgttggtgcgtccagaactttcttcatgagaagtctttaagacgagctcaagagatagaacttcagttgcaatcaatcatgatgcagcaaggcatggcttgtcgaagcattggcagacagtgggatccgatacaggaatgcatttgcagctgtttatttgtcaatgcagctcggttcaaaaagtttggggaatacacaaacctaagaagtgttatgtcgatggtccttcatccaacttccagtctctatggtacagctgatttacctgaatatgtcgtgtttcaagagttgctgttaacatccagagagtacatgaatgtggttacagccgtgaagcctgaatggttagcaaaatacggatcggttttctactccgctaggagtgaccacgaagcagtattgtcccgtctcaaagaagctatggacgatgcgaaaaaaaaatggaatcaattagagacttccaaaactcagaaagtcgttaccaatgttcaacctaaaggacaaataggaatacgcagaccccgaagggtttgatcataaattatctatatacaacgttctaatgtaaacaagaaaatttcattgagtgtgtacccgattaactgccgagtattcttgtcttcaaaaaatgcccttaatctctagatcttggtttcacctcagcatcggcagctttttcaggttcagcttcatcgtagggttcctctggaatcaaagcatcatgtttctcaagcagttcagttagctcaccactctgagccatgctcataacgatgtcacacccaccaacaaattctttgtcaacatacagttggggaatagtaggccattgactgtattccttaatgccctctctaagctcttggtcctctaacacattgtaggcggcaaacttttctggatcaacgccctgctgtcctaacatctgtatagtagccctggaaaatccgcattggggttgctgtggggtccccttcatgaacaagactaccttggcagagttgacagcgctttcaatggcatttttggtttcgcttgaaagaaatctcagagccgtctgcggtctcagtatagactgtgaaaaggtgctcctcagaggaatcctgttgactgtagttctgaacattgatataaaggattgcttcctgtgcttactaacagttgatgtaattggttaaggtaggtacgattgaaggggaaaaataatgtacttcagttcgcgaagttgtgcttggggaattgattgcgggttacaagagggagatatacacgacaggtgccctcggtaagcaggtatcacatgcgtgagtggtaaagatgaggatccatgtatataaaaatcaaaggccccttataacttttaagagaggttataatcactttggatatgtattcagcggagaataaaattattgatgcccattggccccgctacactgagaactcaactattgataaggagaaacggttgaaactatgctatcttaaatataagttcgaaggtacaatcaatgacaataagcccattctcaacctaatattctctcatgcgacaggaatgaacaaatcaatatggaaatattacatcaaaagattgaagaaattggcttttatgaaagatgattatccttttgtcataggatcaatgattacagttgaccatgtacagcacggcgacagtggagtgctcaacaaagacaatcttggcacagaattcaattggacggacggagcaagagatgtcatcaaggtggtaatggaagaacgctcaaacgatgatgctttcaaaaaaggtaacaatattctaataggccattcctttgggggatttctctcagtttacgcagcatttttggaacctttactctttcaggatattattacgatagaacccgttatttatggaagacactctgatccttctgccgcacctcctcctgaagggtataaaacaatgggaaattcggggttattgtccgcactagccagaggcatcaaggatgaatttgattcgaaggaagaagctgttgaatggcttagaagaacgtcttttttctccccctttgagtcagaattattggaatattttatatcagatgaggtcatacagcgaccggatggaaaatggactaccaaaatctccaaagagcagcatctgacatgttacaagggttatgacagctccgttcctatggggatgagtagcgttcagtttatcaaaaatagggtccttcatgtggttggagggagcgccacatggaatccgccagagacaactaatttcttgatcaagaatttggagaacagtgaccgtatcatagtccctaatggtacccacactgttcctgaagaacaaccggatgatgtgctgaaaataatcaagagcaggctaaccgaaacgggtttttctttacaggaacccatcgcattaactgctaaaccaaagctctaacagcataagggttttgtcacgttagatagatagatgtaaatcctagtaagtactacaactctcgaaatgttgtaaagataatttttcagggaaaaaaaaaatctatcttgaaagccagacttctaaatattcttgaaacctctctaaaaatgagtgaacttatcaatgaagctccaaaagagcaagtccttaagtacatcaaggattatctagacaatattggtttcaagaacgccgcagaggctgtcgaaaaacaggccaagaaggaaaagttgaacttggagtgtgctatcgaagatggcgagtataaattggaacagattgtcggaaattggaacattcttgtcagcaatgtcagtgatatggagattgatgacgattctgagtcaagtggaaacgaaagcgacagtgaaagttccggtagttctgacagttctgacagctccagctctgattctgattctgattctgattctgattctgattctagttcttcttctgattcttcttcttcttctgaatctgagtctgaatctgaagaggaagatgacaaggaggggaaacaggaggatacaaaggatgacaaaaaagaagaaaagaaggaagagatcaaggaaagttccagctcgagttccagttccagtgagagctcttcttcaagctcttcagacagttcgtcagccagttcttcagatacctcttcagattcatctgaaagttcttcagatagctcagattcagatgatgaaataaaggatgaaaaggtcgaactgctagcagaaaagaaggaggagaaagaaggaaagaaaatagagaagaaggataaagttgaagagaagtcaagtgaacaatctagcccaagcgagtcaggctccagtgacagttcatcagatagcacttccgattctgaatcagattcagagtctagttcgtctgatagcagcagctcatccagctcatccagctcatcgagctcttcagagtccagttcagattctagttcagattccagctcagaaagttcatccgaaagttcagattcagaaagctcaaactctgactctgactcaaaagctaaatcaaacaagagatctcagaacagttcctcccctaacaaaaagcaaaaactacactcttcagagccctcagaatcagcatctgattcttcccacactgactccttatcctcagactcgaaaccaaaaaaagaacacattccagccattcttgagaacgaggaagtcaaagaaggccagagaaagcatttctcaagaatagaaagagaaaaaatttcctttgaagacggcgccttaactgataatacttacaaaggtgctgcaggaacttggggtgaaaaggccaatgaaaaacttggtgctgtacgtggaaaggactttaccaagaacaaaaacaagatgaaaagaggatcttatagaggaggttctatcactttagacagcggaagttacaagttctccgattagttgattatctagaattcctaccatatgtaaagcgtactgttaaacttataaaagaatgcctttaattgtaagtaaaatacacttgacactgagctataaagttaaacactagtaaccgtcagtaaggtcgaaattttttattatgcattacacatttccaatatatcaacagaggaaatggctcccacaatttaatagacaaaaggcgaaaaaagcacgcttctttcagacctttattcgtatctgtacagttttaactcgtctaatagttggatccgccgatctgttctctatgagcctcaattacatcgttatcatcaaggtccaagtcatctggagtgttgtcatccaaaacacgttgaccgtctaccaaaaacctaatagattctctagtcttaccttgtctcttgcagaaagcgtccataagtcttttcagaggggtctttctcttaatcttgaaaaaaacttcagaagaaccgtcactgacttttagattaatgtgttcactcggttccttaatatcgggcttggtttcagtggctgatggagattcagacattgttgtgtaacttgttgtgaagagtgataagacgaaatgctaatgtcagtgttttgccagatcgcattaatagtcgcactacaatataatgattacataattacattacggggaaggccaacagtgtgttgaaaagtaggtgtaaaaaagatagaggtaaaagaacgaagtgtagcttgcaaggaggtaagaatctctggctcatcattggatgggatatagtttcaattgatgctacaagtagagatcatgctattcccgtccactattttcctcttactaatcagcatcactctaattggtacactaccattattattcaactcctagaacaatatgtaggaactctgtctcctctttacttgccactgagttttactttaagagaaattcaatgtcaaggagaccagcagtcaactacttggaggatgaattctcttctgattcatacagtgaggaagaatttccgaaaagaaggaaaaaggttaacaagaagaaagcccagtctgctatggatgagatcaagaaacagaacaaggacaccaaatttgaagaagatgagttgattgagatccccttggatagaccatcggattttatacctgattcagtctccaaagtatttggatcgtctgatttttcctatttgaagctgaagcctgatcatgcctcaaggcctatatggatctctccaaatgatggtaggatcatattagaaagtttctcacccttaagtgagcaagcacaggactttttggtaaccattgctgagccgataagtcgtcccagctttattcatgagtatcgaattactgcttattccctgtacgctgctgtctctgtggggctagaaaccgatgatatcatttcggtgctgaatcgtctatccaaagtacctgtggcaccttcgattgtgaattttattagatctgccaccatttcatatggaaaggtcaagctagttctgaagaacaatagataccatgtagaaagttcgcaagcagatattctgcaaatgttactaaaggacgaggtgattggccaactacgagttaaatctgatacgttgacaactaccagcgatggattggtacgtacgaataagccaaaatctgatggccttgtcattgcgggtacagctgctcctgcgagcgacaatagcatcaccaacactttcaacacagctataggaagtgacccgttcgaagataaagttgaagaggacgatgaggacgaagatgatgatattgataaagttcattcgttcgaaattgcctcggaatccgttgaaatcgtcaaaaagaggtgccaggaaattgattatccagtcttggaagagtatgatttcaggaatgatcagcggaaccctgatttggacattgacttgaaaccatcgacgcaaatcagaccatatcaagaaaagtctttatctaaaatgttcggtaatggacgtgctagatcgggtatcatcgttcttccatgcggtgctggtaagaccttggttggcatcactgcagcttgtaccattaagaagtctgttattgttctttgtacatcatcagtgtcagtaatgcaatggagacaacaattcttgcaatggtgcacgattcaaccagaaaatgttgctgttttcacatcagaaaacaaggagatgtttactggtgatgctggtctggtcgtatctacttactctatggtcgctaacaccagaaatagatctcacgactctcaaaaagttatggactttcttacttcgagggagtggggttttatcattttagatgaggtccacgtcgtaccagctgcaatgttcagaagagtggtcacaactattgccgcccacgcaaaattaggcttgacagcaacattagttcgtgaagacgataaaattggtgatcttaactttttaatcggaccaaagttatatgaggccaattggatggacttggctcagaaaggtcacatagccaatgttcagtgcgccgaagtttggtgcccaatgacttctgaattttatcaagaatatctcagagaaacctcacgtaagaggatgttattgtatattatgaatcccaccaagtttcaggcatgccagtttcttattcattaccacgaacaacgaggtgataagattatcgttttttctgataacgtctacgccttgcaagagtatgcactaaagcttggtaaaccatttatttatggatccaccccacagcaggaacgaatgaacatcttgcaaaactttcagtataatgatcaggtcaacacaattttcctttcaaaggtaggtgacacatctattgatttaccagaggcaacatgtttaattcaaatttcttctcattatggttctagacgtcaagaagctcaacgtttgggtagaattttgagagctaaaagaagaaatgacgagggatttaatgcttttttctattcgttagtatctaaggacacacaggaaatgtattattccactaaaagacaggcctttttggtcgaccaaggttatgccttcaaagtcatcactcatcttcatggaatggagagcttgccgaacctggcatattcctccgctcgtgagcgtagagaattgttacaggatgttcttctgaagaacgaggatgcagcaggaattgaagccggtgaagactctgagaacatgattggaggtggtgtcagcaagagagttcgctctggcggtcaatcttcctccgcaacgagaacgacaggatcgttagctggtcttgctggtggtgaagacatggcctatgtcgaatacagcagaaacaaaaacaaggaactaaaggagcaccaccctttaatccaaaagatgtactacaagaaaaagagatgagaacaagatgtattgttagtatgataattagtctattctctattgtacatttgattacacgttattctcagctccctggagtgcttcagttctcgggctgtcttcgacctgatcaagctcttcattgcattcttgaatcactaattgttctagatcttctaaattcgattgaatacccagcttaaagtcaaccacaaactctaatatttgtcggaccttattttgataatccattctttttcgattaatttcatgtttcaactgatcatattctatcttaattgagttatatttttggttcactctggatgtgttttctttggacttgagttgaatggattgtaagtccctattcaactttgccaattctatgttagctttggaagattcgttcatcatagtttcgtacatttcgtcgtagagaagtttagactctgttaaattagtttctaacgagtctacttgatctttttgctcgtttattgattcgttgataagatccaaattttcttgaagctttattatatcatcttgcaaactgtaagatttttcaacgatcaattttttcagttcaaactgctgttgttttaaatccttttcttttatatctgtgatgatttcatggggtttcaggcctaacagggaatcgtcgtttaggaatttgttggagaaggtcgttatctctaaatcaaacttagatacatcatactctaagttgcctatagaattgatgatcttgtatacactggagttgtaagaatcaatcttttgctgcagtaaattgaaagaattgcttgctgagatttcttttgcttttatgttctgtgttatttctgccatcttttccttggatcttgtcaattctttagacagagaggtgttttcttggtttagatactcaatatcctcaactgtaaagccttcttctcttagcttagcaacgatcttctccttaatggattgaagagtttcaaactcagattgagactttcgtagctcatcttgtaaggaggtaagtaccggtttccatttcaatttctttgcctccatcatttcaatgtatgattggaacttctctagatcttgtttcattatgctgcatttcttcagagcatgcgtgacttcttcgttggatatttgtagcgtggtcagttcttgatttagatttatgttactttctctcattgctgtaatgttctccgctaaacgattggcataaacattgtaatcactttccatttcttgataaaatgatgaataatcgtcttcattattcaagtacgatttgtaggatttgataatgtatctagtgaacagtttgtcaagtatcaagtcatcttgagcaattgcattgtcatcaactgaatttgtgtacgattctatttgaaattggttgacatcagcttcatcaatttcttccaatgattctcctagtttaacgagccaatgtaacataccaagaaaaataggccaattggatccaccaacagcactgatctgacttttgttgattgcttcaatgtaaggatatcctaaagttttaagaagaaaatagacctcctgttctatggactttagaaatttgtaaccaggatctatcctcttgtacaaccattgaaataccaggacaaaatctttctgtgtgggaaatttgagacttttgatagtgatgggatatttcatttccagctcaaatttgttttccattaaatagtcatgaacttcctgttggagcattgcctgatacgatttgtcccgtaatggtcttgggtctttgctgaaagagctcgtggtattcaacccaccgtagattgacactcgcttggtatccattcccccatacatagacacgcgtcgtttattgttagccccttttaatatttcagactttcgtttggtggctgctgatatggttgttgtagcactattatagcccactgtagggtgccctggtccaccaattgttcttctcttcgtgctgtcatagtttagcagttttggtccaccaatgatcgattgtcgcgtggacagactcaaacgcttggccctgggaagagtagtattcaactgattattgtttaccgaggccaggggcatttttgaacggtaatccatctgtattacaagagatgtgtctggctcttgttattagtcgggcttaatatggttttgtttttgtttatttgttgatgttttgattcaggtcgtgcgttagctaattggtagagaataatactattacttgtgaagtgcacgaccaggtatctgagtttctcttcatacgcgttacgtgacttcagccaaatggtcctcgctcacaaatatcctcggattgattacacttactaagcaatgattggcgaaaacagaatatactaccaatggaaaatgttctccagaaatgttgctcggtgcgcggggttatgtccatacttggtagcagtcattctccttccaagatatatgccttcctttctgggaaatcctcgctatcttaggacctttgtgacttgacctctctcccctcgttttcatacgtccctgcccttcgaagagagaaacccatacttcgtgtccttccaaaataatcaccctgccatctttagcgcgtgtactaccccatctttataactgacatctgctatctcacttaacttctttcttctccacacctggacttactatgagaagcaagataatataccgctttgcttctacaaagcccaaagagattgaccccattgttttggatgaaattttcaagaagaacaaacccgtgaaacgatacaggctgatcatccgtaataataagctgcgatcaaatgaaaccccgaattccaccacaagcgctgaccagctcaaaattctggacgagaacctgaaaaaatttaagaatgcccccataaacttcaattattatcttcggaatatcgctggattgaaaacgagtagccagttaccatacaaatttggagagaaccagataatcaccagcgataagaatgagacattgcagaaagtcctatggaagttcaatgcacctattagatttgctgcgggttacggttccggtgtatttactcaagcgaatcaaaaagtttcagaaagtaaacctcagatggatatgatatacgctgtatcatacccagaccattggcacgcactaaacctacatcagtttccagagcattattcttttttgagaataggcggttctgggttaataggcaaggtccaagatttaggagctggagtttatttcaatccatatgtggacatggaaggttgccagataaaatatggcgtaacctcaatgaccaatttgatgaatgatttaatcaattgggacactttctatctaagtggaaggctgcacaaaccaataaatataatgagaaacagtccaaatattcaattgctgaaccagtttaatttgatcaatgcgatcaaactatcgctgttattaaactccgacaggggtactgagttttcaatgagtaaggaagagcttttccatctgatcacttctctttcttaccatggagatcctcgagtgcagttaggaggagaaagtcgtgacaaggtctcaaacattgtttccggccaatatgataaacttgactggatgtatgatccattgctaagaagctatttcgcagatgtcgtccaattcgaaactgactctacgtttaaagttaatttatccaccgacgcccagtcaagaatgattgtagatttaccaaaatcattcagaaagaagatttacgccaagtatgctgacaaatactcaaaagaattttctgaagatattattgctcaaaaattacttaatcctattgaaaatgtggtagcacctgaactttcagacctttctttcattgagcttcaaacgatcagtaattctgatctatcaaagttacctatccaggattacgagtacatctcaaataacataaaatgtaaatcttcgtttcctttaaaaattgccgaagatgaaaacttgaaacacaatctttaccaagctttgaaggagaccatatacaaacctgcttttctacaaagtgtcaagggaattgctacagcgggagttaccaaaagcataaagtatgcctgggccaaacgaaagaagtataactcttctataaactagtgatacacagaaccatctaatatacaaatatttatccccaatttataactggtctaccttgatgacaacactgtcaatattggaatacgatactgaaagtaaggaaccattcttgttccacgataaactggtaataaatatctgtttgtcgtcctctaaatcgtttccactttgttgtttttcgtctacatcgtcgtcgatgagtatatcgttctcatctggctcttctttcttggaagtattaggttcgtattcggccacacattcaattgattgaatgttggtaccagtgttggatgcatcaagtttatgttcagataggaattgttccaaactttgatagttaatggaccatatctttatgctcccatccaagtcaccagtaacaatcttagttttgtcaggagaaatcttgctgcaaacaaacggcaccccattttcatttaaagagaacattacagtatcacctttgtagacatcccaaactctaatggagccatccattgaggttgatattaaaattactagcttggagagatctgggttcttaaatttttcatttgtgggaagccaatcaagtgacaagataggctgggtatgaccttgcaacaattgggcggagtttaacgaattgcttcgccatattctaatatcgttgtcatctgagccagatgcaagaagatgcaattctttgtaatatgctaagcttgtgattgtgttggaatgaccatatagtgttcccacaggctctttctctgatacttgaaaaatatgaattgagttctttagtccaggaacaacaaccttggattcgtcgatccacacggtatccagccctaatactctatctttgagaccagcatccaaaacttggcgagctttgccggtgaatgaatcccatatgatgacaacattatcgctatctaaagtgaggaatgaacgagaatctggtgaccatgacacatgcacaataggcgatgcatggttatgcaaaaccatctttatcttgccgtcagcttcccacattctgatctcgccattttcacaacatgttaacagtgaatcacccaaacgagaccatgaaacaagtgtgatatcattacctttttcattctctataacataatgctcaacatcaatctttatttgagattgatcgtttatcacacatatgacacttttacttttcctttcaccccaagccaaaactttctctgaagaggggttgaaggagctatgcatcgacgagggatatgtaaataagcttttcaacactcgggtaaaacagctgttgttgtcagtcgtattagttgacggtggaactatttctgtgtttgtgtgttttatagagcttaatagattcagttcttttgcaaactcgtgcaaactgctcttagactccagcacttcaccttctttcattgtgtaaagaattcccttctggatgaagttaactaaacttccaattggaattttattcttatataattcatccaattcgtgaattttcgtctcatcatcaagggcataggccgaaagctctaacccaacctcttggaaatatcgccatattagatagttaacctcctggctggttagagtcatattatatctcactggaggtgttcagcagaatgagtttgacaaggaagaacacactgtccatgataatcttcgcgaaacatcgaaaaataatatattggaccagtacacgactaatgtcttctgtcaacttgcttaatagtaatggggtgacatgactaccatgtactgattttctcgtaaagactcaacagctgagccgatttttagattgaggcatctttaaaatagtggtttcgagtagtattaatgtttcgatatgtgatcgtagaatccttccagaagaggtgtgtggtgtgtccttttcttcacttttgcgggccaaaagacgagcggtagatcgtcatggatagtttgtgcggtgaaattgcgcaaaattgcgtttatccaccaattatacctttctaggtcgatcggcgcctggcaaatctgcgccagatttcaatgatctgaaaactgtagggttagcgtaggcgcggaaagaaaatccctgcgcaaaccccatcataatccttcctttgtaagccggacaccttcttttgtctttcaattagtaagacagccgttaacatcacttaaacgttttaaatttttgttaacacatcgctcaaaagaaggtcaatagaagcctagtaagattgagtcttccaaaaaaccgatgaccgaaaaaatcctgctaaagctacagaatgtcaccccatacaagatacccccgccagaaatagctgaagaaactagtaatgaaaccgatcgcatattaaaacagaggtataaagcactaagctggagagatagtccagagaacaaatttcccgctgttgaattgatcataaaagaaatcgagagtgaaaatggaagtagtctttgcatggaaatgaaaggaaagctgaatggaattacgtggtatgagccaataaacaacatctttgattggagagatcatcagttttatacaatcaacaaagtgggtccaaagtcttttgtttcggtgctagattactatgatgtaaaaagggataggcatgtaaatatcgcacttggattggtgatgaacacgttgaaggatgagctgaacttgaatgacgtgctggtttcttttgacaagagagtagagaatcgtatcatgagacaaaaggtcaacttgaatgaccaatatggagattatggcaacagtcaatgataaacaagttgaattgttgttcaaactgtttggatattgtctgttgacttgtcttccttttttcagttcttaggctagcatgctgctaataaaatttgtgatttatagataaacatggtttatcatgaatggttggaactaaatgagtacattaactatatacagagctggaaatagacaatgtgttctatttagagcttttcccaactggctttgtactaagtgatatgaacagatttgagcatccaaactcttccttcaactgctttcttgtgtatccttcatcccttagttgctgcattctagcaatatcctctttgctcatgtgatatttcttttctctggtctcgttcaaaagaggcatttcgtcaatattttcttttggaatgctaaaatttagcttgtataggttattgttcttcctaacatcttgctcaggcagaaacacaggtggagtttgcaaaggtgtcggtatggtaggtgctggatgatgatataaacctttgggaagattaggtttcagattgaacgcagaggacttggagttgaacttgtttggagtcgtcgtcaacttgccaatagtcgactgtcttctaatgaactgtctcatcattcttggatagaaaggcgatgaattgggagtaacaataagaagtcaactgtgaaaaacttgaattatgtgtcgagcgaaagtttctaggggaggccagcttagagtttccttcctgccactggaatccgagtagcaagagcttagaaggagaaacatcgcgaaacttccgtgcgagagaccactataaaatatttccaaaactttttccttttccccacacaacgataatgactaatttccagctattccgtacgatacaagaagtgcgtgattggagattgaatcagatcattaatggacatagtgttggttttgttccaactatgggtgcacttcacgaaggtcatttgacactggttcgagagtcgttgaacgagaatgacaaaacagttgtgtctatctttgttaatccgtcccagtttgcaccgacggaagatctagaatcctacccacgcactttggaggccgacttggaacaactagcgggtttagatggcagtgaaagtatcgttgtgtttgttccaacggtgcgagaaatgtacccatccggcattccgttagacgtatctcttcaaaagggggcatttgtgacagtgctaggagtcagtgaacaattagaaggcaaattccgacctcagtttttccgcggtgtggcaactgtcgtttgcaaactcttcaacatcgtgtatcccaacaatgcatactttggttctaaggatatccagcaaacaattgtagttaggaggatggtaaaggatctattgattccaacaaatatccgtgtaattttgacttgtagggagaaatcaggattggcaatgagctccagaaaccaatacttatcatcggaaactaaaatgaaagcttctgaaatttatcgatcacttttggcagcaaaggaagtttatgacacagaagattgtactgcagaggatctggaatcagctgttcttgaaacattgaaggagtacacaaatggagttaaagcatcatggaacctggaatatgtcagcgtcaatgaatacgagactttagacgagctcaagtcctcagagaaggtagacaagacaaaaccaactatcataagccttgcagttcatgtacctagagcaaccaccggcacagccagactgattgacaacattgttctaggtgccaaaagtttgtagatagataggtagaaggaaaacatgtaatatcatcttcgcgaccgtccaagacataccatcagttatcaggcccaagataaatagatctcctgtgtaaatgtctcacaaccattcccaacacaatagctctatgatgacaatatcgccatccatgagccacaaaagagcagttttgacacccaataactcttcaaaggtaactggtcgaccaatgggcaataacggtggaagtgtttctaacaaggccttctcaacacctaagtttgatccaaacaacggatttaacccagaaattgacgaaggtgtctccttcttaggcactagtggcggcgtggccggtgctccaggagtttctacaaccaaaaaaccgctcagcttggctgataaactaagactgtggaggcatgatgctttaatgcaacatcattataacactgctcagtatattggggacaaagtattgtccataacgaatgacccaaatgatgcattctggttagcacaggtccactatcaacaaggaagttttcttacggcaagaaacctgttgagaggagatcagtttgaagacagtttatcatgcaaatatctttgtggattatgtctaatagcactggaggaatgggatgaagcactagatgttgtcggagagtttaacccctacaagatggacgaggatgttacagatgcagtagattttgaagatgtggacattgataactataccgatggaggaattaaactcgaggcttctatgtgctatttgcggggcaaaatctatatgaatatgaataactttgatagagctaaggattgtttcagggaagctgttttggcagatttcaaatgctacgaagcatttgatgagctaattactaataattatttaagcccccaggatgaatgggagttgttggagcaaattaactttgatcaggctgatgagttagtgaagttgctatattcaactagattgaacaaactggctcattcttccaaattcttagaaaatgaacaaaaactgcaggatgaatacaatttgaaaggaaataatgatttgaatttagcaaaggctgaactactgttcttgcagtgcaagttcgatacatgtttaacagtatgcgagacgattttgaaggacaaccaattcagcttcaacactctaccactatatttaagttgtctttatgaattggacgcaaaaaacaaactgtttttggtatcccatcaattagcagaatatcaccctaatcactacatcacttggctaagcatcggaatatactatatttccatcaaaaaaattaacgaatcaagaatattctttagcaaatctaccatgttggcgcctaattttgctccagcttggatagggtttgctcatacgtttgccattgaaggcgaacatgaacaagctattagtgcttattccacagccgtccgacttttcccaggatcctaccttccatacttgttcttgggaatgcagtacctacaaatgaataacttaactcttgcatatgaatatctcagtaattccatgctgatatgtgatagggatccattgttgctcaatgagcttggaatcatttactaccaccgaggagagctttctaaagctgaacacatgtttaatcgctcgttagagcaagcacataacctgaaaattgattccaaactgtattactcaatctactcaaacttagcacatgtgaaccgtaagctgggcaactttcaaacggcacttgagtattttgagaacgttcgaaagatcgatagtaaagactccaacatctatgcgtcgatgggactaatttatctcaagatgaacaagatagatcaagcgatacagaccttacacatagcattgtctatatctccaaatgataccatttcttcagaactactcaacaaagcgttaagtctgaacatgactataggatatgaaaacctgttaaaccaagatgtagacgctttggttcgaagattgcatgaagggagtgatgaagaagacgaaggatttgcagatgattaaggcctagtctgctgaactacaagcatgtttttacgagctttattaactgcgatattaaaacaaggataacgggttggagctccaccagagtttactttttatacatacatttcctgtcttatataatctcttgtccttatcgcgctccagtagtaatcagcaacaagttattccacatctcatctcgttatgaatacgcatcagcccctcacgaagaagcccccgagtccaaaatctctgctcaattgttcattcaaccaagatcaatcatgttttgccgtgtgtcatgagaatgggttcaaagttttcaatactgatccaatggaactgaaagtcgagcgatggttctctaacggttcatcccaagagggaacttcaataggaaacatagcaatcttatacagaacgaactacttggcgttgataggaggaggacacaatccaaagtatccgataaacaaagtgataatatgggacgatttgaagcagaaacagtcattgtctcttgagtttatgaatccggtattaaatgtaatgttgtccagaaccaggataatagttctggtttataataaagcttatgtttatgggttcaattctccacccaagctgataacaacaattgagacattttctaatgagtttggcgtctgtgattatcatgacaatatcggatccatctccactacaaatggtacgtcgaatcctaccggatcttctttattggcgattccagggaaagcagttggccagattcaggttgttgatatatcaacaaagaataaagttacgctggttaaggcacataaaagtaaacttcagaaggtggctttgaaccagcaaaacactatggtagcatcggcttcaatagcaggaactatgatcagaatacactctacaacgacaggtagtctgctgttcgaattcagacgtggaatggacactgctttggttaccgctctcaagttttcaccctcagggaccaatcttgcggtcctttccaacaagggcacgctccatattttccatgtcgatcatgaaaataccaacatcaacaacaaacacctgttaaacaatatttcagttctcccaaagtattttcattcaacttggagtttttgctctgctcgtctcactgatcaaaacgataaagatatcaacaccgatgctgagatcggttgggtcaacgatactagtttagtgcttgtctacaagaagaagagtaaatgggaaaaatacgtcatacaagagcaaagcagtttatcttcggacaacaaatccatggaaaccaaatattcattagtgagggaaggctggagaaggcttttgtaaagattttgttgcgctagagacacggcttagaaagataggacaagaaacaaaagagataacaaaggcaaacttactagcgcaatggcaaatcctagaatagcttggtaattgctaatcgaccaggatttcctgacccaatgcatactttcatcaataaatatattaataactttaaacttgcgtgtttaacatggcggtccactatttgacttagtatggtggcagactgctcaagtagctagacaagtcgtagtagccggaggaaatgttaatttcggtcaccgcctttagagcctcgtccactgtcaaaaagtagggcaagtttgaaatatctttggaagttccttgaatttccgcgccagtcatgtttctgatgtcattggcaacctcaacaagcaactgcttcacctttgatgtttccaatctggttctaattttcttgaatgtaggaactctggcaaacataatacagatacctctctctttataattgtgaacaatatcatacaaaatctgagcagcggtagagtctaaatctgtcatgccgtttaagtcaaaaatgacaaatcgggttaggttctcacccctgaggcgaggagttgctggatgtattttgggtgacccatacaattcaacccttcgcaaccgagctttcaagtcagaagagttgatgaatgtaagtggctctggaattttgattattaaacagccatctacgttagagtgagctgaacatgctgaagaattgtccaaaattgaatcactgcgttgttcctggggttcgtctgcattgacaaaagtatccagtgtggaggagcgtgtcaatatttgaatacgagactgtccactgtgtctgacaacacgcaccaatgagtacaggacccccaagatgattcctgcttctatagagtaaaacatggtggctataatggttacaaaaaatgtgagaagctcattataaccgctatttcgccaatggaaataaatgtctttgggaatctcttctaataatgagaaaccaaccgtagaaataatcactgaaagaatacaaataggaagataatacaggtaagacatgaaaaatattgtcacaataagaataatcagtgccatgcaaaacccggacattgtagtcttggctccacttaaggcattgatcttggagcggccatatcctccaaaagaaggcagtgcaccgaacatggagcctaccaaattgatggaacccaatgcaactaattctctgttggaagaaattggcaggttatacatggaacccagtgactttgaggcagttgtactttcaaaaaatcccaatatagcacaagaaaacccagcaccaatcagaggattgtaatacttgacaatgtctccacagaaaggtaatgaaaatttgaagtgtttggtatttacatgaccaagcactttgatacccattgattgccaatctgttgcccacgataagactgtagtgatgagcaaaacaatgagaatttcaggaacaaacacagccttgttcatattgcgggaaatacaccaggacttgacagttctaattaatagtaacaccaatagggacgccaaacagaggtatgctgttggtttgtgagtttcagggaagtagcgatatacgaagtctcaatttctcggtaagtgccctgtgatacatcgacgagcttcagggtccagattttcatatatctctgaaagacccagttctgtaattgaagagttaataagcatgacaagacccacaccaccaataaaacccttcagtagggaggtggagagaacattgtccaaaaatccaaacctggccaaaccgaagcccagaagagttgcacctgagaccgaagttatgacaatcaccagatcaaccacatcgacgcctttttcatgagtatacggttcaatggccgtcccaacaatcaacgacaaggctgcctcaggaccaacaatcatctgcggaactgaaccaaaaacggcatagatcatgggaggaatgatcagaccaatgagaccacaaatgggaggaacccgagcaatagccgtagcataggacatcgacagtggcatttgaaatgatgctaacgatagaccagctaccaaatcaccgaagaaaaactgccaattatacgagggcaaccagctgacgcagggcaaataataagaaaccttgtcggacaatgtaggttcagggtttgacaaatagttggaattagacagagattcaaaggtctgtttgtgttgcaaaagaggcacagattcactcatgactctatcgatggaaaaatcgttcggcttgttgttattgcccagcggtagcttggaacgcgtcggaaaaatttgggaagcggacatgttgccttttaactcataaagttgtgatggtcgcaagtggttgaagaggtgaaaacctagtggataaaatccagataagtcaactgtgtgagatgcgggcacgtgatgtagttttgaagggagatcatggaagatgggaactgacaccaaatgatggatgttggatgtctgtaggagaatgaaatagtacagcaagacaaaactgtggaaccaggtatacttttttttttctctctagatccttctcctacggaagctgcttagggctgaagattattccttgatggcaataagtaataatagccgtctacagatctgcaaatacactaagtatttaagtcgtgccgtgccgtgtttacataattactattgtgttgatctccccatgtaaactggtgcctgatcctcggcttgagcccctctacttcatggccaaagaggagccaccgtgcggatcggagaccgatgtttgaaccaaaacagtagtccgcgaactaccggctgacgacacttgccgacaaaatatgtaacctcacagcaaagtgcatgattgttactaatagcttattcgtaaagtcgcccttttctttttcttacttattcatgttaaaagccgtgtgcttccaacttcctggtctcaaattttaaagccttagcattgcatttaagaatgtcgttacaagagccgtcctcctcctcgaaacatttggaagatagttcagtctcgcgtgagtcgcagtctcatgatgaatttggatcttccacctcaaagtccacgatggattatgatccccaaggatctccagttcaatatgatgctgggttgcaggatgaagtagattgcgatgtcttatcaaaaatagagagtgatgttaacttgtcaagagagctctcacggaaactgaccaacgcttttgccgtggaacaagacactgacacgttggcccctctccttccgatggggaacggcagaccttaccccccgcaagctcccgacagggaacagtacacagttgcattcgacggcccaaacgatccattgtttcctcaaaattgggccacggggaaaaagattagaatgtgtttgttaatcggcctcaatgcattctgcgttgcttttggttctgccgtgttctcccctgctataccctatataagtgctcaatacggagtgattaatgtcgtctccactctaagtgtgtccttgttcgtcattgggtttgctactggtccagttgtttgggcccctctttcagagttgtatggtagaaaacctgtcttgtttgtgtcctccttgggattcatgttattcagttttgccgtagccaccgctcaagatatccagaccattatgatctgccgatttttcactggtgccataggctcaggtcccatggtggtagttccggctggtttcgctgatatgtttggtagtggtagtaggggtattgccattacgatatttggtatgactatcttttgtggtccattgttggcccctatcattggcgcatttattgccaagtcatatttgggatggagatggatcgaatacattctgggtatgttgggcgcagctggttttatctctgtgtttttctatgaggaaacgcaccatcccatcattctcgttaacaaagcggtcacgttgagaagacgaactggaaactggatgattcaagcccctcatgaggaagtcaccctttcaatcaaggaaatctgtgaaaagaacattactagaccattgaaaatgctgttcactgaaccaattttgctgctgatctccatttacactgcatttatatacggaatcttgtatttattccttacagcatacccattggtatttaacaaagggtaccatatgactcaaggtgtggctgagctgccttactttggactgatcatcggacaacttttgggaggtgccttccttatctggtatgaattgagttacaatcgcaaaattgaaagatcgggtataaaacgtactcccgaagctcgtttggtgccttcaatcgtaggcggtattgcatttccaattggactgttgtggttctgttggtcaggttattacgcagatgaagtacattggattgttccaacactgtccggattgttctctggatttggattgatcacaattttcaaccaatgcttgaattacctggttgacgcatatttagtgtttgctgcttcagccatggcagccaacacgttcttaagatcatcatttggagcctgtttcccactgtttgcaggctacatgtttgaagctatgggcataaattgggcaggtcttttgataggattattcgcggcatgtttgatccctttacccatcatcttttacttctacggagaaagaattcggcacaagtccaaatatgctttcgtctattgaacaaaggcatgtatttagcatacatattaatctcggtaataacacatagtcatacttaaattttcttccatcagacatctcgatctattttcaacgcattgtgacaacatagaatcgagaaaggcgcgtttcggttcctgtctcctttccttctctcctctattgatctcgcatcacggagcttcacactactacgtcgcccctagatggaagagaatcccatcagtatcgaaccactaattttaggcggccgtccgactccattggattctgaattgcttgggtggcccggtcacgaacgaactttcagtgaagaatctgggacgtcttccacgataataaacaccaatactaagggttcatcatccgtggcttctgaggtcaagaactccttgagtcaggatttgaaccttggaaggatctacaacaaagctaaaatgcgccgagatgaaaatattccgtcgctagaaagggcgcctaacgagagtttggtagcagacaataattcaaacgacaataataatgataaacaagacaagcacactgatgatgatgacggatcaaagctgctggaaaagctgatcaatgacacattgccgtcccctccttcgtttccccccaaagaattgcttccagatagactttattcgctttataattttcagggtcctgattcggggcacatcactctaaaaaaagacgatgctgtgcagcttttaaacgacgacgatgggtactggtggcttgtacgaaaaattaatatcgacgatccttctgcaaagaacgttggatttgctcctgctgagatactagaaacctatactgagagattggcaaggctaaattgctggaagaatgaggaagctgagagaactaataaggaaatcattcttggatcaaactccacaatcaaagagacgtcacttttggatctcacctgtgatgaaataggtgcgtcccataatctggaagctgatacgacacgcaagtctgtaaaattccagaacgacaatttagaaatggccgataaagagaaggataaagagactgagatactgagtgaagtttattctgattcggtagttcctttgaacattttcaaaaacaagcgattgaacaagcacaattttctaattaaagatcttgattcgtatgagattgaggcaaaccagctagaaagtgaccatgaccaacaagttgacgattataatgatgaatcaatccaggagctggacacccatctcaacaggatagaaagatccgatcatggactaagcaacattcataaccttgtaggtccttcggaactaattcttcatcaacctgcgaaaatcactgaccccgatatagaatctattggaacattctcgccggatgaagatgaagatttcagtactggctcatctccacaactaacagcgcgtcatcccctagccgatcagaactctgaagatctgcaatctcatacaagtattccagtttctgtgaaaacttttgatttatcatcaaaagtattaattactacaccaagtcaactgaaagacgattcgttctcatctttgcccgcaattaacgacccatcgtcaccaccagaggatcctaccgctttgttgatcaccatgcaaaaaggtgattcggaaggatccttagtcaaaaggaattcgtcactcaattcaaatgtttcctttgaacccactccaactacaagcatatcttttgtaaatgataagatgactacaatcacagagcaaccctccacccattcgttaagatcactcaaagaaccaatagtgttacaccccacagtatcggcgatttttgacactctattaaatgatatgacggaactagaacggagacttgcaaatactttccattcaccaactaaatagcattatgtatcataactttcccgactctagtcattccattccaagtattattttgctctgtaatcgcgactttgtttacgcgttgcaccttaaaaagttaaagagaggcttttgttctgaaccaaacccgtttgatatcattcagctttttaattcctcacatgatgagacggtctaaaactcaagtaaatacatcttcacctctgaaacttgatgttttgaaaaaagcgcaagagaagcggcttcattcgctgaacagagtgtctcccagttggagaagttctaagtcggcggctcccatcaaacagttccaggcttcagtgcaagacgatccgttcacagattctaatgaccactcatcatcggtttttgtcattagaagctcttttccgttgaaagaaggtcgtgaggcggaggagcaaggtgttggtaaaaaacatgctctggtgggcgcttcgataaaggatgctgacgacaccgaaaagaacttgaagcgagtaaaaactgtgagtgatcaaatagactatttatcgaccaagtcccagaatgcacagcagaagctggagccgacttctactccaacggttgccgttgataatagtacgatagacgcccagttttgcctgagcgaagctaaaaaaagctacagtggagctacaaacattcggaaaaaacatgtagaggaagaaaagcaagaggaaaatacacaagtaattatgaaactgaagccaatggagagaactgattttgaatcaacgcaggcaaatgatagagctgaagaaattgatacctccagagaaaatgatgaattggaaacggctacagttaataatgcacacaaacttgaagtagtacaagatacagatgagacagaatatttaacaaaacaatgcattcccagaaactacgtcgatcgtggaaagattgaacaaccaaatacacagccagaaaacgaaacccagaacaaaaaagacgatgatgaagatgatgatattaatgaggaggttaaagaagaaattgagcatttatacacaacttttcccacattatcccacaggtatgcattattagatcgcgttggagaaggaactttctcaacagtttacaaggcaaaagatttaacaggaatggaccgcaaaatgagtggatgccctatttggagctctccagtcaccaaaagcaagaagcataatattgttgctttaaaacggatttatgtcacatcttcgccgcaacgaatatttaatgaactgcaattgctctacaattttacgggatgtgacaacattgccccacttatagacgctttacgattcgaagaccaaatcatagctgtgcttcccttttacagtcattctgactttcgtgacttttacagagacttgccactagatgggatcaaggtatacatgcatgaacttttcaaagccctaagttttgtccattcaaagcgcgtaattcatagagatgtcaaaccaaccaacttcctatacgatccatttagaagaagaggtgttttggtggattttggacttgcagaaaaggaacccaacaaattcagagatgcctcactaaattgtgcatgtacaaaaggaggactgaacttagatgatcttccccagagtttaagaatttcccaaaagggctacctgaaagatgatcagagatctgccagaagggccaatagagctggcactagaggatttagagctcctgaggtgttatttaaatgcactaaccagaccatgaagctagatatctggtctgttggcattatccttctcagtttgctgagtagaagatacccatttttccaatgtcctaacgatgtcaatgccttgattgaactgacacgtatattttccttagccaagatgaagaaatgcgctcaattgcacggattatgcttagaaaccaacatccctgacgtgcaacatgtatccctgggagaacttatatattgggctatcgactttgataacaaaaccagtgtaagtgcctttgccccggattccccagcattagaactattggaagcattaaacgaggatggatctgtaaaagacacgccacttggaaaagaatatggaaatgctctagagcttcttaaagcatgtttccaattgaatccaaataaacgaattactgcaaatgatgctatgaacatgccatttttcgatgcaattagaggcgaaaatgaagaaaatgatgaaatcatacttgattagcaagtctaaaatacattatcactatctatactatttacaaattcatacgtgattgcttatttcctcttgaatttcttactgatactaaacctattattttctagttggaaagctctgatattatccaactccttcacaatagtattctccactatatccttcatttctgtaacaccttccctatcgataaagttcttactgtatcgataactcagccatgtgtatactgtaatcaacttgtggatggtttccagagatctaagttcctcatattgtggttttccccttccagcattccttttgtttttggcttctggtggcttactcgggcatgtcactttgctaaaaagcatagttataaccttagtatcaagaatgctcttcacatccctatttatcactgtttccagataatctctaatagcatcaactttgattccagtaagataattctgatgagcattcatgctttgctctgtatccaatgatatgggtacatttagcattctgatctgatcggttatcaggaaatgagattgaaggttcttgtctaactgattgcaaaagaaatttccagcttcctttttaaattcagtaggacttacttggaatagtccgtttgagctagcattcaacgttttcagatcctcctcaaacctttccagcatttggactaatgtggttcctcgagggaacattgagtagtatttgatccagagttcatctgttggccacaacattgcgcgctgtaggtactcaatctttgcattaatcccggatctaatattgtccaggatatccgcgtcaaacgctgaaacgtggccaatgggaggtttgttactatcggtggaagatttaacaccaaatcttccagctcttcctcctatctgcttgaactgagaatcagacaatataatattagaccggccatcatacttttgtgaggtagtgaagacaacccgattgatatttaagttgagtcccatgccaattgcatcactggcaacaatgagatcgtactctccgtcgttgaatttttgagcttctctggatcgaacttctggaggcaaggcaccataaataacaccacatttgaacttggttacatcttcaatatgagatttggtattcaatatcatgttcttactgaagcttacgatacaatcccccctccggagatctgatatatcgataggcttatcatcaactactaactggcccaatctattatacttgttgacttcaatttcatccccagtttcttggataatacgcttaatcaagggcacactcgattcttctccgcaaaggtgtatttcttttgctaaaactccaatcactacattagtccatgactgtcccctatctggatcagaaatcatctgaatttcatccagaaccacaacatcaaatagttcagtggttggaaccatctcgacggtcccactggtcaaacccgcttgatttccaaagtcgtcgtagtcgggaattacctcctctcccgttaatagattgcatcggacaccctttttctgaaacttctcgtaaacctcacgagctagcaatctaaggggacctgcataatagcctgtcttggactgttcaagccttagcaaggcattatatgtctttccactattcgtgggcccaacgtgcataataaactttctcttcatctttcttgcttctggaaaccattcaacggggtttgtgatgtctatggtgttgaaggtcatattttgtttctgaatattctgagtgttgtaaggggaattaaaagtgtctaataatatatgtggtttcaatccaagataaataacatgctccaaaatggggcttaatggtctgttttccaaaaagttcctccagagggacaagtgagcttcatgaagttttggaaaatgcaacgtcaaatatccttcatgaaatttttcggtgctattttctgctaaacttagaaaccgtttttctatggtttcttgggtaacatttgcaatattatctatgagagctacattctttgcaataaacccctctatgtcattcttcacaaacgctttcaacaggctgcttcttaaattagagtatttcatggccttaatattgttcacaatgtttgaaagatcccgctggatcacgttcgaaatcctagagtgaatctccggatcgtatgtgacctcttcatctacgagtgaaaatgaacgattttgccccatggaaaacttcagctgcgatgaatcttcctctccggaaagatcatttcccagtaaatgcaatgtagggttgatattatctcgtaagttcgtatgcgaagtttgcgatttggaggccttgatgctcgtcttaaagttagaaccaacattctgtttgattttcttccttccggtgaacatggcgttactcctgaaccgaacttgagacgatacgacgtctctgagcaggccattactcaacaatgacttagcccttgtccgtaacattcggtcctgaaataagaaaaatctgactatatgaaatttattgtaatatataatttatcgcgtggttacgtaataacagtacatgatctcaaatccagcttccttaagaaaagtgaagatgtcacaaccatcccaataatgaacaaacagatgtacaaagcaattgctggattataagcaacagtttgggaataaacatacagcaacagtggtggcacgatcaaaataaagaggttccggaaaaacgtaattcctccaaataattcgccaacctcgttagggttaccatacttgagtaatgctgtgtgcatagcaggagaggctagagaagcaaggcccgctggtaaggtggcgataaaaaactgtgcagaatttgaagcattgataatcagaatcatcgccagcaattcaaaaacaaaactgctacgcattagcgtcagatcaatattgtcgacacctttcttatccaagctaaagaatttctctagtagcttcaaaatcatgccagaaagtacgagtatggttaacgtcttactgatcatggagacagagatgaagtaacccatcacagaagaatcccagttgaaaacgtaagtcgcatagatcacagaaacttgaccaaatccaagaaggatagacaacatgagagtgtccatgaagaccataatgataacatttgtccttggaatgtaggttgacttaattctatcatggtccgaatgatcaatataccgtgttttgggtaaccataaaactttgagaggaagaaagaaagaagttaaatgcaataatagtttcttgtatagtggttgagcttgactctcttggtttaacctgttcaattccaaaaacatctgtctggatgattcggaagctgttctactcttgttcctggctcttgaagatctggattctggaatgaaaaacaatatgagtaacagctcaacaaataacagaatagaggctacttgcaacgagagaatattggagtggaagtaggaaaacaggacagagttcaaaaggggtcccagcgacatacccacgtacaaaccaacagcaaccaaaccaatgctgtacattcttttatgaacagggacaatatcagccacataactgtggacgattccaagcaatgatatcataccacctcctaaattctccaaagacattataatgatcagccatactttgtgatatgaaccaatgatttgtggattaagaaaaattaacaatagagactttgaaatcaatgcaaacaaaacgataaaggcaaaaataggttttcttccgtaaatatcggataatttaccgattctagccgacaccaaaaccatgaacaatcctccaataatttgagtcgagctctgcaattcagatagcatagtctgaactgcagggacgttgcatggcattgcttcatgtttgttaacctctcgacatattatttctatggatagtccaatctgtgaaggagtagataagcccacggagaaggacgttaagaatattgtcagacatgccatcgccacagtcggtcttttataccaaactgtagcctcgtgcagcagccaatcttgcttcaagctgcgcatatcatcagcatgttctgtgtctccttgttccgcactttcgttcaacctgagggggaagtctaaagagtcaatcacagggtcaatctcacgggcatctgactcctgggatgtacactcatagttgctataggtactttcaccatctttgatcagataagactcctcaacagggtctgatttacccgtcaccaccatttctgaaacgtaagagttctattccaattacagaagataaacaatctctggtcttatatgtaataaactgtggtttgatctggagcaagttgccctatcaggatgatagggatttcgcacccttgctgattaaacatttgataaagagtggcttaagtaattttcctgtacatataaccgaagaaggtaacagttacgataggcataggaaccagactaagtgtgagcagccgaaatttttttgtggagaattgggcttgggtaactaggacgtcttactctttttcaacgagtttcaaagaatcggttttgcagtaaaaaccccgctacaattcgtaaagtacttattagaattcagtctaagaggtcttgcatctcggcagaaaatgattcccactgattgagttgtcactacaatcgaagctcagtggtcgaaagaaagtggcaaagtctgagtttggacaacggtaaaacaaatcaaccatcccttaactgttggtcactgacaattaagcttaagggcattctgctgaaacttatggggacacacaatacgtggccaagggacgccagttatgataatatctagcggaacgcaacatttaccagctgctcgactgtagttacgctgctgagagcctgagccagtagtgtagtggaggagcatttgtgtgatttaaatgaaccaacatttttcactcatgcgtactgcctagcatgtgagattaatgtcctgataaacagtgcaacttactacttaatttccttctgttacctgaaaggcttcttaaaacttcgttgtaaaaggacaatccataaattaattgattaattttgaacttgatacagttggaggaaagttcgaagttatcggatctcttagatatggcaatgctcatgtagaaatatatcttgagctttagggcgtttaggatgcgtgccatatagtttcacttgcttcagtgactgagtcaaggtataggccctacccataaatgaaaagacgctaaacgactcgtcctacagccctcagttatcgattcatgaacaacttctcttcctataagattgggagtaacttattgtggagtcattgtagacgggccctaatcaagacaagtcaatgccgcttacgacctaatttctattctgctgtctgcttaaacaatgcagactataatatgtctaaactcccctcccatatttcagaaaacttaactgaaaatcgcactatgaagctcaatcttaggagactcacttgtttactgtcgattttgtatatctctagtgtagccgaagctaaaccattggaggcagatgccaatgtcaccggaattgatcatataagcacccataactacagactattaaatgaaatggcacttttttgtcaagcctcctattgcaaaagcttagttcccatgagtgaactaaaattgggggataagtgtttcacttccttttgtcaaaagaaagaaaacaaagatattgaaattgcctttatttccgagcctgttgcgggcacgcctggtgctggatatattgcagtagatcatggacgccaatggatcattgttgtaatcagaggctcttcttcgctggaagattggattgctgattttgcattcgtaccaattccttggaaaccgtatgctgccactaagtcaggtgtaaagtttaagtgcaaaaattgcaaggtgcacaaaggttttaaaggaacttccgatcttctggagaaaagaatgtgtgaagcttcatctaccttgcatgaagaataccctgattataagtttatcgtaactgggcattcacttggtggggccattgcaaccttgattggggcagacttgaaaatgatgggaatgaatcccctggtattgagttatgctgggccaaaagttggaaatgaaaatactgccgtttacattgacaaccttttcaaaaacagcgccgctatcaaaaaattggattctggaggtgatatcacccaaggagattacatcagggttgttcacgttggggatttagtgccaaaggttccaccttcagaattcttctggcatgcgggtgctgagtattttattgacaagtacgacctcccgcatcccccttccagcctagtcttcaaggggaaatacaagtacatgcctttgatctctgacatagacaatataatcagaggaaacttcccatttgctgcccataatgagtactttcatgtcgtcaacaagtgtaacgcttaggtaagaaaacggttctaaagtgtctaagaaggattatataatcccaacgagggttgaagaatctcaattacaaccaatctagccaaactcatgcacagctggggccccgcccctttctcggactgaccggcataataaaacgactcataaacaatgtatccacatgtcctagcatgcccgtacaattcaatgtatttctgtgcaaaaaattagtttccggattttccctggccaatagaaagtacccccttttgctgacacaatatttataagccatttgttaccgaataatgctaatgggctgattttcaaatggcaagtaatcttttgatgaaattgtcagcaactacgatccaattagaggctctatgattgtcatctttgatgcaatcggatgcacaaactgtttccgtttgatcaggctcatatccccaaagtcaatcttaacataggatcatatttcaaccggccacaaagtactaaagatgtcctagcttcaattctatataaaaagagccatgagttcctgctatttaatagcataagttatcaaatcatgaccgctccagaaatctatcagattcaagacctcactgaggaccagaagactttcattaggaactcagttcctattttgaaggacgctggagaaactttgactgctaagttttatcagtacatgatttctaattatgatgaagtcaagccatactttaatgagacaaatcaaaaactgttgaaacagcccaggattttagcgtttgctctcctcaagtatgcagaaaacattgacgatttgagcccgctaactgctttcgttcaccagatcgttgtaaagcatgttggactgcagattaaagctgagcactacccaattgtcggtggatcgttgttgaagacaatggctgaactcttgggacctgagcttgctacacctgcgtttctcaaggcatgggcaaccgcttacggaaatcttgctcaaatcctgataaacgctgaatgggcagagttccagaagcagaagtggcatgatttcaaagagtttaaagtgaccaaaatcgaaaatgaatgtgacgatgtgaagtctgtttatttcactccagtagaaggagagatagcaaaacctttggatgggcaatacgtctgcatcagatggaaattacctggggaaaagtttgagaaatctagggagtactctctttcttccaggccaaacaacaatacctacagaatctctgtcaggttgttggaaaatggtaaaatttcgacatttgttcacaatcaactgaaggtgggagacataatcactgtagcaccacccgctggacaattgttatacgaagaatctcaaaaggatgctgttttttttatcggaggtattggtatcactccagtagtatcaatcatggaaactgcccttgaaaggggtcagagagttacattattttactccaatagaacctcaaagagtactgcctttagaggttggttgaaagaactaaagagtaaattcaatttgcaactgacagtgaaggaattcgtctctgaagaacaagttactgaaggtgtagaccaaatcaattctgctcaattacagagatcagacatccaaacggtgtcgccggagaatgaagtttatctggttggacctgttccatacatgcagtttgttagctctgagctcaacaaactgggagtccaaaatattcattccgagttctttggaccaactgtggttgcttgaacgagaaaacgatatttattatatagtgaattaatgcttacgatatgcagtgtaagtcactggatcccttctcttggtagctagttagttacttcgtacctttacatccaacatcttacaaaaatatttcgcggctacgagtatcattaaaccatcattttacgtggatcatccaactataatttcaccacgatgaacatcagacaacaactagttcaattgctcaacctagccatggttctgagtaccgcttttatgttttggaaggggctgggtctggttaccaacagtaactctcctatagttgtcgttctgtctggatctatggagcccgcttttcaacgaggtgatattctcttcttgtggaatagagacaaatatgttgatattggggatgtagtggtttacgaggttaaaggaaagccaattccaattgtccatagagtcctcagagaacacaaagttacgaataaagatcgtaaagtcagacaattacttctcaccaagggagacaacaaccctactgatgacctgtccttatatgcacacaaatcgaattacttggatagagatgaagatgttttgggcactgtcaaagcttatcttcccaaagtgggatacgtaacaattttgattacagagaataagtatgctaaattgggactattaggattaatggcgttgagcacgttattgactcgagaatgaatatgacgattattaaaaagatccatagccaaaagtattgattttctttttgggtcgtgaaacttcaggggtaattttccgttttttagattgcaactctttttccttctccacttggaacattccaaagagaatatttgagttcttatcagagacttgataatcgaggtcagcaatctttcttttgaatgattcaagatcagatatattttccatttccggctttattaataactgaatcaatatttgttgcagtccataattttcactatccagcaagtcccaaaatacatcaataggggaggatccatttcgacccaaaatttctttaaactctggtaagtctttgatttgctggatgtactcataatatgttaaatttgcattctgaatctcttttagtttcaaagaaattgcctttttaaacgaatctcttgcttgcctgtctttcctgtagttaagcttttgattgagtttgatagcttggtctaattgctttacatggaggtccatttcttgttcatagcagcccaactgctccatagatgaaagatgagggaacttttccatcaattgacctgatatatctttccattttgattcaatagttaagcttgattttaaatatgtcttcagatcttgcagttcgttagatttaagttcattagtttgtctttcgtgttcctctctgagactgctagtgtactcttcaaacaatcttcttttcaatttctcggatccaagagagtatataggctcgtcaatgattaatctggaacaggttttccaccttgtataatattttatctctgggtaattagataagactttgagaaatgtgtttttaaatgactgctctgcatcctgttgctctttaaagacttcctgctgtttggatacttgatatgactggtataggtcatttctcttcagggaatcctccacgttccaatatctggaatcttgaatgattaatgaaatagctttggtaaatggtaactttggatcaatattcctttcattaagcatggctataaagtcagtttctctttgttctggtgatcttgtttgtgtttcatctccgattaatgcagattgcactacgtaatcagatagatttatgtctttgaattttatctctccttcttcgccgtcgcccttgacctctgatgctaatgcttgcttcctgggatcctcccatacactctggccggttttctcattgtaatagtagctcttgccgtcatcagtggtatactctttccactcagaatcctcgtcagtttctccttttgggtcctcgtcgatattttcagcagtggcttcagggttctcccacgacgtttctccagtttcaggattgtagtaataagtatttccatcttgatccgtagcagactgccatttcattgtgtagtctgagggccagagtgaaatatagatgagtgatatgggatacctttgggtggtgaactacttaatagaaagacaaataggattaaaatacttgtatcatgaaaagatacaaagaaggtcaaggagctctatttacataaaaactgcgtatagatgatatttttttagctcaaaccatttcattaaagatccttcgtctctgggtgctaccaaaaggatgatcttctcagatttttcagtgtcgctactagtaatttcgctcctctggaacggatgcttgcgcaaagcgtcccccttctatccatcttttctcaaagggacctcgcctcgaaattactatttccatcaacaccaacacatcgtaaccaacccgaacgtatcggtgtccatccatagcccctaaaatggtaagtcggattcatttacaggtcagaataggaaacaattactaacagtcccatttcagtctcaaacgttgcgtccatatttaacagcagtgcgcttttctctgaacgctgctctctgcgttgagaacttcagttctcaaatagtagaaagacacaattatcccgaagtagaaaacaaaaagactaaggaaatcctgctgaatccgctagttatttccagaaacgaaaatgaacacgttctgattgaaccaagtatcaattccgttaggatatccatcaagattaaacagtctgatgagattgaacatattctagtagataaatttacccgatttttgaccaaaagagccgagaactttttgattcttagaagagctcctattaaaggatacgatattagtttcctattgaccaactaccataatgagattatgatgaagcacaagctggttgatttcatcatcgaattcatggaagatgttgacaaagagataagtgaaatgaagctttttttgaattctcgtgctcgtttcgttgcagaggcttacttatcagtgtttgactgaatgatagatagaattgacggatgcagtggatggttgcgattataatcgatgcgagggaagcatccaacttgtagagcctgcgagagtctagggaaaggaacaaaaggaaatcaaattagttgataaaacaaacaccgcaaaagtccgaccttgctactgacgcttatcccccatttttccttatctcctgtcatgtccctccactcatgctgacaatattatataattctctggtagtcaataaagattaacatgcacacgaccaattttttatactttcatttaattcaaaggataccaacctccagtagtgaaatcgacgcatttatcaagttaacttgtctcgttggttgttatagggaattttcctagcctattcatagagaaaatggcacaagaaagaacagacaagtcattaaaagaaaatggctcagctacggtcagttattctccatggactgctgctgctgtggacgatgactacagctctctgtatgagaatgacaaaccaagcaaagacaagctaccaagagaaccatcttctagacctcatagtgatcaaaatgaccgggatactcactctgtagatgactctacagcggagacttttcttcagcagcatctccaatcaatgatgcatagcgatccagataaaaagattcctccacctaatccttccagttctgtccccgtttatccagttccatatgcaatacctcccaaaatgtcttttgccatccaacaaggtatggtaccgcctcctggtttggttcagtatcctcaaaatgtcctcctacagcaaaagcctcgaccaaatgcaacccccgtcaacaataagaactcaagaaggcccaaagtgcagaaaccgaaatttaggccttgtgacgtttgtagaaggagaaagacaaaatgtgcaagagctgcaaataatttgaattgtcagcaatgtgaagctaagggcttaaaatgcacatatacagacaaccctaagcgcccacaagacatcccatccgatcaagcttcgaaaaggagtcgccaagaactcccacccaacatacctataagggatattcaaccagtgatcgactactctacgattcaaggacattctctgctgaagaagactttgagtcttcagtatccaagatccagtttttacatgggcccgacttcggtttatgatccacttctcctgagcaaaatgcggtttgacaacaatgatcagttacaagttaattctattactagcattcgaagagtggctaacaatgtccagtttctcttgaaagatgacttttcgcatgatctttatcagagagcccaactcgaagttgacaatatcgaaaaatttgtggctcctcatggacagacattgattgatctttactttagaatagttcatccttcgttccccattttgcataagaaggtcttcttggaaaagtatagtcgaacccatagagaatttagcgccccgctgctaggagccgtttacattctggccatcaattggtgggactatgatccaaatctctcattgcatccaaagcctaatgtcaaaggactgatgtcgctggctacgaggtcatttgatttggtcacagaaagacccaagttgtccacagttcaggcaggcctgctcttattacaatgtgatcccaccagttcaaaaaattgggtcttatgctcgcaggtggtagctttatcagaagagctcggccttggtttagactgttttaattggaaactccctaagtgggaaagaggacttcgtcgtcgactagcatgggcagtttttgttcaagagaaatggctagccttattggagagtcgacccactcatattgctctgggcacgaattggattataagtaacgtgatggatgatgattttcctgataagaactctgacgaggccctttctatggaaggctcaacggacactgagataggaaaacagatattcaagcagatgattaaattaacagaaattttgagcgacattctagacgcttttttcagttttcactctctacagacaatcacctcgattgagcaagttttgaccctagccaagcctttacaattgaggttacgggattggtatcatgcacttccgcaagacctacagatgtcgtccttgcaacaaagaaagctcaattctaatggttatttgcaattatcatacttcgctgcagaaataagtctccaccgaagaataatatcatgtctagactccggaatatcccatgaattggtcactgtttgcagaaatgctgccaaaactagactctcagctgccattgattttgtcaagcagttgcaacctgaacatatacattcattctggcattcctctgcaacatcaaattttgcactcatcggttcatttgcatctatgttatttgtcacggcacctacaaccgaagatgcaaattggtgcaaagatcaactatatgaatatagatggactctgctgataggatcaaaggcatctcgcagctatgcgatggccatggaaataatcgacaatataatgaacaatatcccagagttactgaaccactacaaaactccgcaaagtacgacttccaataatcgcacacctctttcggaaacacaaacaccagacaacaacttcggaggcaattcaggtagcaatagtaacggtgaaggcaacgatgcaagtaatatgaataatcaatcattcggaattccatatacacctattcctccatatgcattccaaggctacggccaaataccgcaacaaaacatggtaatgagagatccctggaattctgagcagtttacaccaccatcaccgagaaacaatcagaaattatcacctgccatttcgaacggttcatccaatgaaggtccaagtgtcgctgttggccacaactcacctcttcgtagcgtgaaaagtgaaccatcagaagcttctccccatggaggagccaattcagtagagtcataatttaattatagattataagaacttgttaagcttttttgttcgtacttcttgcgtgattgggttctgggtttgcacggactgagcaggtagctgtttttctgagtcagctggcctgcctttggtagccaagcttttaagtgcaagatcagtagcgtttgcatccgagcttgatgcttcttcaaaaacattcttcaaagtagtagagatgtcttcatactcaacttgatcctgtttcttgcctctttgctcatagtcgatgccatcgaagagcgattctttcaaccccaggttcttaccagccttattcaatgctaccaaactgtcatgtatatggtccaatttatctgtttcgataccttttagctcttcttttaaagtagttagtctctggattttcagttgataatgcttagcaattttgtctacacttttgtgatcttccattacgttgagcactatcgaactgagcgtgaccagtaaaagtccagtgtaccaagactgcctaaagttttgctttattttgtgcttgatagttccaaccgttgaaggtgctgctggtgagaccatagagtgaaatcttaccaacgatcggcgaaacatttcaaagggacaaagaatacctaacttgaaatctttcctttaagatatgcttaaagaaggtaatgtaaggaggcataaggaagcatatattcgtataactgaaataaagtgaatgatcgtgtgttactttgctctgattccgattaaactttactataatacaccgaaaacatccctccaataaatatacaatgctaataaaatacagtcagctctaaaatctgtgtggccatgagctttgaattttgaagttctattctttcaactctttcgaaactcgctcaacacaggatatatggcttcaaaagcttggtagatctcttctctcttcttggcacctgtcaatacaatcttgccgctcacaaagatcagcagcacaatcttaggtttcaccattctataaattagaccaggaaacaattcaggctcataagaactgaaatgtccatgtgaaaaggccaaaccttccaatctgataggaaacttaacatcacaagaacccacaatgttttgaattttaaaatcagtaaacttagcgttaaaccccagtttttgtatgatacgcgcgtattttctagatgctagcttagaatcatcctcggacttagcaccagtgacaaccatttttcctgatgcgaaaatcagggccgtcgtcttaggctctcttattctcatgataacagcagcaaaacgcttgggattgtattcagcgtttcttgcgtgtaaagcgatagttttcaaatctaaacgacaatcgagattaacagtagccacgatattctgtaacgtgggaacgatacctgagctgttagcgtcgtcgctgacaacaacatcttttatttctggttctatgtcttgtttgataatgtgctgttcagtctgagaaggatctgccttaatcatgtcgtcattattcatgggaaaggaaagggatccgctggatgtaaaagcctttgcctgagcggcagttgtaggcaatttgagggaatccattgtgtgactttgaagggagaaggaagagaaagagaatgcaatttaatgattctcaggcttatgcaattagttacccctaagaaaactcaaatgtagatgagaagggaaatcgcgctgcttatatagttttcttatttatatccgggtaatcattgctacgtcttgactgcatcttcataataggtgagtctaatagaattgagtgggaaattcagcttcctataacgttagttgatgttagagaaacccaatttgacgagcggaagtttttacggtagctttccatcactttttcctgtggttaactgactaacagtggaaagctatgcgataagtcaaggcgcgcacttcaattactgattataccccataaggaaatttttcacaaggtgctcacttaatactgcacttgaacaataggtggtctacacagtccccgaagcatagaaaaatatcatctatacaaagtaaatctctagggccctttagctggttaatgggcccaagtggctatcgaacactatccctcttctgcttgacttcttctcacttgcaagattagatatactggtgctcctaaccataacttttcgcgactcttccatctacgatactagtttggcactcatcacatcacattcttctagaagcagaaacatgtccactgaaaagttgtttgaggacttggatgaagattccctgatgcaggatgttgaagggggggtggaaggatccatgactattgaggaagagcccgaaccgaatgacgagaaagaggctcctcacatttctatgccttccctaccagaatacacaagaaaggacaagactttggaagaaatactagagatgatggaggacgaagaattcacgccaattattcccgatgcagttacagactattatcttgccaagaatggatttgaaacttcagatatcaaaatcaaaagaattttggctttggctacccaaaagtttatcagtgatattgcccaagatgcgtacgaatattcaagaatacgttcttccagtagtgtgtatactagtgccaatcctcaagcccgcgccaggcaattggtggccggacagcaacaacagcaacagcaacaaccgcagcagcagcagcaacaacaacctcaaacgggagcttcacagccagcgccgacagtaggtggtagtggagggggaggaggaggaggaggaggaacaagtacgggcactaacaacaaggtagtgctaacaatggatgatctacggtcggcactaggggaatatggaatcaacgtcaagcgacctaacttctacagatagtaagaattgcaataatatgtacattattaatacattattaagtagtgaaaaaaaaggaaaagaagccagtaagtaattcatttattaaagggagctagctccaaaaaataattaatcggctttgtcgcccataacttgcttgaccggttcagtgtcattgacgtaaagcttgtgttcttggatataccgaatcacactattcggcaacagatattgaacgctcattccacggcgtatgaatagccggactttcgtagagctaatatcgttgtaaatgagttgggtaataaccagaatgttcttgcggtgttcatacataatgtcgtgagaaaggaggaaacttcgaacatcggaccctgttcgttcgacaatcagacatccgtaacctccaaggatatgatgcaagtcttgatcagcccatacatttggttcacccattgattcaataagatcaccacccgccaggagcataatcttgcatggtttcctcactccagaggaagtgattacacctcctcttttaatattgatttcttcgttgaaatggtctaatacaagcgctgttcgtgtatactggggttgaagcgattcccaggcatctaccattaaccaggagctagttctttcgcatgctaattcacacatcctcacacgatgcgcagctgatgccaaaccttgtttcttgtagttatcactaacaggtgagtagtaaccgccaacaacttcaaactttgtgttttctctgatagcatcaattgccatctcaaacatccttaaatgcaggtaggtgatgggagagaaagatccacaagccactataaccaagggatatttaccagactctttcagcgtgctaaccagtctatgagttggaaacttataagtctcaagattcttggactggcgctgcactccgtgaggaacctcttccaagtcggcaatttgaaatgaatgaatgcgagggatattccccacgggctgtttctcatgtttggaattatgttggttcaaatgcagtttatcttcatcattcggtttgctgtctctattttcctgttttgggtcgctttcatcatcactggagctgttgagatctgttcttggtttagggatcttgtgatgcacaattttgttctgagagcctgcgcaatggttatctaatccggcagaccctgaactgggagaaatcggcaacgatttagacggatgtggttgtggagcatctattagttcacagtagtcctctaaaacatacggttggataggtttagatttgggtaccttgttgcccgctggtggtacgtagtttttgttcgcagaaggcgggacaaaattgggatcgtttgtggggtccattgaaggggttgtgccggtgaatactataaatggatttcttctaagcctgtccaattatgaggagtaaatatcacacagcaaagccttgaataatagacagtcttagcaagtcctttgaaggtgtttgtagaatggtaaaatctttctgggtgtatcttgaggggaggggggggtgtagcctcgcgggtagttccggtatggtaatcatgtgacaaaaaaccaggggtaggccgagtctcggaaaatttccgaggaagtgttcttggaaatgagggttacagaaagaggggtgtaactgttgatggtttgaaggagggagggggtgccggctatccgtaggacaataaaacggatttaaagttcaagtttcatctaatagatctctcaggatctttgtaggaactttttctggggtggcactgggtcgaacgatgtcgagagttgtcccgctccattttgcgagatttttcgggatgttgctacgatttggtgatatttggctttttgtatgacaggttgtgcaacgctcacccctaaatcagataaacccggcagattttcgttttgatcacaagacccaccacgacccaatgccgtcacactactagctgtcatagctgacgagagtctctgtaatcattgaacatggtaaaccattgtggtcaggttaatcgattgagatggtcgtcttttctttcccttgacgtcatagatgtaattaatatgtgagaagtagttttatggcaacctagagagtcacgaaggcacatgcacatatattttgtatgagctgaatttgttttcgggtctttcactccttggttggctttctcaagataaagagcaatccttgcatgaagaaacaaccgttcatcccagataagtaacgaacatcttccaaggcccctttgcttctgaggtaatttttttacgagggcaaggtagtcagatattgatagggatgtttacaaactacaaactggcatgaggaattaaagacgtagctagtgcgttgtgttttaagttcaaacataatgattcagtgccaactgaatgatgaaacaggaggattgctagttagttcttcaagggaacattccgagagcaaagatacatactaatgatggtgtcttttgaagcggagattgcatatagtagcgggttgattgtgttttggatatgattttgagtctcatttaagaaattaaagcactgtatgctaacctgaaaggaatatccgaagaggtctgtatttttgcaattattgagtaccatggcattttgaaatggtcaaatttattataagctagcgattttttgatggatatagttctcaattgattgaagattatcctggagaacgttcatttcacatttatagtgaaaatagtggctgatttgtatttctcttctcaacttgtataaaaacctgaaatgtatatcaaaatcttgctctgtatttgagtgggttctacatgtatcgacatactctcgatgtttggtgagtaatttaatgcgatcccccaatcgatggttcaaacttgtcatgagctggatttcttttggcctaacaggctgatggccctgagtataatccaaaatttctacgcctgcccattgtaaccggttcttctctagtaacatcttgttcaaatcttgagaagtgccatacttgtaagtattggcaatcaagagcccgtaaatgtcgctatcaaagaacccatataccttcaacgatgtgtgcttcatcattaagtccaggaactgccttgttaggtgatctggataacctttccctgtaaccaagatatactgatcttgtgcccaggaagattcgcataatcttttgaacacggcatccttctccaaaactattacgcatctgattgttggaggaatacggacgctaagtatttcaacgtcattggaaaaccaattgggagtcagttgagacttttcagatgaactcaactgatagcagcattcttttcccaccaagtttttatagatgatcgagattgacccaaatataagccctttctgtgaagggaatacacctagatcggagcctttaacccccagggagtcacatagttgctcgattaaggcgtcgatggtagcctggttacgaaacaaggcaacatctttgtaatacaagtctcgccttgttgtcacagtacctgaattcaaattatcaagtatcaagcgaaaaaggcgaacataacaggctgagatagaagggtcttagaatgaaaattctgaaagaaaaatgggggaaaaataccccacaaaaaggtatcacatactaaacttccagcactccttctttccaggaaagcgaattaccgttggtcgtgagggtctctttctaaacgtgactccctgtaacaatggcctagagaaaatcaattggacagatgaacagtctagcagagccatctcaacactggtaagaatgcattgcaatactttggagggatcaggaggtcggatgtctgattctatataaacagatcgggtcttcgtcattagataagattcttggtaaggatagcgcaatcaatgtctgcaaaattcgcaaggcttagccaaaacatcacgtggttgataactgacctttgacatgtcctttttcttcgcgggtgcactactcaatagctatttaatctacgtaggtcccttgccttcagatcacaaccatacccaattttagcacactatggctagcatatatttaaacaaaagatggattgtttctaatggttggtccaatagcaatgctagatgggccttctttgctttattcatcgtatttattattggttttcttttgctgatgtgccgaacaaatttgaggagaatgcgaagaggccagaaacctgtccgaggaactgcgtggttgactccaccctcttacggccagtcgcaacaacagtacaatacaggcggtattaatgattctgtacccgtctactcatcgcaggccagggcggaagacgcaggctattacgatgctgagggagtgtttcactacaatccccactacgtccctgccaaaccaatggcaacagcagcaacagggtcaacgagcacccaaacgtatccccctcaagcataccatacaccaggggcttatgatgactttgaatcgactccaaatcgaccgacgcaaacgccaagtgatgatgattttggctatacacgtccatctcatccacctcctgtgtcatcaaatctgaataccccaagcgatgcagatagaatatatgacactactggtgagggtacttcctcttcaaacatagacgatgagcttcctgggtaccagccaccaagtagtcctccgcctgctgccagaaagaattagattgttcattgattgtcctttgttttcggtggttttattcttatacgaacatttttatttctacttgctgggtgtttgctactgttgtttctgtattaaaatgagatgcccagtttcatattctgctatttattgttacttttccactgattactgcttgtatcttttcaacaaatttgattaatggctgcagatcatggaatagcaactcaaaaacttagttgaatttccaattttttacgaacattcatattcacagagagctgctcatggttttgtcacccatcacagtactgctaaccttggccgcattcattggtattgctttaatagcttgtctggtactaagagttctcgagatactacgcagcaaacagtcccagaaggaagcatgcaacgaggacgctaatgatccccgacccctgtatattaattcaagagaaattgaactagtcaatcaggatcctcaagtggctccactacaacacgcagggattttcatccctgatcaggcatactgccctgacccatgtcgaggttttgatattccagaaaacttcggttccagtagaacctcggtcaagtcagaggatatggatagagtttaagtatacttatattttgtaatttataggcaagctcctatgtttttagttaggttggcctggttattgtatgcggcatctatatctttccctttgggaatgctactgagggtttcgtaatgagaggagtcttgtggacgactgttgcgtcttctatgctttgtcggagatgttttcttttctagatgcgtagacgacatggagctggtagctacgctacttccattccgtgcgtgagcccctgagatccttccttggccattggttgacatagttcttggatttattcctcttattgtcaattctgagacagtcgttgaaagcttctctattttccctctttggtatgttgtctttttgtggtattcaaatagtcggtcaatcaacccagacaaggatgattccacaaattgctcaatttcggaagcacgtttctgttgttctaacacaaaagattcatcaatctcgtcattcttgtcaaagggtgagtagttcttcaatttctcccatgttggagttatagactcgatgtcctctgaggaaatcattctggttagctgagcaaataatctatcacagatatcgtcgtatgcagatttcagaaacttcccataagtgccatttcttatagcaattttacgaaacttatctctaacagtgttgccctctccaaggatgacattatcatgaatattttttctttcattgagttttgatttgaaatgatcaactttcttcatcatctcagaaacctgatctctctgaacatcaattagggtatctttttgtttcagttgattcttgtatttttcttcaagctcagcgttcagctttcttgactcttttttttctgattttaacctatggttttccgcctccaaaactgaaattctttgttgatatctcccttcagtctgaattatttcttcctggtaagattggagttcgctgctaatcagagctttactggagcgaagcctttcaacttcttctttgagagtcgcctgttggctaagaagcttaatattctgttcagaaatcttgaacttatcctcttgtagatttccgtactcaatttctaagtcgtgatgcaagttttgggtaaacttcaacttctcgtttatgagctccattccatgcgaattagacaaatttgccctctgaaggtcctctaattggccttgtctttcttgtagttgcaaacttaagcttaaaatgtccttcttgtgaagctcaatttgagtttcaagctcgcactttgtcagactcaatttctccaacttagaatctttgattgtaagctcgttgtgagcagacgactctgactgggtggttgtagtaagtacattcgtaatctctgtaagcaagtcatccagcgcttgtccttcagtattgaaggaaggatgcaagttcctcactccctcaacaaatgaactatatcgtcggattaactccttctctgtagacgactgggaatgctgtttgtctaatttctctttgaaatcgttattggcggcgtcaaagcttctacgtatttcatagatttctctctcatgtcgtagtttcattgattttatcattgattctttttgacttacttcttcttctttggtctctagtttttctaggatctgtcggatcttgccgttcgtcccatcattgtccagaagaagttgacgaattttttcagacgctttaattgcctttgtttcaagcaaatgtagaaattgttcagtatctttctcttgaagaacttcttgtgaatggttagcatcttcaggatccaggtaaaagagaattttttgtagctgatctgaaaacgagtctaataccgactgagatttgcaatcattagagaagcccgattcttgagatgtgttggacgccaactggttcttaatagaaacatctaggatcctttcgatttcaatttggtctttagacttgaattcattctcgccttttatttcttttatttcgtttgattctagctcatttctttcattctctttttcgagttcattttcagcatctatctgaacgacttgattcacgccgtcaaaagtaacatgacgtcgcaaactctttccctcaagcacattgcttctttttaaagtttcaggcaatgactcggcacctccatctttgttccccaccttcaatattggagggggatatgcttctataggtttgtctttgaatggatcaagcgtttcaattgatgtagcatctaagctagtatttatatctttgaagtaatcggtaagcacaatatgttccgaagccctgtaggtgtcagaagaagtggaagagctagagcttagaaccatctcaatagaagatcctaaaaagtcggcaacccaaggtagataaatggaaccctaaaatattcaacgggtagactacaatcactatcaatctgaagaggaaatctctggtgcccagtcttgttctagtttccaaatttaaggtagactcttgaggagaatctttagacattattttgtgacaacaagggtcaatatctgggagaagagcatctcgtctttttgtaccctgaagaattgtagggcgacaaaggctaccacaagacatatgttgtgacagatgggcgtggaagattaaagaaatcttcagatcacgtgacgaattttagagtaaagtatcttatccaaacttctatcttcacctttgcatcctacaaaccagagtgcaaacctcccccactgtcccttctcgtcataattgcagatggctaccaaaaatggcaggattcgatcctcggtggcaaatatcgaacaacagagaagacaagtactcaagccacttctcgacaatccattcacacagacagcatggccagaagtgggtcaagatactttaaaagggattactgacatcttgattcaaattttgcgatcagtcagtaagtataacaagttgagcggcaagaatctggaagcaaccattcacaagccgagtgtagtggataaaatgactattggattcaactccaccaccaaaagtttggagtataaagtgcaaaagggaaaaaaagaacgtaaactctcctttgataactgtaagaaaattcaactgaatagaaagacagtgagggacatttcctatgtttttgtctgcaaggatgacatcaaaccagatattttaactcagcattttccaagtctttgtctcatggcatcaagtaccgatgatgagataaagctggtagcccttcccaaaggctctgtagcacaattatctgaagcactgaacgttccaaacacaacaattttagggtttcccaggaaatttgaggagaacgacttattgagcacactcatggaaaatattgagccaccgaaagtcccctggctatctgcaatgccaaggtatgaacctctgtcggtaggctttctgcagacaacacagccaatatcacgaaaggttagccaaaaggatcacaacaacatcaggaaaagagaagatgaccaaggtggggtcaagaatcaaaaaaggacaaaaacgtaatgtagagaaacctatttaatgactcggcgtaaaagtccagagactgcactatggtaacatctagttccgagtttcataaaaggtaaagcaacactattcgggtataaaattggatgtgtttcgccattttgtccttttgatttggaaggcgtctctagcaatagttgtggtttctttttggtggttttccaggtcattatcccctgatgataatcgttgaggctgggaggagtacgacgagtgatttttgaaaggtacttgacatattcataggaacacgatggaattgaatctgtaaatacattctgaaatttatattcttcagacgcatcttcatggtataggtatttattccagtataacagctgctttgctcgcgtgagtgcgacatagatcagtctcttggtttcttcagatctgaacgtggaaacctgagttgcacccagcagaaatacgacggggaactctaatcctttcgccccatgtattgtactgaaattgatagcatcttctgtgggttgcacaatttcatcagcaaaatgggcgatgaaatactgtaccagtgtttcattcggtgaccggagtttacttgccatatgaaagccaacccttatactttcaagttgtttaaaataaaagctgtcaggtttttgtgaccaattggggttggatttgatagcctgaagaagaccgtacttagatgcaaactctaaggttatcttgaaaatttcgtccgggtcatcaaaatattgaaaaaatcgatctctaacagtgttcaaatcctcaacaaagctgtcaatcactggtctgactccttttaggagatgaaatattggcgaacctgaagacattgctttgaggactaaggagctcagagatacatggcccacacctggaatgatagataggcaggaaatcaaggggtaatctgcgccaggatcattgattactctgagaaaattgataaaatggtaaagctcattgttagtccattcaggagaagaccccagtttctgggtcttgataccttgcttctcaaatacactttgggcataatttatatcatcatttttgaaagaaaggatagcaaaatcggaaggtttcaaaactcctccgcactgatggactaaccgagatatttcttccaaaatgaaatcaacttcctgagcaatgtctgtaaaatatttctttgtaggtttaggcagataattcggagcaggagactctacaggtgtaagcggttttttgaacatggagaatagctgtgatgattcgattatgggaagagacattctgaaagtggcagtcaaattaatggtttcaatcttactatagttgtgtggtaatattttgtctagcccgttcagcacataaggtgttgatcctaaaaacgaataaatactctgatctggatcaccggcaactgtgagatgacaatcagaagctaaaacggccaccaattgaactaattcagggtacatatcctgaaattcatcgactattaacacccgatgattgagtttttgagagttttcacgtaatagtaatgtacattgacttatgatagatgatgaagttaacacattagtgttgtgtaagaacttaactaactgttgtactttcaagttggaggaggaagtggaggaggttttctgggaactagacatcctgttgatcatttgctgctctaaaagctttgtgatctgatcttttctctttaaaaatggaacattgaccaatttgcttatcatctgtgttcctccaaatcccagcaactcgtactgattgggtatcagatcatttagcacattcatagcaaaggaatgaaatgtctgtatatttacctgctgtgctagctcagtgcccactaaatcaatcaatcgtgaccttagagacaaaactgccctattggtgagcgataggacaagaatttggcatggatccacctcactgttcaacaggtggactatgcgagcaattaatgtgtgagtcttaccgcatccaggcccagctacgatctttagtgccgttaggggttcatgtgagtaagtaatggatctaaactgatcgtctgttattttcaactctaacgaatcggtactatcttcattttccatgcttcgtgtttgagaagaagggccctcttaacaagacgtgattattatggagcgctttttttgaggtgacagttgccgacattcaacatccataatattgaggttcagaactgagagcaattgccttgaaaaaatgtattcacaaaacaataaacagtacgttactagctctattggtttttggctacatggattgccccgaatatgtgttgctaaggctgatctgctaggcctactgctctttcggccgattattcttttgaaagcttaaatcgaataatctgacccgcgatcgcatacttatctccatgatttaatctctcaaccatctaagaatacatcgttcccctttattgccttctctatacggtaattgatcagttctccagtatgttcagattgccatttcaaaggcaagccactctaagtgacgatgaggctgccgataaactgatgcatgaggcatacaattttgagactgcactcaaggccatggattacgtgttggatgataggacttcaatcgggatcgacttgctgtcgaaccataaggaaattgccatccagaaactagccctgggggtgatccaatttttagaggctacgctaggttttgaaccggaaactatgaaaaaggctaacgagactttgattgaggcagagtcaatgtgttggaaagagaaacagaacaatgaaaagtggaacctgaagacaagctctatctatccaccaggaacagagtatgccgtgacatatgctgaagcaaatcttttgaatgcgctcttaatgctgcttagtgaaagcgctattgaaagtgttaaagccctctacaaactgcgccgagcttatcacactttggatgaaattactcgcagtactgaaaagctaactggtgtttctattgaacaggatctggtctacctttctgcaagtgccaatggatccacttcgagtctgagttctgctccttccgagaaaaccacagcttccggcttcgctgaagttcatctcccattgaaccctcagcaaaagaaagacgagaagctcattaagagatacgaaaagatctacaacatgaaacttaagcgcattgaaggctctcacatcggaaactcccctgccaaagagagacttcgaaacgatttagggtataaggaatccggtaacaccacgcctgagttagaccgtgaacagacgcagcagaatcacgatcattcagtaattgatgagttcattcattctggtgttaacctatgctttggaatcctacaagtggtactatctttggttcctccaactattggcaaagttttatcagtagttggattcaaaggatcaagggaaatggggttaaaaatgttatggaaggccagtgatcaaagaaacattcatggtggtattggattattagcattgttagttttctacgatggtcctttccagtttacagatgttgattttgacgtccctactcttaccgagaaggttgataccccagagagtcccaatgttggtcgatccttaagcttacgaaaaatgaacacggaaactagggcagcaataggagcaggccaacccacactattacatccaggaaaaaagctttctaccgcgttgttgaaagcaagggctctattccccaatagtggtttatggctactacaggaaggcagaatgctggcttccgctggtcgattggaagaagcggttgatcttatggatgctttggataagaagatagaaatgaaacaggttgaagcattattgatttttgacagagcgatgatcctttgttttcttcatcgatatgaacgagctgcaaaagattttatcaaactagtggacataaatgcttggtctcatggactttactattattttgcgggagcatgctacttggaagcttatcgtatgtgtgagaccaaaaacatacccaaaaatggtaaagatcaagttaatccttcgaaacaggagtggtacaaagaacaggctagcaagtatttattagaagctccagaacttgttggaagaaggaagtttatggcaaagactatgccctttgatagatttttgattaggaaggttaaaggtattaaagaggcttctgccaaatatggaaccagtagtgttgactctgttggtacttctttaattcatgaactcaattacttttggaatggttacaatagaatgcctccagagcatttggaattagccctgaaaatgctgggatattcagccaagaacaattcgccgttttcttccaatctcggaagaactcttccggaatctaaagaagaatctatgattagatataccttgcaaagcattacactgaggagattgggtcgaataaatgaaggtgagaaattgttagacgttgtcattggcaatattactggatcggatgggaaactgcttaaactgcatcatgatccatggctataccccgcttccctctacgaaaaggccctctttgtttggaagagggaaagtaccggtgggctggctcaaagtcgaaagtggttgaaacaggcagaagactacagcgatgactacgagctgagtacccgtataggaatgaagatcaaatcggcaattgaccgtttagaggggctttagaatgactcgagaacggaaggaagatttcaagcttaacctcggtatcaaattcactaagttctgggtcttcgaccttcattagatcatttcacgggtctggatgatgaaattcgagaaaaaccgcctgcaaattactaatcgtgtggcagagcagccttgcatataaatactacagttactccgatgacttcctcgtttccagtacagtgcagtcaattgattacgagttttgattaaaatactaaaatggttcaagtaggtgacaaattcccaacggatgtggcattaacgtatattccatggactcctgaaaattctggagtcttagcttgtgctattccaatcccatacgacttatcgaagaaattgccaggtaggaccgtagtaattgtttctgccccaggtgcatttacccctacttgtacggctaatcacattcctgttttcattgagaaaatcgacgaattcaaaaagaaaggcgtagacgatgtggtcgttattaccactgacactccttttgccaatgctgcttggggtaaagccttaggtgccaaagacgagatcatctttgcaaatgaccccttggccgctctgtcgaaagagttgggctatctaaagagcgaggtacctgcttcttttgggattcgtggtgccagatatgccgtcgttgtcaaggacggtgttgtttcttattttggtgttgaaacaagctcaggcgtgactgtcagtggtgctgatgcggttttggaagctctatagattattcaggaccttcatagtaaaagatacgacatttgatttttcggtaacatctgacatcgcttgtgcagagagctttatcaatctgtcacttctgagattcttagtcatatttcagtcgaagtctaatatttctaattatctcttgatggccacctcagactactatgactctgaagaggaactagatctttcggaggacgaccttgaatttgatctgcaggacctgcacatcacttcccaagactctgaaatcgaattcctcttcaagtccctaacctcggatgtactgtggatttctatcgttgaaaaggctgatcatgttgcagcattcatcggaatgacaagagacgaatgtttggtgttgctacaacattatgactggagagaggataaagtgttagatgatttcctatctttgggagatgaaataaaagtttccaaagggcttgccttgagtagcaagctaaggcactctctgcctttgcattccttatccagaatttgtgcaatctgttgtgagcaagttgatcagatgtttcatttggaacaatgctcccatgagtattgcgtcaagtgttatacccgatatctaagtgataagttgcggcaacaggacagcttggtactttgcatggaacccagttgctccatctccgtgagtctacaagatctgaaggctttagattccaactttcctgggaaagatcacaaacctctctacgacatcatgatttcgaacatagccaaaaattacgtagagtcaaatccaaagctaaaatggtgtccagctcccgactgcacaggtattgttcagtttgatgggttcagcacttacgaaattggaactctcaaggaataccttgattcccataacctccccatcgttacctgtccgtatagccattcattttgttttgcctgttcctacgaagatcatgatcctatcccatgcaacattgccaagaactggataaggaaatctaaagatgattcagaaacagccaattggatcgatatcaacaccaagcagtgtcccaaatgcgatgctgtaatagagaaaaacggaggttgtaaccacatgacgtgcaagaaatgtgcctaccaattttgctggatatgtctacaagattggcccctgcatggtactgcgtattacaattgctctagatacgatgcttccgcaataaaagagatgcatcagaaacagcaaaccaccaaacaatccttaaaacgatatttgcattattacaaattttatatctcgcatgagctctcggctcatcaagataatgatctctttcggagtatagaatccagagtacaagaaatgcagcaagacctgggtatttcttggatagattgccagttttaccgcacagctatgaagctgctgattaagtccaggaaagtgttaaagtggtcttatgctttgctgtattattgtgaggttaacaactacgtgtacattgtggaaacgaatcaaagctttctgagtaacagcatcgaagatttgtctcatttgttccaattgactgatcctaaatgcattgttcgtgagaggctacaattcatcaacctatccaatagcatgaagaaaagagaggcagcgttagttgaaattatacatgaagggctgaaaaatcagcatttaaaagtaacttgataatagtatatattgtccacataatgacctacaacaaacttacttcgttttccaggacaccaactagtacctgcaactctagcttctttctagcttccacaatccaatcttcagagagctttctagaccagcctttgagactactaacttcttccaaagcgtcatctaatctgttttttaacaaattatcatgcactctggaaatgacggattcgatgtcatttccagaggttggggtgccagatttgcccaacagaaagaaactaaacagcttggaggataaatggccaagaataccggcattaggaggaagcaaggaagcagatctcaactccggtgtcaaaagatcccacctggcaagcagctgcgcctgagataacactccattggatagagctttatcattaggtaagttcaacaaaacagagctgattaactcgttattgaggtccttgctataagtcttaaacttgttcacctcgttgattaatgtctttgcatcaacgccatcgttggatgaaattagcaggcggttgattttggaaactgttttcttcaaattggttaacttctcggcatttgatatgttgtcgaaaagcttgatctgtacattctctagctcctctactcttttagccagtgcatccaagtttttaagcttgccatttctctcgttgtcaattttatcactaatgatcgactcgaactccgaaagggtattaattctagcctgtactataatgttttcggcttccaagagaatacggcgctgagcagtgtcaagctctttggccaaaatttggtcatgcttgagctcgatctgtctttttgtctcttgaagatcagaaatgtacttgtcagtaagtgccaactctttattctgatattttgtcttcagttcatcgtccagttttgctagtgcctcttccacagcagtgtttcggtcggtcacaaaggagttatactttgagcccaattccttgatagaactctttaattgctcaacttggggtaatagatcaacagtgttaacttgagttctgatagtatcaattagatggttcaagtgttcaacactagattgcaaaacttcgtctttgaattccaaatcaatagaaggcaagttaagattgctgtaaatagtcttgctaagactgactgactcgtcagcagatcccctggtgacatttttgatgtgttctacatcttctactttagcagactgaacacctcgctttgggatcaaaacagtcttatcgaagttctgaagcttttgcttggtgctactgaaagatagctcctctggatgattcacgtaatattcggtgaagtccaacagagcctcacccagcgggacatgttctatgaaagcatcctgaacaatatcgtttttcaacgacacagcgacacctccggcataaaacacaccagtcaaaagacccaatcggaacaagaactttctcaaaggttttgactttttcacagttgggttggtggactggaatctaacacccctgaaggtgattccggaagctttggttccaattgtacgcaacatgtttacctaagagggaatcctgggtgtggttttttggaaggttttattggcctctacgtgaaccgcgaattgtcgaactatctgagaggatgaggtggtgagagaggaaactaggagaaggaaaaagggcaaggagttagcgttgatagaggggaataaaggccatattgttaatacctatcggctcatataccgtaagttgtagtaaaactacctattcttggctggtgacaagattgcagcacaatttattactatttacattacattcatttcttaaagtaaacttttcaaacattgtgtctgtggtctttgtgcacgtggaagggggaccatattcctcttacactttcgttcaacgactctacgttttgctttgggttcttcaatttgcggcctgaagagttgatcacttttttcagcgcattttcgacattgtcgacattcaaattacggacacagattggctttatattgttattctcagaataatgacccttcaccacaggatggcctctcttcttaatcacattaaactctatttgtgggtgtgaagaggcaaatttcgaaagtctattggagatgaagtctcgcattccttgtgaggaaccaccccagttacagtattgcagctcgattcttttgcatggaagaacaaagataccaacaccgtttcttgcaatagaaacctttggtatagctctgattggcattccagtggtatgatttagggagagaggaatgtttgaacgagtaaacgaagttttttggtctaatttcgcctggaaagtttgttcgagggttactggcctagagggagattctgaaaggaggcttcgcggcactggatatctaaagcaaagctatttttccccctaggcgaacacaggataaatgaacatgccaaataacctcatggtcagggctgtgagtttgctcggtagacccttgctaggaagaagctttcacacttcctcctcattacttcatatgggggaagccaaatcgttcaaacctcagaatttagggaagaatctggccaatttcgacatacttggattatcagataagccatcaaacaacattgaaatgatatccaaagatagtataatatttaccaatttgacactgatcaaatctccaaccaaggataagagaatagtcggagctcttcttttaaacaacgaagtctatcagatagatctaactgacagatacgagattcacaacaaattcatcatggacttggatgaaagcatcctaaaggtattttctataatatatccaaaaccagagctagttgttattggaatgggagggaaaccaagaatgctgcaccaaaacaataaggaatatctcaataaactgggtatccagtatgaagtcagcgatacgaagaattcagcattaaactacgatcttcttgctactgaaaggggagtgacccaaatagcaggacttattcttcctcctaacttatgaggacttatttatttgtaaatagacaggcaatagggttaagttgcagagttgaaaactgaagcttcatgtaagagtgagagtcgttcttaatatgactgatacccacgtaaatcactccctagaacgactaagtagccgccaagtgacagttgtatcagccacatgatattctcttagatttaacggttgaattatctcatcttgtggatcccctattttccttccaatccctgcttcgaggcttctggtggagtccttataggatcaaacgcgacagttttttgtccttctcatccaccgacctaaccaaataatggcaacagcaccacaggtctacggagctgacgaaatcaatgccgttgttctggatgcttcctcctatagaactaaaataggctatggatcattggactgccccattttgaatcttccctcttactatggacatcaaacaaaagatggctccgagaagttcatatttgaagaaaactccatgttaataccaaggcctgattatgaaattaaaaagatcatgaaagatgggattatagatgactttgaaggcgctgttaagcaatataactatatgtttgatgtattgaagttgaagccctctgagcaacccatcctggtgatagaatcgactcaaaatgaatacgaaaagaaaacggctctgttgaaacagctactcaaagaaaacaagtttgttgccaccttcttgatcaagaatccaacgtgtgtttcatttgcacacggaaggcctaactgtttggtggttgatttggggcatgatctcgttaccataacacctatcttggatggaatctccttaagaaaacaagttttgggaactcattacgccggtgcctttcttagtcaacaactgagacagcttttgaatcacaaaggtgttgaggtagtgcctgtttacaaagtgaagagtaaggttcccacttatttcccagatgaggcaaagttcgaagaacgcaagtacgactttgatatatctgaatcctttgaaaacttccataaattgcgaatactacgcgagatgaaagagactctattgcaggctctaccggatagtgagacggaaaaactgaaggagcaggaaactgaggaggatactcgttactttgagtttccaaatggattaaacgtcccatttacaaaatacgaacgtgtgaggttggcgaactcgctgttcaatccgtcagagccatacacaggcgaatctggccccaatatcgtagttgaaggattttcagttgaaactggaaaaatcatcaatgaagacacaattacttccagagaatacgtgcctcttagaagatctaagaaaacagattcgtccagcggacggcgctctaaagatgaacctacggatgataagccccgtggtttgacttctttggtaaatcaggctctaaaccacctagacgtagacttgaagccacagttagccaacaacataatcctcacaggagcaacatccctgattccgggtgttgcagaacgtctaaaccaagaacttacggcgatgaacccaggattgaaggtacgcattcatagcagcgcaaacgtcattgaaagaacatgttccgcctggattggagggtcaattttatccagcttgggaacattccaccaactttgggttagtgagaatgaatatgacgaggttggcgccaaaaagctgatcatggaccggtttagatgaaacaagttaataaaactatgtacaaaaatacaactttaggcctatttgggcaaattctttagcagttttccagacagaatcacaccataagaggccaatccgatagcggtaaccaaattgaagagtaaagacaatccgtggcttctaccaaattctttggtgagctttttgtaatcttcattctcttcgaagccttcacctaaggtttgctgtaaggataacctcttggacttcacattgtgggtccatggcaacaaccagaagtaattggccaaaccacccaaagaggatagtcccaaggtcaccaaagcagctgtggacagggcaaatggggcagttagtccaataataactggtgagatcgcctgtcccagaaaatagctggggaacaaacggttctgaagctttccaaattggtcctttggcaaaactttgaacgcaacgggagacgaaacgtaagaatgaaagaccgtggctccgaatgagaaggagtaggtcaataaatggtagggagcagtagtaaggaagatggacattgtgggtttatgtggtaggaagtatcggaattgagatctaagaaaaagggtttcgcattctacgcatcggacgatcgtaacatcatctgataatcaatcatcttacataatttcatcgtttgaatacttgtttctatgatattccctatttgtatacgtgctgtggagcctgttcatacggttgatagaccatcatcggctgcttctctgcggaatcggtgtacgacctactacgcttcctagtagatccacagcagattgaaaagatccaaaatactaaggctatcaggtttaatgcaaccgcaagccagtagaagaccaaaaagtttctagaaagacctgctctgactccatactcaccgaggttatcattgaaaatagtttgcacaattcggtacatcccagtcgcaccaccagcaccaatgataagacttacgaaggacaatatacttacaacagtggtggcacaagaccatcccttgctgaagaaagctccaatggagaagagaacctgtatgaatgtaagcacaataccgattatggtgcaaataaagatcatcttggatactgctcttattgtgtcctcgtagtcgaccaaatcctgaggaagagagatgtcaacgttgtctactccaagaatgtccaggtatgagttcacttgatttagtgatgccgaggtattcagcacatcctgtatgaaactttcgggatcaaaaacgtacattgcctttggacttgaacaagcggtgaaatcaacattgtccagaccaagaatttcatctctgtcagtttgagcatcagaggaagctgtaccctcgcagtatccccacataccaagagtgtagacatctgacaaacccaattgttgaggagagatgtctatattggcggcagcagggatcagagccgaaattgatatattggaggcatcaatttccaaaaggtaaatagacgtcaaaaactcgttatttttggttgatccgatacaggagaaaattgcaaataaacatgcgacaaccgacagtaaggctggtattatgaccagacaaaatctaaagcaacccatcttgattaatatgagacgttgaagttgctgatatattaagcggatctacgtttcctttaatagtgaatacatcgagatcatcaacctatttttagttcgcgaatttttcatctgcagggctggtttctggacttgatgcataggatcatgaaaatacacagggctgagctcttattggtggctgtgtgaccaaagctagagatgcacagaacgtggaatatgtatttttggacgcggatgatcgatgccctgggatgtgccaggcagtgataactcagattttttgtttttctgtcgctctagaaggttgctcctgctctgctctggcggtgcagttcatgttgctggagagtgctgcaattgattgctattgagctcttggaccctaactttatatggaatatagggaatttttagatgcatattctattgttagcgactaacgagtgacgtgaatttggcgccaagtctgtggtgtattgctgttgaataaggaggtattaggtaggaagggaaaaactagttgcaaaaagtatggtccctagcaggatcgaactgctgatccccgcgttattagcacgatgccttgaccaactgggccaagggaccattacgtttttagttttgtaagtagtagtatagaaagtttaagttgttttgtcctggggcatcacaactagggtcagataatttgaataccaacaccattgatcggcagtggaaagagtctctagaagagtgtagttacctaatcaccaattatgctcggataaatctgtgtcaacattactaccaacctacttacttcggaaaacgctagtaataagtcgctgcttgtgtcccaaccacagagcatgcttcgtatggtccactaaatcacctttgtcacttcttggatgaatcagaacacttagatttccatggttgacttgataaaaagagacgatacctgcaaataattcaggcttcttaaaatcaatctcccacatacaaattgggtgaggcccaattggtgtctcccaaaacttatgaactctgatatcaccagcttcaatctcgtccttgaattcctcttttaccttttctctcaattgataagcaaattccttctcttcactgacattctggttatagtaagtatgaacgtcataggagacaatgttcccataaaattcgggtttagtcatgtcagctcagtcagacctcagtttaccaattgggtcagagaatttcacacaagtaatgatcagtcttttaatagatctgatgccctactccgataattcgaccacaccacctgcgtggttcctgattcataagctcttagtaatattgctgacataatgtgaaattgtccgtgcatcaaatctccatctcccgttacccgctcttattaagtcaccagacatgttctgaaagatacgcacgtatttcggtacatctcgtcacagctaaatcatcagcgacggggaagggcattctttgatgggcgaaccaacaaaacaaaatgaaaaacacgcccgcagataagcaaccactttttgaccaccccaggcagtaaaaattggaaaatttccccattcaactgccgctttccttccaagtccccactgtagcctctcagcatctctcgctcgatgccaattgtaggtagaattccgtttacactcctctacggcttcgccatcaccgcggcctgccttccctatcatgtcttatcaaacttatcaaagtgataacgataaaactttcatctcgctgttatctcacttttctcgatttttcagtgtaaattgtcaaaaggaaaattttttccaaccttatctctttccaacaagctggagcatcgaacgacccaagaaaagatgatggacactgtagacactatgcctgctaatgacctggcccacgatccgatccatcctaatgcaaagaccacaatcacaacgaatactaatgatggaacgtcgacttcgaaaacgaatatctcctctcccgtgtgccggaattgtaaaactcagaccactcctttatggcgcagagatgagacgggacaagttctttgcaatgcttgcggcctgttcttgaaactccatggcagaccaagacccatctctctgaagactgatgtgatcaagtccagaaacagagtgaagcacaatcatagtggcagcaacaacaacaataacagtagtagcaacaacaacagtaataataatagtggcagcagtagcaacagcacaagctccaatgtcgacacagaggatgatttgaaagacaagaagttcagttcaaaagctttcaagattaagaaggaaaaggacaaggatagagataccatcgccaagtccgctagtgccaacaattctccaggtttaataccacttctccctagagataatgctggttgccagccaaatccaacctcctctaatagtggaaacttgatgaaatttcaacttctgtaccagccgatgagtcgtccaaatagcactcctacgcatttcgccccgaacctgaatgctgtcacttctccattattattgacaaccacatcctcagaaagatcttccttagggaagaataataacggcctggcgttggtaaacgctgctgccggtgccctggagacgatgtccaacgaatccaacgataatgataagaaaatcccaaagatgaaattagacgatgatgaaaccaaactgaaagaatctcaatcaaatacgaccactccagcatccctcctgaaacgacaattcaccccatccatagacctccccagcatctcggctaactccaaattgaattctcctacttttggaccacagttctctttaagtgcctattccagtacgaattccagtggaaatgggactggaaatggtaatggaagtgcgttcagtagcgccatggagaagtcaagtagtatcccttcgtttaactcactcaaaccactcatgaataactctaacaatcattcccaatcaaataatgtcccatcttccctttcacgttcttccacgggtagccatacatcagatgaccctgtggagttgagaacaaggatatcagagttggagttggtaaatgatttgtaccgtacccggatccaagagctggaagctatggaaagcgctgctagacagagggaacaattattgaccaaacgtttgaatgagttgaaggggttaccctcagaaggaggagtgattgataatgagaccaagagagtaaagcttgaaaatggctatgtaaagaagtgattaagactaatagatgatgaaacgtactggatgataattagtgcaactgtagaccgtagattgtgctaggcgatggaatttttcgctcgcatattttcccgtcggcctcccaggatttacctcttttcgctatcaatctcaatcttcaatctccaaacatattgccttccttaatacatcgattcaaaggcccctaccaaactcgtaatgtctgggttagaaagtaagtgccctttttttcggcagtaaatagtgtcactatggatgctgtattttcgaaaaatctcccattaatgagagattactaacaacatagaatcattatttcaactaaaggtatgcatgcattcaggaaccactcctgattcaattacgaaacctaactaacatatctagttcacatcgaaacagcttaataaacaggcgttgaaggcaggaaaggaagaaaaagccgaaaaagccaaggtcaaaaaagcactaactcaaggtaatagtgatattgcacaactgtacgctcaaaatgctattagaaaggcaaacgagagagtaaaccttttgaaactagctggccgtattgatgccgttgcatctagagtgcaaacagccgtgacaatgagaaatgtcacgggaagcatggctggggtgattaggggaatggataaagctcttcaaacgatgaacttggagagaatatcgctggtaatggacaaatttgagaaccagtttgaagaaatggactcatctgccaactactatgaaaatgtcactaatgatatcaacgtaacacaacaacctcaagaagaagtggatctcttgatgagccagatagccgacgaagcgggcctagaattgaaacagaatttgaacgaaacaggtgtttccgatggtttggcaaacctaaagcaatctcctggtaaaaataaggctaatgaagaagacgaagatcagttggcacaacggttgagggcattacgtaattagagctttttatagtatcattttcgagtaattattatagtgattccgatatctatcgcataaaagtcacacactgctcttgccgcacatttattccgaagttggcaaatgagtgaagtattggacattccggatggggagtacgatttagacatttcgtctttgctttgcgacgattctgtcaacttgggagttagatacaatttcaaacccgattcaattgatatggactatcccttggagttggtccaggagtcgtccaattatattctgaaggccgagtcagatcccaatgttcgcaaggagcctctagtttttgaaggaacccttggaaagactaatcaacatgattatttattgatttacgatgatatcacaaagcgcttccagatggatcgtttcaacggggttctacggatgaataagtccagagcgcctgacaaattgctcacgaagtttgaaaagctgaaactgggaaaggattctccggctagtggctctaggccttatgttgcgactgccaatcataccgctttaagaaaagtaacccccttcaagcttgaaacaaagttgaaaccaacaaaaccattggaaaatagggtccatatacatatgaaggaaagcaaacccaaaaacagctcttctttaaccgaaagtgtggataagaagaagcaagaggtttctataccgaaggtgcaccttactccgcacacgccttcgtccatcttagtgtccaaagctgagcatcccaaagttgcttcaaaaagaccaccaaatacaccactagaatttcaagacgatagtaacgataataatgataatggcgacgatgacgacgacctgacctcgtttgttggagaactggaagcagaaatgggaatagaaactcctcccccaactcaagagagggccgggcttgtcggcattgggatatcaaaatctgacaagtctactgatcaacaaagtgctacacaaatggaactaagcaaagactccttccatgaggataattggcagccgaactactcagattgggaatctgatctcgaagaggtacctgcgtccaattccatcaacttttttgttgacgatgatcctaaatccaaggaatttcagaaccaggccacctacgtgaacccagagtttcataatacccctgctagctctgtagcaaggccgatcagcatgaaagaactcgccactacaacgtttagtcaaagttccaaatcgtcataacaaaaccgtctctaaacctatatgcggttgataatagtgcaggtactatttcccgatggagaaatctcactcagatttcaccagccatccttgttctctatgcgcgacatacatgctgttacatagttgatacgcattacagaatcaactttatggtaagtttgaaaaggctatcttcaattagaaaccaaccatttcaagtaacttagtacctgcagcgaatatataatgggggtcatagtaacatatttgtatcacattacatttctaaacctgtctgaagagaaagcacaacacatatcctacttttgaagggcaatactatcagatttcagttctccaactttttacattcctttgaactataatgagattacttcacatttcattgctatcaattatctcagtattgaccaaggccaacgctgaatgttgttacaccaacacacatactaccactgaagtctggtatactacagtatatgctcgagatgttagtgaagagacttcttccacactggctggtggaagtgcaactgtcagctcagaagtgagttcgacaattgaatctagcgttgccacttccgctaccaccgaatcttcaagtgagacatcagggtccacatctgggtccacatctgccactgaatcatcaactggtagtagctcgctagcaaccagttcatcgataaccagttcagagtcttccaccattacacaaaccacaggacaagagtcaacaagcccaaccccatcgtcctcagagacaggttcttctactactactccctacgatataagtccaacggcaagttccgactttgatgcttttaaatatcaaattcttgatgaacacaacataaaaagagctctacatggagttgacggattagagtgggatgaagaagtatatgctgccgcccaagcatatgctgacgcatacacttgtgacggaaccttggttcactctggaaatagtctgtacggagaaaacttagcgtatggttactcaaccagagggactgttgatgcctggtacagtgaaattgaatattatgactttaataacccaggttataccccaggtgttggacatttcactcaagtagtttggaaaagcaccacaaagctcggctgcgctttcaagtactgcaatgactattacggagcctacgtggtatgcaactactcaccaccaggaaattatgtcaacgagggatacttcgaagccaatgtgttaccactggtagattaactctttaaagtttagttttgtagttatataaaagatagtatattttgttgtaggtaaagtgatggatttcggatgttcttatcaggaacgttctatgcatgaattttttttttcacgtttaccatcttacgtctaacatttactcatgactgaacaactgatagaatggtttagggacccgtcaaacaaggcttattggaatgaagacttggttgccataagagagtctcctcttggaggagtaggagtctttgctaaagaaaagattgggcatgacgaagaggacgatgaagagaaccttcttctgagagtatccaagcagtcgattttaagcggcaagaactctttcatttcgaatttgctccatgaatgtggtgctgatagtcatttgggacttatcttggcgtttttgtatgagaagtccttaggctccgattctccatggtatgcatatcttcaaacaattcaacctaagaatactaagggtttaatacttccagttcatttatggccagatgagaagaaaaatctgctaataggaactgagctttattcagtcttggataattttgaagaagagactgaagggctgtttgagtcttgcgtatcgtttgccagagaatacgaatctgtcctcaaagtccccactgagttagctgttgatgaaaacaatgccaaagaaaaacttttggaatttgctgctataacattagcaatagcttctaggtcgttcaatgttgataattaccatgaattggcccttgttccaggagccgatcttttcaaccatgattcatacggaagggagcatgtacatttcgaagcgttgggagatgtttgcccattttgtgccagttgtgacgagtgtggccatatagagcatggagctcctgacagtgagatagaaagcgatttggagcaagagggtgataacgaggaagacgaggaagacaaagttcacgatgacgcggataccgaggacggaatggaagataataagaaagaaggtaataatgaaccatttgaggtgacggaagactatattaccaagttggaaaaagaactggaacgtgaagacatgtctgacgaggaatctgatgcctccgaagctgaagggcacgataactctgatagtgacatgagcgatatcgatgaagacagtcttttgatacccgatgtttgctgtgatatcaagattgtcaagtcaatcccaaagaacaaggaattgctcaacacctatggggatctaaacaatacgtccctgttgacaaaatatggatttacgtccctcaacaaccccaatgattatgtgagtcttggagaccaggctttaagccagctcaagaacttcccagatcgtaaagactggtgggattccaagggatacgaagtgttcaacgattatttgcattacacagctcaattaaatcaagaggagtacgacaacgaaggggtggaagacaaagaagaaaaggaaggccataaaaatggggaggaaggtgacgatcagtatcactctgacgccgaatgccaatcatgcaatggagactcccaggccagtccaggatcctgctgtaactcatgtgatggtggtaacgatgaaggagaagaggaagaggaagagcaaccagaatatctaccatggcaagttgaattgagagtcaatgcggagggaaggccttcccaatctacttatgctctcgcaagactattgtctctttcagaggctgaatttcaagagctgagagaggcagacgataaaaccctgttcctggaaaagatcggtactctggaatctcctgaaaaggcagcatatcagaatattctaaattggtgcaagcaaagatctaccgcctaccaagatgggggactgactagcaacgactatgagaaagccattagggtaaccaaagattctcaaaagctggccatctcgattttggttttcggtgaaaagaaggtcctagaacagtcaatagcttctctcacgcagcagatcaactagtatgtgaataagatgtagcatagatatagagtattatcatattagggaccctattagcataggcactaccagacaaccccaggatatttccagaacttctcgaaagttccaatataaaaaatcggtaccggattctctccctttttccttctttcactctccatctttcgattaacagcacattaacaacaatggtaagtcgtcgtcactcccaattggtcaatagcaggcaaacggttactaacagttcaagtctactcttttaaagtcagccaactcactcaagccattgctgaacagagttctcgttcaaagagctaaggccgccaccaagactgcttctggtatctacattcccgagaagaacgtggagaagttgcaccaggcaacggtgattgccactggtccaggtgttccaaaccaaaatggatcattggaaccaactatcgtcaaagccggcgacaatgtgttgattccctcgttcggtggatctccagtcaagatcaacgatgaagagtatctgttgttctccgacagagagattcttgccaagatcgagaattaaattattggttgattccatgtaaatagaaacaaaatatcagaatcaattcagccctacccttactcaactcatctcctctgcgaaaaggttttcgttctcgattctagtgtctcagttgagagaaaaataaaaaagaaacaaggtcgttcacctatcaacacggcttttatcgcaaacccactctgccactatctacaccttacatctaacctgtcatcatggctgatttagttacacaagagcccagatttgcccagttcaagcttgttttattgggtaagtatttctttagacgtcgctgttccatattcgtggtttgccatctgactaacattctttaaggggaaagtgctgttggaaagtcctctatcgtacatcgtttcgtcaccgactcctttgacgatttgagagagtcaacaataggagccgcatttttaacccaaactattcagctagatgaaaggaccacaatcaaatttgagatttgggataccgctggccaggagagatacaagtctttggccccaatgtactatagaaatgccaactgtgcacttgttgcttacgacataacacaagaatcttccttggatagagctaaatcctggattcaggaactacagaaacaggctagcgctgacatcgtcgtggccttggtgggaaataagctggatttggaagccgaacgtaaggtttcaaccaaggaggccaaggagtacgcggatgaattggggctcattttcaaggaaataagtgctaaaacaggcgaaggaataaaggatgttttccattcgattgcctccaagttaccagttgaagagaaactgaattcagctaccaagagacgtcgcaacatcgatttgaaccgaccatctacgaacaaccaagagtcttgtagctgctaggtagtttaatctgcataatattaggagaattcattgggaatttgttcttcttttctaataaaagaacgagaaaatcattatcctttaaaacatatcattctcaaaagggcattgaacgctatcatgtccttccctttcacaaagaccacaccatttttttcttccatttgcgggatcagagttttttggaacaaatatttgcaagttcccgttctcatccagcaaggttgattgctctgtggttgttgaggtcaatggttgtattttttccttctctctggcggtctcaagctgttgttgcagagatcgattttctgctttcaatcgttgtaattgctcttctatttccgtgtttttttcaggttgagctttctgagagcttgataattttgctttcaaatcatcgatttcacgctggtatccttgaattatatcgttttcctctttactttttgaatccttaagttgagtatatttcaactcccaatcttgacacattttttccttgactttcagctgacgttggagttcgttcgtttcctttgcagtatccttgtttttataagcagcacattcctccctcaaccttttcaattctttagtgtagagctgttcagtttctgacgcttgtttttcaagggaatcaataatatccagcagttcggtcttctgttcgtcgaatgaaacctttagcttggaaattttttcattcttctcagacaaatctttctccatttggttgaaggctggttcgtaatggtctttaatgaccttctccatagactcgagaacttccgtgcactcttgtaactgtgtttctaacttcaaacatttctgtgaaagatgggtattttcagtcttcaaactgtgcaattgtccttcattgcctgcaacagtgctcgggctactctcctttgatgatcgtttcaacccttgttgattggaaacagctaatggtgagcgagatacataaacatttcgttttgtcttcgttggtgtctctgcttgaagtcgttgcatgttacttgtctccagaagtctttgatagggcaaaaatatgcctgaattagggactttggtggtaaagtactgcacgttcttaaactctccagaattctttccttttccactcatttgaccaatcagttcaacaccagcaaaaatcccagactttgactccacatttcctacgaacttgagtatggctctttccccaccgggtaagacaatctcagaacccaaggggacatgtaattccatggggttagaccttatttattatgttcagagtgagacttgatctcgattcactagattagaaacactggatgttagatgccggttagatctatcgaatctaaatgtaagttaaaatctctaaataattaaataagtcccagtttctccatacgaaccttaacagcattgcggtgagcatctagaccttcaacagcagccagatccatcactgcttggccaatatgtttcagtccctcaggagttacgtcttgtgaagtgatgaacttctggaaggttgcagtgttaactccgctgtattgacgggcatatccgtacgttggcaaagtgtggttggtaccggaggagtaatctccacaactctctggagagtaggcaccaacaaacacagatccagcgtgttgtacttgatcaacataagaagaagcattctcgatttgcaggatcaagtgttcaggagcgtactgattggacatttccaaagcctgctcgtaggttgcaaccgatagggttgtagagtgtgcaatacacttgcgtacaatttcaacccttggcaactgcacagcttggttgtgaacagcatcttcaattctggcaagctccttgtctgtcatatcgacagccaacagaatcacctgggaatcaataccatgttcagcttgagacagaaggtctgaggcaacgaaatctggatcagcgtatttatcagcaataactagaacttcagaaggcccagcaggcatgtcaatactacacagggctgatgtgtcattttgaaccatcatcttggcagcagtaacgaactggtttcctggaccaaatattttgtcacacttaggaacagtttctgttccgtaagccatagcagctactgcctgggcgcctcctgctagcacgatacacttagcaccaaccttgtgggcaacgtagatgacttctggggtaagggtaccatccttcttaggtggagatgcaaaaacaatttctttgcaaccagcaactttggcaggaacacccagcatcagggaagtggaaggcagaattgcggttccaccaggaatatagaggccaactttctcaataggtcttgcaaaacgagagcagactacaccagggcaagtctcaacttgcaacgtctccgttagttgagcttcatggaatttcctgacgttatctatagagagatcaatggctctcttaacgttatctggcaattgcataagttcctctgggaaaggagcttctaacacaggtgtcttcaaagcgactccatcaaacttggcagttagttctaaaagggctttgtcaccattttgacgaacattgtcgacaattggtttgactaattccataatctgttccgttttctggataggacgacgaagggcatcttcaatttcttgtgaggaggccttagaaacgtcaattttgcacaattcaatacgaccttcagaagggacttctttaggtttggattcttctttaggttgttccttggtgtatcctggcttggcatctcctttccttctagtgacctttagggacttcatatccaggtttctctccacctcgtccaacgtcacaccgtacttggcacatctaactaatgcaaaataaaataagtcagcacattcccaggctatatcttccttggatttagcttctgcaagttcatcagcttcctccctaattttagcgttcaacaaaacttcgtcgtcaaataaccgtttggtataagaaccttctggagcattgctcttacgatcccacaaggtggcttccatggctctaagaccctttgattggccaaaacaggaagtgcgttccaagtgacagaaaccaacacctgtttgttcaaccacaaatttcaagcagtctccatcacaatccaattcgatacccagcaacttttgagttgctccagatgtagcacctttataccacaaaccgtgacgacgagattggtagactccagtttgtgtccttatagcctccggaatagactttttggacgagtacaccaggcccaacgagtaattagaagagtcagccaccaaagtagtgaatagaccatcggggcggtcagtagtcaaagacgccaacaaaatttcactgacagggaactttttgacatcttcagaaagttcgtattcagtagtcaattgccgagcatcaataatggggattataccagaagcaacagtggaagtcacatctaccaactttgcggtctcagaaaaagcataaacagttctactaccgccattagtgaaacttttcaaatcgcccagtggagaagaaaaaggcacagcgatactagcattagcgggcaaggatgcaactttatcaaccagggtcctatagataaccctagcgcctgggatcctttggacaactctttctgccaaatctaggtccaaaatcacttcattgataccattattgtacaacttgagcaagttgtcgatcagctcctcaaattggtcctctgtaacggatgactcaacttgcacattaacttgaagctcagtcgattgagtgaacttgatcaggttgtgcagctggtcagcagcatagggaaacacggcttttcctaccaaactcaaggaattatcaaactctgcaacacttgcgtatgcaggtagcaagggaaatgtcatacttgaagtcggacagtgagtgtagtcttgagaaattctgaagccgtatttttattatcagtgagtcagtcatcaggagatctgaaatatggtgttgggatccaagcgagagacaaaaaaaaaagaaaaaaagaaaagatgcctgattatataatacatagttcgtactcaagtgattggggaagacattaagaattaaccgttaagtttggacagcaaactggctagagcaggatttatagatgaagaaacaggtgtttcatcttgcttctgcgttgctgttgctgactcgtccgaagtagaagcaggttctggtgttagtccagttgttctagatagactctctaagatggaggaaagctgagggtggactgggttagttggctgttcgccagaatcaactgtttcagttggtgggctctccatttttctcttttttgacacattttcgtcgccttcttcatcacttgaagcggcatattgaggtacaccatcttcttcttctacatcgtttatgaattctttcaactctgattctttctgctgaactgtggcaagtttctcatccagagaacccgaagactctgcatctttcgtaatccacgactcttggacttgaatcagtttcttcagctcatttattatggactctcgtaattcttgggtctcctgtgactttgatctggctgaggtgattaaggttgatagatctccaagttgttttaaataaatatcagttcctggtaatgtttcagagtcgaatagacttgagtattgttcatttatctgattaacgaccagagacgttgaagacttcaatgttgagattttgttgaacagcgttgatagagaggaaatctcaggagccaaatccccagaattgattggtggagaatttgaactagacgaggataaaccgttataagctttttgatcctgtatgctctgataaagtctatgaatcaggtttgagtcaaatatcttacgttgactccagacatctataattcgcttcagtttcgcctggtgagtagagatcatactcggatagatttgctctaaagtagatggtagcaccttggcaaactcatctagaaatgtagtctttcgtttagctctcgattgctgaataatttcattggccagatagagccccgcaagcttcttggtttgggtggaacctacaaattcactccaaatggcgacggtttcgggagcatgtctatggtgaaatagacaccattgtccgatggattgaatgctaatttgggtttcttccaaactagcaagcttttccaaaactatatcctttgagtaagacatggtctggagtaagtatcaatggtttggttgttggtggagaaatacgagagcgttcagcctcgaaggggaggaatggcaaactagagggaagtccaacgggagttaggaccctcgaaaccttcattggtaggtggggcccccaaacctccagatcgtcttctctcactacctcccctgtttaccttgccgcataatttcttcacaatggctgacaagtttccagagttgaaagacgtcgacaccggcgcatcttccggtgaatctccttcgcaaggtgactttttaagtagagaaaaggaacttttgggcgatgaattcacaaccgagagagaccaagagttggctgacgacaacgtggacgagttcgacgaatttgagagcaactttcccaaagtagatgctgatcaagaggagagtattccagtagaagatgctcccgaagaagaggcacatactccactgcacagcacttttgataatttggacttgaaggagagcaagccaattcaagagtggaaagagcgtactgaattggagatctccaagagagatgaggttgctgccaagaaacacgaagagatcaaaaaacaggctgagaaggatgtggatgacttttatgtcaactataacgacaagaaggagaaatctctaaaggccaccaaggaggacgaggagaagttcattgccaagagggacagtttcttcgaccagggaagtgtgtgggatagaacagtagagctgctgaagttgaagaagaacagttcttttggtgctgatgaagcggacaagactagatttaaggagattttgttatctttgaaggggaaggaaaacgtccctggagctgctggatattgaaatggaagccggaaagatttgatctattcatatgtataaaataggcgtattatttaagtgaataaattcgaattatttgatgtttggaaaaattccgtgaaacgaatttggaattgtatttttcaactctcaattttacttaattgggagcattttctgtaagcaattggttgactaccaagtatggaccaggagaactctcaactacgtaatttccatggattgttagttttggcgaggctcttggatgattacatttccaaaactcttcagcaagatgcggtgaaggatgatacgatggtgcaaaatgacctcaagtggacgcaaaccgaaattaaggaaacaatctccagagtgtctccattggcgtcaacactgacatcaaataactcctcatcgaatgcggaaaagaaggagatttttgttcaggtctgcgcttactttggaggtgtgttggataatgttatcgtgatctttaaagagactacagaactgtcaatgttacctactctcgagacgttgcaaaataatttatgtgctatagaaagcggtggagatgcaggcggagatctttctttgttgataaaagaagctatagagcaattacaaagacagagataaacggtatcctaaagtatctgatcctaggaggagttcaagctctaaaggcaccagaataaaatgatacgactgacacaagtagaccctttttcttcaggagacaaagtcaattacccaatctatgttttccttccactttttgtagttttctggatcctttatccataattcacagagctccgataattcagggttttcagataaagatttaagccattgtttcgcttgatttttgaaaaattgtccctgcttttcgagttcctggaaatctggggaatccttaactttgtcataggtttcttcgataccatcagtgatgtggccagagtacttcgctttggctaagggaatctttgtatcgaagtccagccaaattgcaagaaaaatggcagacatcaacttttgaaaggattcactgcaatcaatctcgccatcctcaagagtttgtggtaccggagcagccaacgaatccacaacaaatttaacctgatcttgtgactttagtaaattatccaagaagtcaagtgaggtgtggtcatgaaaaacatccattacccaagcacccatcttgaggagaaggatgccaactgccttgaagagggatctgttgattggagaagaaagcaaaaggaacgtctggtaaatccagcgggtgattgacacgaccaagtgggactaaacctggcgcccctaccaaaacttcctacgcaagagtcatttttgtatggggcgataagcaccaagggcgagtgagtatcactcatcgccagctagtcgccagctagtcgccagctagtcgccagctagtcgccagctagtcgccaatcgatgcgtgagtctgaacatcttcctttagtaaagagcgtacagtcgcatatcatgacaacaagagaatccaaagacaaaaaagaaaaggcggattgggctgttactaattctctgtcatccagcttgcatttgaaaaattcccaatttggcatcctagcaaacaaccctgctcagtgaagctctaaccggtcaactcagctgagctgtggatcccacgtacacgatataatctgcaacaaattcattcttcactcacaaactctctttaagtaggtttctgactccatttctccgtgtggctttcactacatgctccccctttgagatcctgatttataatcttaggcccctggtgcagctcgttgacaatacgtcagaagcaggtcgtactatatccgctatgatacaatacgctcctttcagatcgccttccagactgtggaccacaattacctcagatctgcaaggttcactacccccaatgattttgcatgtaaatatatcatgatattttgtctaatctatccccctcgttcttgtctcgaatcgcatcatcatccgcattagttcagtctcaaatcgctcagattccctctcctcattccctctctttatttccttccccatcatccccaccattcccaaatcgccctttgtcttgccatgaacgggttaccacaacagccatggcactcggaactcaacccgaaggaacgacagggcttcataaacattattgtacagtcagtcttccaaatacagggcaataattcctttaataacgctaagaccaaacagttggctgaagactttgaaaaatgggcgttcagcaatgctagatcaaagaaggagtacgttgacatgttgagaaacaaagtatccagcatcaagcaggctgcggttaacggtcgttcctccatggccgctaatgcccctgaccctgcagctactctgaacggaatgcagagcatgggtcaacagaatattcccgttcaaccacaaatgcagcaacatcaacagcaaaaccagtatatgaaaaataatcagcaacagcaaccgcaacaacaacagcaacaacagcaaccgcagcgtcccatgatgaataatttctccaatgaccaaagagtcaatcttaaaactgccccaatacctgaggctcttttgaaacgtattcctgggcttccagttggcgtcaatacctgggctcaaataacccagatgttgcagaatgggcaaataaatcctcagctgatgaacaccattaaacaggtttacacggtccactcgcaactgttacaagcaagaagtcatcaagatgccatgcagaaaccaccccagcaaccccaggtacagacccaaccccaaacacaaccccagccacaaagagatcagatgtttatgcaacagaatcgtatggctaacaaccaacagcacattcaacaacaagctcagaatcctcaattcaattccaaattggttcaaggtcagcagcagcaacaaccacagcagccaccacaacaatctgctactcagcagccacaacttcaaataacacaagaaatgcttagggaaggtactacgcaagcattgaatttgattgagaggctgaaacaaactggcgacttgccccaaacattggcgccggcccagcaacaatctttcatcaaaacgttcattcaacgacattacctaccacgagttctacaaaacaaaaatgctactgcaaatccttcaagccaacaagcgaacaatcaaaactcggttcctcaagcggttccaggctttcctggtcaatctgtgccactacaacaggcacagaaatttgtcaatacgtctcccctgatgaaccaaactttgcctacaacattcaacaatgcaaggcctatgcaaaaacctcagcaacagaaacaacctcaacaatctgtaccatcaaattctatgttcggtgcacttccaaatgcacaacaacctgtgcctaatatgcatcagcagcagcaaaagcaacctataaagcttttacctggtatccaagctacagaagaggattggactaatttaagaaaagtgtacgcagaggctttgcaactaccaataaagctaaaaaatgtgacaaacgaaatcacacctgatcagaaacgagctgtgctggatcaggctaagactatgatccagctctctatcacaacagagaatttgattccgaacttttttattgccacaaagaatgttgagggtacaagaaggctgattcaaatcaagttcatgctgaaggaagttttagaaagtctgaagcgaaatgagtatttggcgactccaaacattttacaaagagttcaaactcagattcacaagtacattacttacttgaaagaactccagcagcgcaagtttcaacaattacaaaatgttcagtctctgcaacaacaacagcaacaacagcagcagacttctaatctccagcaagtcccccagatgggccagggaaataagcagctgccaaataatatgctctacacgtcgcagacaaatcctgactcgctcatgggtggatcaaatgctaacaacatgttttcaggtttagggattcaagacccttctctgaacaatactgctgcattcagtcagcaacagagagtcaccccagcttcgggacagcaattaaactcgtctcccttgatgcagacacctatgctcaatcaaaactccttgatgcctaaccaaatccagcagtttccaccccaacaacagcagcatcggcaacagcaacgcgctcttcctcagcaacggttggctcagcaagttcaaacttcccccaatgctaaacctcagcagtatatgcaacaactgcctaataatatgccccaaccacaacattcacaacaaccctatcaagcttcattagaacagcaagtaccgcagcagatgctgcaacaaccacagcaacgtcagcagctacaacaacaggtacctatacagcaagttcagcaagctaaaagaaaagtcaaatcatccgtatcgggaccttctactggcgcacccggtaaacaagccaaagtgcaaggtaataggatggctgctaccaacgctgcggctaaatcaagccctgtagtgatggcaactcctagcagcgttcagtcaccagagaatcttgtagctacgaaagaacagaacgagatccaagcaaaggaagaagcagagagtgccgctattaatacttctcggatgagaataaaagaattgggacttgatgaccctgcttcttatttcctctgcatgttatctcgctcgttggacctcaaagatgaggagactcaactactagactccaaggaaagcaattctgtcaagaaagatactatatctcaaaagggtataactccgtccgcaatcttgcagactccactatcttttatcaagaccccaggctcgtcccgacccttggactctccgtctaccagtaaaaatgccaacgagtggtctagcaaggttacgccagctgcaatcaatgcagtgttcagagatgtttcggcaatcagcaagacgctatcgtttggaatgttgcctacccctcctgaagaaaatgaagttttgaagagatcatccgacgccgacgaggaacccagtaagaaagctaaactagagaacaagttgcagaactcgttatgggactttgactacgcggaagaactttttgcaacagaccatttatcgccttaagtaagcattatggattatagttcattattacatttatgttatagaattatttttttcatctgagcaatttgtaatcgcgtttagcaattatgctatacactttctactactttcgcgtaaattttcacgaggtgcgtctctagaccttgatatttgcctgagatgatccagagttcctaacaactttttttgttgcggcaggctacagtcatccctgaaaattgttgttaacagacgcagtttttacgaagtggagccatttacgagagagacctaatcattaggaaaaccggatttggataccccaatattgctctttctactttcgcagatagccgttaagaagaaccttgccactgatgaccaaagcaagcgaagcaggcggattcatagtggacgacccagactacaagaaacccgccaggagaagaagagctgcgaagaaagctgtctcctacgttgagacggacgatgagcttcctccaaacggtacctcatcctctaaatcttctaggaagaggaaggtaaaggacgaatctgaagatgaggagtaccaggagtcgcttggaacagacaaggttgacgatattaaacccgaagacgatgaagaagaagatgctattgttattagagggactagcaccggcagaaacagacctaatggtgccagtattgttaacgcaattagtctttcagatctcagtgatctgagcgatttggaacagaatattgatataccagaggaattagaggaactcgacctggaagtagttgaggaggctgaggctcctagacccaaaaagaaacggaagacaccagcaaaaccgaagaaaccaagagtaccttatttcactagagtaactgaaaaactctacaacattcatccttctttgaaagatgtctttccgaatttagaccagcacgaacaaatcgaagtgaaaaaagccactcagcccgaaggaatgacttgtactctcttgccgtttcaacttgaaggtcttaactggctcgtcaagcaggaggagagcgagtttggtgggggtgtactggcagatgagatgggaatggggaagaccatccagactattgcgttgtttatgcatgacagaactaagtcccccaatctggttattgcacccacggtggcactaatgcagtggaaaagtgagatagaacttcataccaatgggatactgaaggtcggggtctttcatggtcaaaatagaggaaagagtgccgaagagttaaaggaatatgatgtgatactgacaacttattcggttcttgaatcggtttataggaagcaaaactatggattcaaacgaaaacgtggactggtgaaagaacccagtcctttgcacaatacgcatttttatagggtcattttagacgaagcccacaatattaaggacagacaaagcgggacagccaaagctgcaaattctctagacacagagaagagatggtgcttgtcaggtactccgctacagaatagaattggagaaatgtattctctaattcgttttatgaaactgtacccattctgtgagtatttctgcactaagtgtgattgccgatccacggagtggaaattcactaattggaaatgttgtgacacatgtggacatactcccatgttacacaccaattttttcaaccatttcatgttgaaaaatattcagaagtacggggtagaaggcctcgggttggagagcttcaagaatatcagattattattgaaaaatataatgctgagaagaaccaaagttcagcgggctgacgacttgggtcttcctcccagaattgtcgagatccgccgtgatagattcaatgaggaggaaaaggacttgtatgcaagcttgtattccgacagtaagagaaagttcaatgactatgttgcggagggggttgttctgaacaactatgccaacatctttacactgattactcggatgcgtcaacttgcagaccatcctgatctggtactcagaagagttggtaccaacagcatcgatagttctggtatgccagaaggagtcattgtatgccaattgtgtgatgatgaggctgaagagcctattgaaagtaaatgtcaccacaaattctgtcgcttgtgtgtttccgaatatgtggaaggtttcaacggagacccaaacaaactggagtgcccagtatgtcacttggcattaagcatagacttagaaggtccagcaatagaagtggacctcgaacttattaaaaagggaagcattgtgaatcgtattagaatgggaggtgaatggaggtcttcaaccaagattgaagccttggtggaggagttgtttcatcttagaagtgaccgtgtcactatcaaatcgattgttttctctcaatttaccagtatgttggacctggtagaatggcgtttgaaaagagcagggtttgaaactgttaaattgcaaggttcaatgtctcctctccaaagagaaagtactatcaagcactttatggaaactccgtccgtagaggtgtttttggtgtctttgaaagctggaggtgtggcacttaacttatgtgaagcttcacaagtattcattcttgacccttggtggaatccttcggttgaatggcaatctggtgaccgtgttcatcgaattggccaacataggcctgtgaagattaccagattttgtatagaagatagcattgagtccagaatcatcgagttgcaagataaaaaggcaaatatgattcatgcgaccattaaccaagatgatgctgctatcagcagattgacaccttcagacctacaatttttgtttatgaactgagtttaatatcacttacatatagaactaggcagcactggtacgagctccggcgccttccttaatcaatttcaaggattcttcggaaatctcaatttctggtaacggtttcttgccttccttagacggagggggaaggaaacctgtctttattaagtaggcaatgtagatacctgtttgggcagaatctacccctctacccttggaaccatcgtatcctgtccatctggtgtctccgctaagaatatcttttgcatttttgtcatctagttccggagctttagtgtcttgtggaagattgtccaacacgaaatggagcaatggatacaatgcactgtccttggattgatccacaacaaatctttccaagtcacgtttccactcaacataatcagttaactttacttcataaccatagtcattcaaagcgttcaaaaactcgttgaagcggattcttggatgccctgtcacctgtaccacacaatgaccttcttctgcagtagggtgaagagaagatgcagtaacaactaaagcaacgtgatcaactgggaccatgttaaccgtgttagaaatgttgggtaactttccaagttcggcacatcctttcaacatacgtaacaagaagtcatctgtgttacaagcaccagtcctagagtggcccgtaacataccctggacgaataatggcacctcttaaacctctctcgaaggcacggcgaattatgtattcagctgcccacttagattgtccatatccagttccaagacccttggaagatccaagcaaatcatcagattctggaataccatcctcaccttgttctgttaacgtgtctgaaagagtgatatagtgttcagtgtctaaagttgaagtagatgaaacaaatccaaactgtttgggtttaccagaagctgccaagttcaacacattgattgtagaaatgacattagcatcacgtaacttggaatatggatagacccagtgaaccagagcaccgttgtgtatgatcaagtcaatagtgttagctagctcagcatacttttcacctgatagacctaacttatctttactgagatcagcaatgacaaccttaatacggctagtccattcttcattccaaattccgtaaaccttaccggtgttgcgcaatctttcaagcccagactcttcgtctttagctctaacgtgggcatagacctggacatccaagtctctctccaagagatctttcagaatgtaagagcccaaaaatccagtagcaccagttaagaaaatgttgatcagctcagcatttgaaagagccaatctagatttataggagtctagcaattgacttgaaaccaagtcctttgcatcttgaaagtagtcaacaacttgttcgtcagatccagcagaagtactctcctgcttgttgtccgcaaactgaacttcgtcaccattcttgacacgatcaacctctgctgcgaaaagcttaacagtggggtgcttgaagatggtacccaatggcaaatcgactgcaagttttctcctgagttcgaaaatcattctcgtagccaaaattgagtgtcctccaagatcgaaaaatgagtcttctaacgaaatactggcaggtggattgggaagtacttgcaaccagagatccttgatctgtagttctgtggtggtaaattcagagtcatcaacctcagcagaggacttttgggctacagcagcaagctggacagtatctggaaagggtaacttcggtttgtcaaccttaccattaggattcagaggcaactttgccattgggacaataatggtggggatagcataagaggccaaagttttcttcaaatgtgcttttaggtcttttatcaattctctgtacaataataaactcttaacaattggatcattcaaatcgtccagatcgtcagatgacgacttgaagttttccagttcgggtgtttctttgggcacaacataagagataagaattggctcctcatctttgtccctacgaacaagagtaacgttctgacgaattaaaggatgcctagagatatgggtgtcaatctcccccaattcaattctgaatcctcttatcttaacctggtcatcagctctaccactgacctcacaatctccggtaggtagataccttcctaagtccccagttctatagagtctatccctgggtcctaagtagaattccctccaaggttcgtcctttgagattttcttatcttcttctacccacttagatggagatacaaaccagttggggacaaacttttctttgttaaggtcaggctgccctctatactgctcagctaaaccagcagcacggacgtagatctcaccaacttcacctattgcgcaagtcttagatctatcgtgtctgttgactacaagtaactgaacattatgcatccccttaccggccggcatgatatccttctgaacttccaagaaagtggaatcttgggctcttgaaggtatctcaaagtacgaaactgcacgttgcgtttctgtggttccgtacatgtttatgatgttcacgttttgagcaatagtttgcagtctcaaacaatctctcttggtaaggatatcaccaacaaaaaaggcgtgatgaagggaaggaatttccttagttgcctgggcagacaacagctgtcccatagcaggagtcaaatgggtcactgttgcaccataggtttgcatccattctgccaattttcctggagtaccaatgtcatcactagtaggaatcaaaagctgagcacctaaaaataaaggagtaaacatatctctttgaatggggtcatgagcgataccagacaacattgtgaacttgtcattctctgaaaggttgaaagtttttgacatccaaggaaaataataggccaaggagaaatgacgaccaagaacacctttagggatgccctcagatccagaggtaaacgataatgtaggattagagtcaggcccaaccaaaacgccagttcttctagttttgaattgttggtagtcgtataaagcgtcctttccatccacgtctccacccagaacgttaccatcggcttcaattttcaaatttgatatacgagaaaccaagcttagctcgttcttgatataatcctcaaccagctgatccaaaacgccagctttttccaagacaattagaccagcaggtttagcaacttgcagatagacgttctgtctggccggaggataagcgggatcaataacagaaaacgtggcaccagctttaagtactcccataacggcaaccatcagatcaacgccacggtaggcataaatcatgactacgtctccacgtttgatacctgtatgcaccaagtagtttccaacaatgttggaagcttggtcgatttgcttgtatgtgaaagttctagtttgggaattggggttcaaaaatgacttagtttcaacaacacatgttctgtcgggaaatttctccgcgttatcagagaagatgtcttggatagcacctctatatcctgaccaatcaaggtttgcagtgggatcagggagcagtttagactgctgctcagttagtagagagatcttacctattggagtttcaggagctttgttaacttcgtcaatgaaggaagaaaactgttggctgaaatatgcaatacgattgtgggtgtacaaaagagagttgtagtaaatattgatactggtattattctccaaaaaaatagccaggtctctcgtagatccctcgaccagagttgacagttgttgaaccttcttggctgtttggaaacttagcctgaaaatggggggataatttggcaattgtttggactctttaagatgggttacaatatctttcagcggggttgcacgctccaagctctcaagatattgttcgcctacttgcttggaaacatcgacaaatgacttggaaggatcaacttgaagtctgacgacaaaggggagattttgtttctttggtgaatcggtcaagatgacaatgtcatcatcaccggtaagtctgtagaccaagacggcaaacacagccagtggagcagtaaactgggtgacagatggctcgttggctttgttcaagaagggaagaatgtctgaaatgtcaaatgtcttgttggcttctatcactttgccggctacaggccggttataatctcgaggaagaacacttagtgttgggccgtctaggatattggcccagtaatttaggttctcttcactcatggttcgttcttaagagtgcggggaatccgtctaagtgaaaaaaaatatgaagacaagttgggtttcgtttgaatgagtcctaacctcactgtaaatgactcagttgagtctgaaaaataattcagttgtcggtaaaagataaccagtagtgcatggcctaaagttggggaagcgatggggttcgatatgaagaaacccaatagtcgtgtgctctgccaataatgaaccgacattgggagaaaacccgttcacgtgacatcatcatgagaacacaacgacaacatagtatagaagacagttcttaaccaccacacacatgtctcaaaggaagttacaacagtaagttatcgtgtaccattaatggctaagtgacaaagatgctttgttttctagtcaagtcgcaaggaaaagaaatcagacactaacatatgtcccccgtttagagagattgaccgtgtgttcaaaaaagtcaaagaaggtctggaagagttcgattatgtctatgataaactacaagcatgcgagagctcttctcagaaggaaaaattagaaagtgatctgaaaagagaaatcaaaaaactacaacgatccagagaccaaatcaaaatatggttggcgggaaatgaagtcaaggagaagaaaggattgatggaacacagaaaattgattgaacatgagatggagcgattcaaagaggtcgagaaagaaatgaagacaaaggcgttcagtaaggagggactgaacatgaataaagtcgatccaagggaaaaggaaaagtcagagacctccaagtttgtggagtccatgattgaagagttggaaagacagagtgaagccttggaagctcagatagatcaaatccagagtagtggcaaacgagggaagaaactggataactctaagaccgatcaaattgccgaactacagtcctccttggatagaaataactggcatcaggagaaacttcaaactatactaagattgcttcagaatggtaatttggaggcggatcaaatccagcgcatacaagaggatattgagtattacgtcgaatctaaccaggatgccgattttgctgaagatgatggtatttatgatgaattgggactggatgaaattgaagatgggttcttgtttgccgccgcctctggacccctttcaaaagatgaagaaggtaaagatgaaaatgacgaaaatgtatcagataacgagtctccaagtgccagtgcatctagtaattttgctgcggtaaatcaaggttcaacttctgacagcaccgtcaagaccgctcctgctgctattaactcatcaacaggatctgtctccaatgtcacctcaacgaactccaatgcatctgttttgctcaacaaactcacaagaacatctcctgcaagatcagctgctgcgactcccccacattctcataacgaattaactggaattcaatcaaatcttaagcctgctgtggcccctgtgctgacgcccaagttgaaatattctaaggttgccagtacagcagctaccgcaagtgtgccaccaggatcaacgaaggttggatcgtccacccattcaaccactccgactgcaactacagccgcaactgcacatccggcagtttcctcttcttctctaccattggattctttgtcgtcaacgactactcatcccaatggtcttgacgctccaacatctgaatcgtccttgaaaattgcaaacaatcttattgctaatttggatggagtcaagaaggaatgtctcaataagccgattaaaaagacccctgaagagatggacaacatgtatcaactgcttaattcttcactgttaaattgtccagactcatttgatgcagatgtgccaaacatgtatatccctagacaaccacaccctacccatatttcgttccctcaggaacctttgttggagattatgaactcggcaaagattttacagaactttgatttggagactttattctactgtttctattatcacagctacgagaatgcagctgatgaacataaggtattcgacaactcaggcagtttcctacaaattaatacggcgaaggagttgcatagaaggggctggaagtaccacaaagagctcaagacctggttcctgctcaataatgacgaagctaatcaaactcctccgcctattgaagagcacgttcaacaaaagagcaactggaaatactttgattaccaggagacatggcttcccaggagaaaagacgattttacttttgagaaggacaagttggaaacgttgtatctttgaaaagttgataatctataatctataactctttgtttaagaattcttcactgaaatgcgtaatctgtttgaaatttctctcaaatccagaagacccgccgtagtaaggatcctccacaatcctgtggaaggacttgtccgttctgtagtctccaaagagcctgactacggcattggagtctttgggctgtatgcgtttgagattggagagatttgattcatccatggccagtatgtagtcaaagtggtagaagtcgtccggcgagatctgctgacctctatggttcacaggaactccatgtttcttgcaacacgccacggaacggtgatcaggagtatcgtcgatatggtatcctgaagttccaaaggagtcaatctttttgaacttagagtcgagtcctttttctttgactaagtgggtgaacaccgcctcagccatggggcttcggcaaatgtttcctagacatacaaacgcaacggatatcggggccatctttgagggtggcaaataatgagtcgaaggaagaggagagtaagaaggaagcaaaataaattacaagtattcactccaataaataatcctcgcaatcctggtaactttgtcgagcattctaagacagcctattcttcccgcactatgaacttactaattaactaactacctaaaggcgcacaaactacgcatgaacagactcaaaagccttattaagtggcgatagaagttcctttcccttgtagaattggacgactttagaagccctgtcagcaaccccctcagcagtgaactcaaagaacttgtaaatctcagggcctggtccagaaataccaaatctgttgataccaaattgctcgtgagagtacttggaccatccgaaggtagacatgacctcgacagacattattggaacaccgtctggaaggactgataattggtaagatctagcctgagagtcgaaagtgaagaagtctggaatggaaacaaccgaagctttgacaccttcggttcctaacttcttggcaccgtcaatagcaatagaaacttcagatccagaggcaaccagaatgatatcagggttctcgactgggtagacagtgtaaccacctttggcagccttctcgatgctagagtgttctagttgaggcaagttctgtctagtcaaagcaatgatggaaggagtgtgcttagactcaatagccctcaagtaggcagcagaagtttcattcccatcggctggtctccacaccatgaggtttggaagagctctcaagtgggccagagtctcgataggctgatgagttggaccatcctcacccagaccaatcgagtcatgtgtagcgacccaaataattgggtgtccagacaaagcggacaatctaacggctccggaggcgtaggacacgaagttcaggaaagtaccaccgtaagctttgaagttggcaccataagcggagataccgttaatgatggctcccataccatgctctctgacaccaaatctgaagtatcttccagaaaagtcacctaatcctgtggattttggctggaagtcaacagcgtctggccatctggtcaagttagaaccagtcaaatcggcagaaccaccaaccaattctggcaattccttctcgatgctggtcaaaactatttcggacagctttcttgaggcaacaggcttgtcatcaaccgtgtatgttggcaaagccttctgccagttttctggaagtttgccatccaatcttctgtgcaactcctgacccaattctggatactccttagtgtaagctgttaacagtttgttccattcgacctcaacttgctggttgtcggcaacatgtttggcgtaagattcagtaacttctctaggaacaacaaagttttgttctggatcaaatccgaacttcttcttcaattgcttgatgtcatcaggcttcagtggagaaccgtgcacaccgtgagtaccttgttgaagagagccgtaaccaatgatggttggtaatctgatcaaagttggcttgttggtggtctttgccttggccaaagcagcagcaataccttcgaggtcatcgttgccgtccttgacgctcagaacttcccaaccttgggctctaaacttagcaggtacgtcttcagtgaaagagacgttggtatcaccatcaatggagatttgattgtcatcccagaaagcaattagctttaaaccgtctccgagatggccggcaagagaaatggcttcttgagcaacaccctcctgcaaacatccatcacctaggaaagcgtaagtgtagttgctgaacaattcgtagtttggcttgttgtatgtggcagccaactgagcttgagcaattgccaaaccaacggcattggcaataccttgacccaggggaccagtggtgacttcgacacctggtagttcagcctcaggatgacctggagtcttggagttgagctgtctgaagctcttcaggtcatcaatggtgtagtcatatccatacaaaaatagcatggtgtacaacaaagcacaagcatgtccgttggacaagacgaaacgatcacgattgatccatgctgggtttcttgggttgaaacgcatttgcttgaacaaagtgtgagcagctggggccagacccattggagcacctgggtgaccggagttagccttggccacggtgtcgacagccaatagacggatagtgttgatagctaagagatcagacattgtgtagagtggatgtagaatacaagtctagagttagtgaagcaacctgtgtctccctttttataaagaaaatgggcaccgtcgagaatacgagggatgattaatgtacttcggagtggtttctccctgacttccgaggggtgtctgagggttagtgggacaaaggtcgggggttctatggttcggactttgcaacaggcgcggggacacccaagatggagtagataaggtgggggtgggttgttggtgcttgaaaacaaagtgggaatggcttataatagtcaccgagaagttgggaagaaggtagcgttcacagcgattcctatagcgtgggtagaccagcgaaagaacacgaccgagaaaatctcccagagctaaacagagtagggcagatccaatctgaggaggtggttttgaatgaatttccgaaccgctctgctattctgcaagttttttagactgatttcatgcttacaaatgatactccgtgcaacatccaccaaccacctcaacttccaacgtccaagtcacgtgaatagttgttgagccaccctcggaattcatgatattagttcatgacacgaccttatcttctaacatctggtgcacaatttcagctatcattctcatacaaagtgtagagggaactggaatgtttgataattttgatgtcaccaacaaaaaggcaattattacgggtgcatcccagggtgttggagccgagtttgctaaacttttgtatggaaaaggatgttccgttgtgattgtggctagaacagaatccttactaaagcaggtagtaaaggacgctattgatattcacgggaccgagaagggcaacacaatttcttacgtggcagcagatatctccaaatatgaccagtgtgagcgtgttttagaggaagttggttttagtcccgacatagttttctgttgcgctggctcctccatccccggacttttcttagagcttgatgaaaagactctgagcagtggaatcgatatcaattacaagacagcgttgtacttctcacatgttgcgctcaaggtaatgacaaaggtagaaaagccctacaaaaggcacttggtgttttttttcatctgtactggcattctattcgttcattggatacggtcagtatgccccaatgaaggcagcattgcgatcattgagtgacatactacgtcaagaagtgtcgatacacaatatcaaagttgaatgcatatttccaggaaatactttaagtgaggggttcctggaggaagagaaatcaaaaccagaaatcactaggatcatcgagggcccatcgtcaccaatctccacagaacaatgttgcaaaataatctacaacgccttgcaaagtgggtatcagtacgtgactacagatttcatagggtatgtgctgatgagtgcatctttagggggcagccccaggtactatggcgttatccaggtgataatttcattccttttcagcatttttgcaccaattgcctctatgttcgttaacaaacaaatacgagactacttcaagaaacaaagcagaatatccccatcgtcatcatcatcgccatctcccgagagagaacaaaaagataagtagtgtcgaaaacttaattgatctatttaccctcaactttatccaccagatacttagcatcctcgtaccatctaatgctgtaaattctgttgactgttttaatgacctcctcgttccacaagtctttgaatgcctctttccatggtcttgtctggtattctagtttattgtccgtgagtttcagttggtcaccttcgtttatgagtttttgataggagcgcagccttgttgaaatccgaacttggtcagactggaattgttctcgtgcaagatatgtaagggacgaggtaaacagagcaccggccaggaacccgtatattcttccacccatgtcaattctgttgtatggagtgaggtgaaactcaagacgttgtgtttttattggaggtcgcgaagttcaccagaggtggaaggagagccgtaaccccctagcaggtcaaatgtctttgctcctccctcccaagttgcttccgacttttttttttcttctcctcctagactcttctcgaccccagcacaacttttttgtctacacatttttcttttcaccaacatgggtttaggacgatcagtcaaacatgaatgggcaatgctgcggaatttggcctcatccttaataaaaaatgagtccatcattacgaccaaggcacgtgctaaaaaaactcaagcgctggtggaaaacttgatcacgaaggccaagaagaactacgacaagtcgctcattttggctgatatatttgaacctaatgtcacaattccaaagttgtataatgttctcaaaccaagataccaaagtagagctggtggctacaccagaatactaaacctagaaccaagaatgaacgacaaggctccccaggttataatggaactagtggacaacactcaaagggagatgaaattgtggtacactgccaagatagtggccagattggagctacagaatatcgcaattaatcctttgactcaaaagaacgttgacaagttgctacataacagagaaaacggtgaggaaaaattccgtgaaattgttgaaatttgtaagaaggagttttactcggaccccaagagtttggagaacctacctagaatgaggaatgacataaacactttcaagaagagagatcatccatacaagattgttccaagaccggttaaacgtaacaacgctactgtttctacaagctcttaataatgagtgatagtagcctttttcttaacttttccttcagacataaatgtacatagtgaatacaattctatttagcaaagttttcaagtagctggttggatttgtagcccaatgacttaactttatcgctaacctgttgataaatcttggtcgacgtgtgattaatgatcaacttttcatcgtcaagtgtagcattcttcaagtccaaagaagcgataaggtccttcagctcttgcttggtcaaattcaaagtctcggacaatgcttccaaactgatccttccgtagcatttcacatagacctgtatgattaatttctttgcgttggtaatgaattttttggaaataagaggaaggttctcgtcttcgttgttcaggaagaagtctgtcttcaaaatcacttcacagtcgttcaagtgctgactggcctgggcaaaatcaaagtccaagtataatgctttaatcaaattagtaaaaggatccgcgtactggtagctttcttgagcagtgactctaaccagatctttcaatttcttgctgttgttagaaatgacagcaacaaccaagtatctcaacacccatggacaggaagcttggatggtggacaggtaagacgaactgaaaaaaagatcgcacagagtctctaatccattggcagtcttgaaataagggaacagagaccagtggataacccaggttctgttgtataactgtaagagtggatcgttaaaagaggttcttgaatcgataagctccctcagctttgacagctcttctaacgcattattccattccaataacaaaatttcgcaagccaaacgaccccatgtgctgctaacgtttagctcgttgtttgtagacagaatacgaaagttggccaacaaatcgcttgccataacgtagtcacctttgttgtactgaatctgtccatattcatacaaggcatgaatcttatcctcagtgatgccatgctgagactccaaatatcttctattgtgattcttgtcagatttcaattgttcttgcacttctttcttactcaacaagttcaatgtttcctttgtttcggcttccaaaacttcagatttggcttcaatttccttttgcttcgtcaagacatcttgagaaatctccttgtctgggttcaagtcgttgatgaacttgttcatgtaggtatccctgagaagattgtatgagagttctttgatggtcttttcatcgtatgtgaggtccaagttttcaatgagtgggtaaatcagatgacggtccaagaagggaattatcttggaggtcaagtcgaacttctttgcgacctcaatctctgctggtgttagctgtgccatgatgtagtatcagatggtttggtgaagatttttttgcttgaaggatttgttgattatggttggcgaacgaccttagctttgccaatgaacgcgagaagagtagcattgacgagatggagaagaaaataacggtcggctatttggcaataaccggtcagaatgacttgtctgtaattgtttctgtgtcaaagaatctacttataaaagagaaagcatgttagaaaggccttagctggtggactacatggaccaacttgcaaaggtgcgcgaagaagaaagcatcgtccgtccaaagaatcttcttcaaagagtgatggctcagccagctgattggcctccaatagctaaacacgaattacttaccgcaaaactggtacatagatgatttaccaagtagctttcgtagatttgcaccgtatgttcacagctgggttctgaaaattgagttgaatcaggaacgcgttaaccccagtctttcgtacgagctcttacaaaaaaagaacgcgcttcttcctctcaacagaactttcaccaaatgacgcaaatagcgagttatctggcgacaaaactctatgaagaaaagttgcccgtgacctatagaatgctcagtagagagctttccattgatgtccgccgctcaaaggaagaactagctgagttttataagaaagatgagaaactggaaatcatttacgcagtatcaggcatcaagaatggcctagatattaagttggtcggtaaacaggatctggagactgtgaagcagggatacgagaaggttctttctgtggcttgctattcattgtcaactagtggcgttggtgcccaggaagttgccaatatggaaggaatgaggcgaaacgagtggttaaatgcagaattgcaaagaaagctaggcattattgaaagtccatttcacaaagaacaacctgctgaacaaattgagcatgtagaggaacaatggccaaaggtggacgtggtaaaacaaccggctccaaaacactctccggatccaaagagccaaagtccaaaacctcccaagaaaacagaaactatcccatccattacgtccaaatacgtatctaggaaaccccaaaacagcaaatcctctgcctcagtacaaaagaccattccgacttcaaaagctaagccaaactccaaatctaaaatttcatacgtttctagaaaagaaccaaaagaatcgattgtggctggagacatagaagatgataattccttcccgttgaacgagcctccaaggaaaaagaccaccgaagagatcaacaaagagaggcaagaattggctgccatgttcactgatagtgatgacgagatgcaagacacacaggttattcaagaggagtctgccccgcccaaaaatgaagatagtttgtttgtaattgacgatgacgaggatgaaggtggtgaccaagcgcatgcaagagaggatgcgaatcccgtggatcagatggatgttgaccttgcctctgactttgacacttccattcaggaagttaaccccccggtggccagtaatgagccctcacaaaatgaagtggagcagtcaaaggaggcgatcactagttatgttgatgaagacggctttattacgacagttaaaaatacaaagataagcacagacaaatcatcgaaccccaaatcgtccagttcgaagccttcacccacagttgggaccgtcaagggcaaatcatctaagaaggcccaatccaccctattgagcttttttggaaaaaaatagtatttgaagtcttctacaataatggcgtaaacttaaataactgacaaatagaccctgagatgtcaaatgctgagtcagcttactccgtaaaagtattatgcagcctattatgcgcagtgcttctccacctcgactatagctagaaggtagtaattgttagtaatatggaatattcgcgaaggttcgatatgcatgattctgatgagcccttctggtagcgagtcctatgtaagaactccttagtaaggttaactaagcaaggaaaaggtataaatacccctcaacttgtctttcatcatcaaacatgtctcgttcagttttaaaaagtttctattgcaatgaagtctcagaaggtgtgggtgccaaagtccgtaggtcaattggctccatgcaaatgagaaatttcaaaccgttcttactgctagatcatttcaacgttgacccaagtgctgggttccctgatcatcctcatcgtgggcaagagaccattacgtatatgacgaaaggtcaattcgcccaccaggatttcactagcgacaaggttgggatcttgaatgccggggattgtcagatcatgagagccggaagaggtattatgcacgccgaaatgccagttcaaggcaaatcaggagaaaacatagttggaatgcagctgtgggttgacctaccaaagcatcttaaacatagtgaacctgagtaccgagatttaagggcctcagagatcccgacagtaactccaaatgataaagtcacagttaagattatctcaggaaaggcctatggggtcgaaaacttccaagatttgtcgtattctcctgttgactattactactatactgtccaacccgggggatcatttgaacaaagcgttggtgagaactacaactccttcatctatttacttgacggtagtcttgaaatcaacaacaaaacatatgataagttcaatgctctgttctttgacttgaatggaaacaagattaccggctccgtcccagaagatgctacttctcctgctgagtttgttctcgttgcgggacagattttagaccagcctattgttcaacacggcccattcgtggagacttctaaagacctcatctacaaagccttcatggactatcaaacagcctcaaacggatttgaaaggggaaaggattggagatccaagattgctgatggtgttaaagaagacgatttggctaagttgaagtaattattttactactatttgctacaccacctttatagctcttatttatttactctttgtatttttatcaattattgactcacacaaataaattacaacgtttggaaaaccctgttcaagatatttctagatttgtaaagattccgaactctcagtctctcgttatctaagtgggcattgtcggaagcttgaccacagggataatgtattgctggggcaccaaaggccttttcaaggaacctaatggaaggaatagatcctccttctctgatatacaatggttcaatgccccattcgttgataatggcattttccagtacttgaaaaccagtatttcttcgatctcctaaccatggctctgcttcatgggttatagaaatcttgcattcattctctgtcttcaaatccttaaacttatcctttaagaaggatacaagcatgtttttaaccgattctagattttgttctggtgttatgcgtaatgatatagctgctgatgccatttgtggaatgatcgtattgtttcctggaccggaaactgtcaccttatgcacagttaatgagggatatctccatttggccatcaacatttctttactagattttatctttgctctctccaaaattcgttcatagtctttttcctcttcttcagagggtggattcaagccatcaaaaaaccctggcaaaagtatccttccttcatcagatgttaatttagaaatcagttttacgagatcaacggccggttccctagacactcctccatcaaccccagaatgcctgtcaggtttatcactagatatttcaactttgacaccaacaactccacgcaacccatagtttatacagggaaggtgatcgtcaatccaataagaattactaaggaagatccaatcaatctctccaacaacgtccttataagctccaacggcttcctggaaaccaaaagaggctgattcttcctcaccttcaataaggaaaacaacatctgactttaatgcatcttgggaaaagagctctgcaacagaataaattgcagctaaaagtggacccttattatcggttacacctcttccatataaatacccatccatggcagacatcttaaagggatcttgaacccaaccgttggattgatccgcacttaccacatcataatgaccataccagagaattcggcttggtttctttttagcagaattaattacttgtgctgggaagcatgcatgaatgataggattaccgttcttcacgggaattagctgagcagtagccccaaagctggtcagtagattaaccaaaaaggaggcacatcttcgggaatcgtcaataaaaaattgaggaagcttcgaaacagttttataggacacaaatttggctagtgtttgtaataaagagtcgttgtccaatggtagaattgactttttagataatgaaagtgatcgtcttttagatgcagaataaaccccatccaaagaccacaacgcaaggcggttattaactccgcctgtgataagatagggatttccttgcctttcaaaaagtttcacagtaagagcatatccttcatgagtcacccaatctgttcttctagctccttgcagtttccatttcgtgataccatgttcagttcccttgaaaaggcaatcggcgtaaagtgctaaggaaagaacatccccttcatccgtcttggtggacctgattagctgaaaagttcccaaatcccaaaggtttacttgtccgtctactaatccagcataaagaaacgaccctgagatgaccatgctgagaacagaatcctcgttatcaagttcatgcaacgccactacggatctatctgaaccaacaccccacagtttcacgagaccatcccctccacctgagactaggatatgattataaatattgggaatgttaataaatatctccacagtttctggagttctcttaaaggattgcatagcatacacgtaaccattgtgcgcatatcgtaaaatattatacgtgtcgacctcgaccaatggagaagtgtgctgtttgttctttttactttgtttggggttcatgtttccgcctggacctttcgaatcaaaaaagttgtcatatctgtttgccggcagaaaacttgggtcgttcttccaggaaccgtctacctcgacataagcgtacaatatacaagcattttgagttccaaaaaaaaccatgttcaagtcttggatccaagttatgctaaagatgtcgccaatgtccattaatgaataaatagtgaaccgttcagtcatggtttccaagtcccaaattctcagaagagagtcacttcctcccgagaaaagaaacttctcatttgctgatatttctaaacacaaaacggcaccttcatgagcctgtaaaacgtgaatcttttcatatgtgttcagatcaaacacaagaatctttgcgtcttgagtgccacagaacagtaatccacgggaagaactaacgctcacacagacaacagaatactcatgattccattggtgtaccaacgaaggattgtctgtcagtaatggatagttggctagactttcaacgctctcattgtccgatttcaaaagctctggagtgaattgcttggtcaacgaagaaaaggaactgttaaagcaggacgacgccgtttttaaaggcagttgcttggacacatggttattcccgtctgaacctatcacatccaatgggttcattgtcctttggctgttaattgacagggaataatgatgggaaaggaaaatatttacgtctgcagtctgcagacttttgttagcatgatatgctagatagatatgatcacgtgaggtttagtcatttacattttggtggaacttacgattgggtgaaagggcttggtaggaagactagagacgtaggcgtcgcctttgcttagtcacgcacgatggaggttcaaatgcagaaacgaatgctgtcacaatgcagttctacgtggattaattttttatttttgacctttgtatgtgtcacagataagaagttaattttgcctcgtgtgcgtgaaaacacgaaccagttccttatggaaaatgcatgctacgcggagcaccactgacctagagaagtcttacaggaaaaaaaaaagaaaagaatgtcgacgttggatgtctgtattgaatattatgctattttgactctatgcttgtgaatcagttaaaatctttgtctcacagttgaaatttctatctttcatcgtgtagaattgccggcactctacgattctaagttcgcactccttcatggtctcggcatctccgatctttccttgtacggcaacgccaagtttatctacgcacagccgtcgagtaacgtccaacactttctccatgattgtcaaagcgttgctcactgcaggctctatgggttctccaccgggcagtctatatatcttgtcaaccagaagagcagaaaaaagatctcctactcccgtgaaataactgtccatgtatggtatcttgaaaaaattaggcttcttgtaagaggttttggtggaactgacacagtagaaaaaatccttattcttagtgaacgaaaaggtggagatgaccacatgcataacattaaaatcctcgtgaaagacctttaaggctttcctcaaatcatcagtgttgttaatgctaaaaccaacaagtagttcagcctcgtattggttaggcgttataatgtcgacttttttgtagcccaagatgcgtctataagcgggaatcacatccgcgctcacatatagctctccttcgtctcccatcaccgggtcaagtaaccatagtatacctggggttcgttctttcagatccaagcacaccttgcccatcgcctcgactccatctgctccttgaatgtaacctgttaacatcgcgtcgtattggacattgatatcctgcaggccttcataaagagatagaacttgttcgccggttgttgcttggcctttgaagcttccatagccggtatgattggaaaagttgacagtgttcaacaagtccacatcccaatactggcattgtagtacaaaaccagcaactttgttgccaacatacccatgcgcaacatgtgactgaatggatataatcttgttagcaggggttaccataccgcttcaaagctttgacaacttgcaataatctatgactgattgcaagagaaaaacggccttgaaaaaacaataagatagcgaggacctcatctctacatcttaacaccaggtgaaaacaggtggtttggaagtgatagtttctaacctctccacgatgagtcttcttgtagccgtggtcggcttttgaatggaatcagtgttggcccgtccaggagtatttgcatttgaactaattgcgtaacctccacgatcagtggacgcagccgaagaaaagggatcatccaaacactcagactctggtgtggttggttcgtgttcatgataccttcctggtgagttgtgagcaatgttggagctccagtactcttcatcataattttggtatgtccaaacaggagagtcattatatatatcaatgtctctaggaacgtaggaaactgggatctccacgacattatcccagaccattattctggttttttgaacaagatctaatgggctctgacctggaattttaagggtttcaaccacattgaaagcttgtccctttagtacggcccattgacgtctccacattctctccttaaactctgtatctctcgaaaacatttctcggaatagcactgaagtttcttcccaccactctttggaagtcaaaagaggaaggtaatgccttctggttctctctgagaaaggccttgcaatcactgatgttggaagatacaaccaaccaaaagggaaggatctccactcattaggatgcttccaagggaatgccagcccggagtctattgctctaactttcaagttcggcctcttataagcctcgttcgcctcttcatctaagtattcatcccattcgaccttgatcatccaattgtcaaaagctctgtctgtattacgtatgatgtaatccagaattaccagtttttccagctgttctcgtaattgttgtaaggtatccctattccactcaaaaacagtgtctttgtcaaaaatagaatgtctagtatcacctctttgtctctttttggaagtttttttcttcttgtgtttatcgggtaaaaatggcaataggctccttcctttgtcagctggcaagggatactttttgaagaactcatctgctcctatgtatccgtttaaatataactgaaatgaacccaccttcttgcgatacggcttcttagaccaagcgtgagtacacctgtcccaaaatgcgtagtagaaactactggacgagagtagcactgtgtctgtgtagggaacaataaaagactgcaactggcgatccaaaagactcgctgcagattctgcaatatatcccaaattagggattagacaacttcgtccaaaaaagcaaggaaataagtttcgatgaatccatttggtccatttagggctcaagggtccatacggttcctcgtcctttggtttaaacactcccactatcttcccctgcgtattgtacataaaatatgatcctgaagagccttgtgaaattctagttggttttatcccctgttctatggcatcgataacgtcatctactatatgtgcaaaatcttctcttgaagttggacccatattcatcaaccctcccgctggaagtcttctaagaggctgcacataaggtggtgccatgaaaacactgaaaaggatctcactaggctgcccttctacatcctttgaccgtactatccaccatttgtatgaaagccctctggtccactttcctagtttcgtgtttaaggacttcaacttgtccgtagaaagtagtgaacgcgttcttttcttcttcgacaaaggtgatcggccagcaccttgggaaggactcgtagcattgtaattagggctctgcgggagaagtgtgtccctctctgatggggaatgacctagttgctccgtgtatacattagctggatccggatagttttcttgtatagagctattggacctcagctgtacagatggatccagattcaagttactagcttccgctagtgacaccccagacaatggcttggaatccatactcagtatagtgaactgtggttaaagctacttacagaatcaacctcaaaggaacaaaggcagatgagatccgagatgttgccgagggtcgggatcgaggacaactataatatactccacaccatgcttatgtaacaatgcgatctacgtctccaccggtgtcggtccagccatcaccatagtcatgtcaatcttgcccgtcttaggatcggtggcatagttcttgatagctgctttcatcaatctaacggactcccgaacatcttgcaaatcaaccgtttctgaaagacgcatcttggcgtgggcctcactaagtctgatcattgactctaattgtctggtagtggctgttatcctcttctctgatgatctgggatcgtctcctaacattcgcatttcaacataagcacgtacaagctccacttttccctcctccgtcatcactggcgtgaagttttctttggcatattggatgtaggatgtcagaatatgaattgggagaatctcatattccgagacattctcgggagtgtcttccaagtacatttgtgtcatatgttgtgctagtaggcgatcagctttttcgtccactttgtccaaaattaagtagaccaaatcgaacctggacagaagaggaggaggaaggtcgatattctgaaccactggcaaatttacatcaaagcgggaattgacaggattggcagaggctagaattgatgttcttgcattcagcgtagtgataatacctgctttggcaattgatattgtttgttgttccattacttcgtgcaagaccgaccttgtagaatcggacattttatcgaactcatcaatgcaacagataccaccatccgaaagcaccagagcaccagattccagaacaaactgtctagtgtctacatccctggtgatataggcggtcagaccaacagcagaagacccttttcctgaagtgtaaattcctctcggtgctatcttgtgaacatattgaagcatttgagacttggaagtagaggggtctcccactaaaagtacattgatatctccacggtaccttcctcccttttcgaactctttatttgttcctccaaagagttgaagaagaattcccttcttgacatcatccatttcgtagatagatggagccaaagagcgagacagaacttcgtataagtcaggtcgttcagagatttgatgaatcatttcgatatcttcctccgaaagcttcttcacttcttccacttcctgttgctcagagacttcattctccaaagtcgatatatcagctgccatccgttttctgtcaaccttctttatatgaacaacatccaaatatgttttgaaaagagccttcactgttctttggatagcgttggtacgtactggaacggaacggaatataccacacacttctactctatcaccagctctcacagtatcaaccagctcatcgtatacgcatagagacacggagtgaggagtttgtccatctggtaccaaatcaggtgtttcttgcaacttaataacttgcttatcggcaaatgttgatcggttgtggatcaattgcattgagtttgcttgcgcacaaacttctcggggacattttgtgggctcttgaatgacacctctatcattttcgacctccatcgtatgatcgcagacagtgcacttgaagaaggcaattttcatatctggaatgattggtgtcgatcgtatgaccaaacccttcacactgaccaatttgtcaatatcattaggattgagctctctcatacccttgttgtcttgaagattgtagggacgaatcttgtaaatagtggtatcaattctagccacttctggatcctgttcatctccattgttgtcttcaagaattaagttaatcatacagtctttgatggtctgatccataatgggtatcacttcttgtggatagtgaatcaattggtagtacaatttcttggtaaaactatacgccagtaagtttatgacatcgagattcaggttacttgtccccatttctctcatttgattaagcttttccacatagtagtttctttcgtcttcttcttcaattgaggaatcatctagaatttttcggtacttcattttgaaggatagcaaaaaggatctgaagctattcgtacattcgtcaatggacacgttggtaccccaaatgaccctaacaggctcttcgctgtcaacagcatccgatgtgtcagaacctaaattagcgatcgaactactacggtctccggaggatctattgtcattttgttgagaaaaaaaccttcttctcatgggggatgagctaaagtctgtagcgttgatttcgcctcgttgagggtttcttttcctggcagagctctcctctccaagagaagaactgaaatgcacaggagaggacatccttgtagcacggcttcttgcagaagcgctggatcgtggatggtctctaggtgtatgtggcctatcattatcggaactcggtgggaagaacaagggagaagagggaacgttggctggacctgctggagacgacggaatgggatttgagtctctcatagtggagtcaaaattagtattattggagtcatattgaggtgaggagtcaatcctgcctgtgtctctattaggagaagaggatcttgacattgctgagagtgaaggctaagactacctggaaacaaaggaatactacgtttgatgaaaggaaagtacgatgagatattgtgccaaaacgcgcgcgcacgtaatttatcacaaacgttagttgaaaaatattccctgatcaggaaatataattgacaaagactcagatttcatatcatccggcacgtgatgcatcacatgattcataggatgagtacaccccgtatcctccaccagagatttaggctacccacctaaagggtgccagtatctctcaggaagctctgtcggttataaatcgcatactcttccaaaaatcctcctcaatagttcatgtctgttgcaacagagaacactgtagtaatagaccttaggagtataccgggctacgaacctgttccactcacggtcagagtccccacagtgctgaccttagcaggaagtgatccgtctggtggagcaggtatagaagctgatataaagactatatcagctttccactgtttagggcttagtgccataaatgcgctcactgcgcaaaatacaacaggagttaagaacgtgctacaaacggatgaacgttttctaacacagttacttcaggctctgtttgaggatatgcgaattgacgcaataaaaacgggaatgatgactagcaaagctgtcaagttgcttccattctacctggacaagtttcatagaggcaaaccattggttattgatcctgtcttatcttcaacttcaggttttgatctggggaagttagatgtcttaaagtcaagcatcagtacatttttcgccaaagcgactgtcatcacacctaattttatcgaagcaaaaaagataatgtgtgcgattcagggcatatcatttgatacgtttgatttgcctgttaatggtatcaacgatctaaaggcccttgcgaagtttttacaacaaaatataggttgtcaatcggtactggtaaagggaggccatataccctgggatgaggactttagacccagtgacattactggaaaaccccccagatatttaacagaagttttatatgaacagagtggtgatgttacagtattcaaatctgatttcaatagatccaagttcacccatggaacaggatgcaccttagcgtctgctatggcggcaaacttggctagaggtttatccatttctgaatctgtccaattgtccatttcgttcgttcaaaatagtataaaatatgccgacaaaagtttaggtagtggtaccggctacggtcccatgaatcatttatataacatcagtacccctgtctgtttgggtgttaccaagagtaacttgcctttcaatgaaggacacttttttgatcatttaattaactacccatcaattgcaccatggtggaaaagatatactcaacacgatttcataaagcttatggcaacaggtgctttatcacagaaaagtttccgccatttcttaaaacaggggaaactgtatctggaagtctacaccaagatatatgctaaaacagtggcattagctccaagtttagatcagctacaatcaaacaccattgtactcaaggattgcgttagagaattagctcttcttggggatagactaaagttgcttggggtagacgcttcaaacataaaaatgtcccccgcctgcaaagattatactgaatatttgatgtcagtggcctcttcaactgacgattggttgacgataaatattttattagcaccctgtttacacggctatcatcatgccacgaaatgggcccttcaatttgttggagaccagccttcagagaattggaacctgaaatggttgaatgattacgtatccgactggtacgtcgattcatgtgttaaaggaagaaaagttctggagaaaaatgcattagagttgcaaagtgacgaacaattatctactctgatcgatatctttgagcagggaactgtcttagagtgcaaattttgggatgaggcattgttaatgggccaagataaactgtgattggttcacaaagtctatgatacagaatattaatatcgacatactatacaaaaaattcatgcctcctcatcagacaccagcaacgagtaaggattacttgacttttccttttcaagtgcttctttttctttttctttctctttttcctctacttgtccaaatgtttccacttccatgctgtccaaaagttccttgtcattatcctcctgcctctgggcttttgtctttctattcctgctgaccacttcaaacccgtcatctctcagtttttcgagctcttccttggttactttatcaatggtgtcccaagacgactttctcagaaattggacattcttgaatctttctatgctgtgttggattttggtcgacaaccttccaccagaatccactctgaatgagcgggaggactttgaaagtgattcctttgagattttgttcttggatcctcttttcttgttcattttctgtgataatagactctcattcttagcggtggctcttattatactgttggcgacgtctgtctcctgtgccgtgggaatgttctccaaggactttatttctgcatccatagcaagctcgccccttctggccgctcttgaatgtttggaaacttttctagccattcctagggagacgttagctaagggaaaaaaaaaattcagatccttagaaaaaaataatactactcgcgatggactctaggccagatttggtctactgctgccacaggcggttaagcttttcccttcgagacgttagcgagcggccgtgagacgcctgtcttccaacaaagacttaagatttgaagtattttcaagttatggcatcggtagtacaagtccggatctatgcatcacacattgacctctctcatctttgacagaaactagtggatgcaattgacttgcaaactctgcaaaggcaatttatccggccggtcccaataccaacggcttcagaaacaatctgtaagtttttctttttcctctgtctttagttgtggtaccatatccacactcgatttggcgacagaaattactcctggaaattaccactatttgctatggtatactcaattaaggaattggactccggaaaggcatcatatttcacacataagcagcctcagaaaccagggtctccacttaaactgactagagataccccgaagctgtttactcccttgaaaatcagaaacatagaattgcccaatagaattggggtttctccaatgtgcacatattcagccaaagacggtgtggctaccccctggcatttcgcacactatggaagtcttatgaggggtgctggagtaatcatactagaaagcactgccatcaatgaaggagggagaacaacggccaacgaccttggaatctacacccaggagcaagtcgaagcgctttccaagatcacagagctcgcacatagtcaagatagcctaattggaattcaattggaccatgcaggcagaaatgggtcaactttaccattgttttacagcctccttggctctgctaccaaagatgatgatggttggccaaataaacttgtagccccatctgcaattcctttcaaagaagacttcccagtgccaaaagaactaacccttaaagaaattgaagaattggtgaaccagtttggagtatgtgccaaaaactcggttgaggcgggttttgatttcattgagattcatgctgctcatggtttcctgattcatgagtttttatcttcatactctaacaaacgaactgataaatacgggggcagttttgagaacagaattcggtttctactagaagtcatcgataaggtcagacaagtggttccagatgattatccaattttcctaagaatatcagtcactgatagcagagaagatattgttgagtcttggaaactggctgactctctcaagcttgtggacattgtgcttgatagaggaattgatttgattgattgcagcaatggtggcgttatatttgagccaaatccaggaccaactcacagcgtgtcccaaagagaagctgccatgattataaagaaacacattggtaataggggtctggtggcttcagttggaggaatatattcggggactgaagccaactctgtattagaagatgagggcgtagaccttgtcttactgggatcaagattcctaaggcatccgactactgtatgggattttgctgatgatgtcgaagtagatatctttgacagtatacaacgaggctgggccttccccccctaaattccttaccaatgactgattgcaagtaatctatatacctttaattgtccgtacttgttccatgtctcccccctttatgaccattgattctcgtattgactcactgatgatttccaaaactttctcagcatgttccctggtcaacaaatcattatctgtatctctgatatacctgagactaattaagaccttgctgccgtaccctttcggtactccactcaaaccagcaggtccagtgattagatcacatactaaaaaaacagcggctcttctcattacgttctgttcttttgatgtttccaattgtaaaacaccgagcacacaatctagagcatcggttatataatcaatgatgcaataaggggccactttgcaacacatgcctagaatagacattgcagacattctaagccgtatgtccttggtattctcatcagtccttttaataaccgataagacattagaaacaattagcttgcccagttctccaatcgtttcatttgccgtggtaatatgctttagcaggacctctccaatccttagtctttcatctaggttctgcgagtcatcgacatacagtgacaccagaagtggtgcaacctgctctttattcaactcgattaatgcttccaacccttttattacgttcaagtaaacgaatgggtcctcgtccttaagttgaatgaggtgaagttgcacgacaaaatcaaccgatataacctcagatttgcgttcgatcaattgtctcaacatgtataacccatgggctctgattggaaccaaaggatcatttaaactactgatagctctttcaaacaactgcttatcttgctctttttgagactttggcttaggcggctccccattgataattaagttaattcgttctaataaagcttgtgtggcagctagtttgagatttggtaagatagtctgaatttctttcaactctttgattgaaccttctgaaaagttggctacagacgtttctgagatcactgaagacagaagctccagaaccatctttaaggtctccttgtcagttttttcatcttcgtcttcatcgtcagagtcaacatcttcctctggcttgattatgtttgcataagatgtagttgctggaccgacattcttcagaaagcttttagtaatcaccagcagttcttcaggttcttcagctagttggtccttgaattttgaggcgattgcttccaataatcgaagattgatgagtattttaaatggattctcgtcagcaatcagcgtgtgatttccattaagccatctttgaaggacatctaggaaaaccttattgaccaaccctttatctaagtctttcaatagagacatgtaaagttttaacgaagcatccaaggtatcaaaaagtcttgatgtttttgttgaatctaaagatttgggagttcgtataatcattggcagatcatttggtcctaacttaaactcccaattttccatgtttgttatcaaattttgagcaatctcatttagtagctccacactgttaacgatagtgaaaaatgagaccaggacacccatcatcacttttgttgatttccctttttgttgcaaaaaacagagataattccatagtggaatcaaaatcggggaaaacagagcgataagaaacattggttcagctttttgggcaattgaaataattacattgattgtgttattgaggtctttttctgatatcaactcttcattatccgtagactttggatctaaattatcccagattttttgaaacacaaagtccttgatgattaggctattttttagatagatgtgttccagtatatgtccagccactgaagttaaaactggcctgtcaatgagaattagtatttcgtataactgcgatcccaaaactttaaagtactctgtagacgaaatattggttggcttactgagtaggatggacgttacttgttcgattttctcaatatcaatgtcctcttcatctctgagaccacagatatactctatcaagcacatgacaccgtcgtttcgaaacagtggaatattagatagtcttgtaaggacaaataacttgaaatggggttgttgtgatgagaccaaagaactgtaaaactttataagctcaaatgttggacatagctgttcaactctatcaaacaatgtctgataggttagattagaggatgtcgctggataagacagtaaacacataatggcacataaaacatctgagtagccggttcccgtcattaagaagtccttgacatcaccgtctgcctctaagatcttcaacatctccccaatgaccatgtttaacaacttttcaccatttggaagtcccagtttcactaccttaatcttctgtgatgatttcaagaaccgtttgggtagaggtattccaacacctggtggtaaacatgaatatatgccttgtataacaatgaagttgaccagcatgttgaaagtcttcatgtcatgcattgaaattgttattagattatgtttcttgacggatgcattttgatgtcgctctaaattggagagagtatgcagctgtactagtaagcttaataaatattgtacaacctgatatcgggactccttgggtggcagttcttccagtttgtggctctttttcaagattgactgaacggcatcaaatccatcgccatcaataaatagttcagaaatttccttaaatagaagatctaagggtttgtttcccaaaaattccggtttatgaagccctttatgttgcttatattctacttggggcttcttttcagacatttggcaagaataatcctggtatttgccatagattggataaacagtacagtactagaaaggaaaggagcgaaacggaagtccttcttgctggatggataatacatagtctagaagatcaatttcaactgtttagctgcaacttcctaaaccaacagcccaaaacgtcgatgaatatacctagcatccttataacgtgggaacaaacccccgatctaactagtcatcctagaacggatccgatactgaagtctcaatgaacatccatcgtagatctcgaatgaaaaaaaaaaaagtgcattgcattctctcttccctactgctaccaataatgatcactcaacttactcaagaagaagtcgatattctcattgacgaggcaagatatggtgagctagactcgttgaaagaaatttttcagcaaatagatcccaaagttctcctttctatacacaacgacatcacattgaccacacctttccatatggcagcagctaatggccacacaaaggttcttgactatttgctaagcctgatccccaaagaggaagttaaaaccgttatcaacaagcaaaatgaaagtggcagcacagctttacattggtctgccttgaatggacatttggaggtagtaaagcttttgtgtgaaaagtatgatgctgatccctttatcaagaatagtgccggtcatgatgccatttacgaagctgaaatgaacaacaaagaagatgtagaaacttactttctagagaagtactctgttgagccagagaataatcacgatgacgacactgttgagttcaatgagggcacagagatccaaaatgcaacaaaggatgctgtagacagtctttccaaggacgcagaaaaggtcagtattaattagatagtaggagtattaatggtgcggttggtagaataaaaataactgttaatagccttcctcttttgagcttttacttcttcctacaagcgctcccttctggggagttccttctagcgttaggtgttttctccccactctgcttctcccctgattcgagaaacctttgcatgtcacccgcacttctccagacctctaaaacatctccatcccagcttccatcccttcatttaaacccttttctttcaacatggacgacaacagacgttgttgggtctgcctgggggattttggtgaaatccctcccatgggaacagtgaagcaagcccatgaatggatccaaccatgtacctgttcaatggaggcccacagggtttgcctggctaactgggtttcctctgttgttctgcaagagaaacggcccacaaggcaaaccaatagaaatacaagctggctttttctaatctatggaagaactcaacaagtcgagatgaaatgcccgcaatgtcagaaaccaattatacttcatctgaagccaactggtttcatttcctctgcctttaaatcggctgagtattttgttggtgactttaccaagttcgctttggcatccacactgctaacttcagctgtaaccgctactacattggcttcagtaggtgtgctgtctctcacaggaatgagaatcatgtcctcgttatgtcccaacagtgtgatattacgattatttgacgtcaaacaacgaataggtacattagcctcagctgttcagaacggctatcttcctgcctccagggttataacctttacttcaaccattccattttacctattgagtctgagaacgagatattccagaatgacagataatgaaatacttgtcaatgttttccctttgtcattttttagtgaaaccaagtaccttcttaacttttcaggaataaatgagagtcccaaaaaatggtttcttttgatatccccagtcagatatgcatacatgttattcttccgcttgacatttaatccctgctactatatgttggccaagagaacccgacctggatttattgccaataacttttcggtacaagaaatagatgaaatggaaatagaaaataaccccgaaaacattcccgaaacaacttcctctaagcaaatggaggctagtatcattttgtcgatcagaagttggctgatgaaaaccaaaagaaggttcaagattcgccgtataagaaggatgtttattagttgcctcaagacagactattctaaagcttttggcaagagttccatgttctttcttattggttccaccttgatatggccagccttgggggagttcacgagttcaacactcctttcaaaactaccaagtctaatgcgtctgctaaacaagcatgtctcgtctcccgatgaagctatatttgttcgaaacttgataggatgcttggtggttgtactggctaaagatgttaccaatctctttctaacatggagatcttgcctacagttaaacgactttgatgtattcgtcaatccttaggaaaccaaaatgctattactttctccattatgtacctacatctactactatacagctggctctctccaacgaaacattttccattttcaacttcacatcttccttcttctaccaacatgggcttggaaacctgtcttgatagaggacacagacttagtagaaccacaggccttacagacaatgaaatgcaatctgttggcgctctctctcttcagttcggtgttcatagacttacaggtcttacatgtcacatattcaatgatgtaacgtcttaaaacgttctcgatctgtttaggttggaatctacctttaatgatcaaccttttctgaccatcaatagatcccgatgtacccaattcagcaaataaatattgaatcaaatgctctggtgacctttgtaatacagtggcgatttcttgaacgttagcaaaaagagttctcttggtaccttctctttgaaccactggaggtggaatacgaaatttaggaccagatctctctccagccagttctgggttattttgtttcaggactttgaaaaatctagataacatgtcctcatactttggtcccaaatcggtagtagtctctacctctggagtagactctttggtgacatctttgtcatcctcaagaacaccggccttctccaacaatttatcaaagtcctcgcttacaggggcggcagccttcttcttctttttcttgagtttcagctcgcccattacatcggcgaggtctttctctacttccttttcctccccagtggctgcggtagccttcttctttttctttttcaatccggaaaaaagatcatcgtccccttctttggtgtcaacggattgctctaaaacttcaggatcagcactcttagccttcttcttcttcttcttcaatgtgggatcaaaccccaatgcctctgtttttgttatctcttcggacatgatttgtgtgattcagagtatctagtgacaagaaatgaattttcagcgagactatgagctgagaagctttcgcgggcgattacgatctacgccgctttggtgatgcggtgggtgcagttagcgtaattttcagaatgaataataatccagtgtctaagagtgcttagagtatacatactagcggaacaatccaaacaatcccttttttttcttctctggtgacggagattcagaatccgcttgtctctcttgcttgtttgaactctcgataggttcctcaaatatctggtttggttgactcacgtagttgaaagctatgtcaaacaatacaggcttaacattgacaggtttgacattcttgtaggatacagaggcaatcttgtgcagactgggattcgacggaaccttgttgcgattgtcagcaatgaaatcatactccgatacaccacctaaagaagactcttgcttatacttggccaaaacataagccttaaggatgtcttgattaatttgttctaagatcgaactcaaatctttattcgtagggaaattagtgggatattctccggcgatagtgtgcccctttaccaaggactttgcctttattaataacgccaatgattccttggatctgttgaataaaaggtgggtagatgccaaatgttggatcttggatgcttggaaataagcatccaatgcctgcaacgaattccactcctcttgcttgttgtaaacacctggaacgtctttcaactcattgactttcttgacgatattgtcgaaaattctaccaacgtctttagcacgttccagagccacagctagggaagaattaaccacagatctgtttctaacttggtctatcaaagtaatgtcccttctcaaagtggtgataagtaacaaatatctgatgtacgacagtaaaacatgattgttttgatcgtcgtctgcgaagttgtcaacatttctggccatcaacaactgatgagcatccagcgcttcttgaagagttagtagagccggatcatatgaggagacgtttccatcctcgataagttgcagcttttcgttcgcatctgaaatcagctttgctacctcctctgaatgaatagagatatcgtagtcccaccaaatcaactgagtttcaacaactccaacattcagaaactcgggatcttttgattctattatttgccttgcctgatccaaataccctagggtgtccgtcctaatttgatgtctgcactctgtatccaaaataggactgttatttttagtagcttggtagatcacaaatttcaacatttgatctatgtgagtgtcaattatgccattatagaggtcagtttgtgtttcagtaccatatttgtccaaaaactggagcccacatctcgccacactgagagcatactgagcattggtccaattcttgtttgcaatggaaagtttaccctgaatcaatgcaacataaacaaatacttccaattttctcatctcatcaggctcgtctccaactaggatcagtaattttctaccgtggtccagtgatctcttcaatctagaaacaataaacttttctctcgatttactatgatggaccttcatgatctccttgacctcatcactatacatgtgatccctctctgcagtgaacagtataatgtcaccatatcgcttatccctgttgtacgactctagatcaattttggaaatctgctctttctctctatagttcttagtatcagtaacatgaatatccaagctcttacgtaacttgtgcagccttcgattcaatctgtgtctttgtttatgaaaagcatcagcactatctaaatacctttcggctctttctccgtatgtagattgcaagggcgattccatgttgctctatttgagtgaagttaagctcgtcagaggtgaaaacgtcgacgctggatgtggtaacgcgcgaatgaatatttcaataaggttgggatgttgacggggaggtctaaggaacgacttacgtctgtcccgactttgtggaattcttagaatacttaagtagatgagttaagtcgaaacatcttgaacttatgtcgtcattttattgtagagggctagattttacttttatcattatttagtctaactagctaaggcctctagatgttgtcttcaggctattatcgagttgccgttctcgtctatggcctccacaacttgctcatcaccgaaggtgatatgattatttgcagagccattagaaaagtgttctgtctgtccattctcttgcacgaccttcttctcttttcctccttcaaagttctgcctcactcttagatagtgatccaactcttctgcagagactgatggaactagttctttcctagatttgtcaaagtcttccaaagtcactaatacgtctatgtcctcttttgtcgctacgttgtcaaaccaccagcgtgtgctcacttgactcttttctggcagctcctcgttgtatctcttgatcttctcgtccactgtattggcgattctggtcattgcattaagcattgcgtcagaacatagagcatagaagtcagcacctgtaaatgtgaaaggacagctctcagccactttatccaaatccaccgagggatgtagatgaaactttctactcagtgcctccattatcttgctttgcttttcgtgggtatcagagactccaaggtataacatcttatcaaatcttcccggtctaagtaaggcttcgtccaacagatctggtctgttagtagcaccaacgacaaagacgccatctccgccatcaccaccactcataccatctaattcagcaagcaattgagatacaatacgatccattactcctcccgaatctccctggttacctctttttggagcaacagaatccagttcatcaaaaaatacaacacatggtttagcgtctcgtgctctttgaaacactttacgcacgttggcctctgactctccaatatacatattcaacaactctgggccctttacagagaaaaagttgagagcaaagtttgttgcaatggctttagcaagcagagttttccctgttcccgggggcccgtaaaataaaataccacttctctttttaataccgttactgaaaagctcaggatgtttcattggcatatcaatagtatccagtatctcatccttgaccacatccaaaccacctacatcttcccatttgacgttcggaattctaggtgccccgatggaatcactgaacttatttctcgcagtattgatagatttttcaacatcttcaggagtaaacttgatatatcccccgctggaatataccatattctcaaatgaaacattatggtgcttagcaaggctctctactctgtcaactgccaatgtcttagcattttctacaatagagatcaagtctctgggtgtcaacccagcactctgaagcgataacgaactgagagataaatcatttctgggtgcaaatgaaagctctctcgttccctcagtaaccttgggagttgtcttctggtcaaagtcaatcaagtatttaaaaatcaacgttctttcttgctctgaaggaacaccaaggacaatttcgaacttaaactttgctcttagctcatcactgaggttatcggaatcgttagttgaagcaacaaaaaggactccaggttttgccgtatactcgtcaatcaattcgttgatcttaacagctagtgaatctttttgctgttgttcagactttttggtgagagcttcgatgtgcttaataaacacaattaaaggcgtacagccctctacaactctatccaattttcctctaattgttccaattgtctttgactcagaagatgggttcaaaacctcgtacccatcaatttcaactaaatgaacaccacattcaagggcaagactgtgaactagaagtgacttcccaattgctctggataaggacgacaacaaaactgtggtttgaaggtttaccaaccttgatggatcaatggtagctttgatcaatttgcgcaacgttttggcgtactcaaaggttgaagtcgttacaccagaaacgttaggaaaggaaaacatctgaccgcatcctaaatagttagcccaattgcagtgttgactatttttgggcggggagcaggaaacgactcctgattgcatcattttggtcttcaatggatcaatgataaactgctgggaggctgaatcggctagttcgcctgaaacctcggttaccttaaaccacgcaattgcatcaggttttccttcaggtatgacagttgggaactgcgagtcatcgactcccaacttttcatatgtgctgaatattgacttggcgagaagtgtgtcaactggaattggaatcaattgatcttttgaaagcacttttcggccagattcaaaatacgttttcaagttagttaaaaataatgtttgcaaggtcctgtcaagcgtaactggagaagaaactctggcaatcgtaacctgctttgccaatgggatgaacttggaaaagtggaaaccttgcagctcaaatctcttatcggggatagatattgggcatagtttcacaatctttgggttgtttaaattaaaagaaagaattgggttcagatagatgcatcctttttcatacgtattagggtcagtaaatgcatgaattcggatatacctgtattgtacagggcaagattcacaattacattcaaacgtagtgcattgacactgtcctgatttcattttcacgatatcaccagaaagacatccaattttggcaagctctgtagtcttgcaaaaggcgtatagcagagtatcctcgtttgaaatgtcctcctctactagtttgggagagctttcatcctccgaatcatgagccacacttatactcttcgcagttttccttacagaaatggggctatccaaacatttgaccgagaactctactcctgttgtggtaatctggttctcaggatctaaggaatttaaggaaaaataattggagattgaatgttccaggttcattttgacattttcttcgtaatttaggcttccatcttgtgattgatctagcaaaggcaagttcaaactattctctttcaccacaattattttggttgtagactctagaaagccttggtcggtaggctcacacaaagatatttttccgttgatgtctttattgtaatcaccttgtcttatgacagtatgttgatcattcccacctagaatatcgactaattgatgttgagaagcctggctagccaggctgtatacctctggtaagactgaaataataactgtatccagtttgaccagagaatcaactcttgctacatatcctgagtcaactgtgaaatcagagctgtaatcaatgatgttgcccatgttgcataagttgacagtattagggggcaattgctcttcgctttcatacactttgaaagtttgaaactcattgaaaagagaggaacccataagctgaatcgaaattaaagtcaagccagattttgacccgttggcgtaatcttcaaaaagcagttcatataaatcagttgaaaggaacgctctctcagaagcatcgtagggatcctcagtcacaatcacatgggccagcacaggtccggtaacctgacttgtctcagttataccaggcataaagtactgcgtacaaaagaatctgaaagtgtgatgaatgccggcgggaacttgaaagaggcagatgatggagaaatatagagccgaataatgtggagaaaaaggcctagagtgttcgaatgcggtaatatgatggcatataaccgttttgggtttttcgattgtaggtttcaattaaggttggttatgtaatcataaaataaattagattgggaagtcatcacaacttgaaacttttctgccatgaactgtcatctatttgaaaaactttctgttgtgttcagaaatgtgagctgcaaaaaacccttctggattcttgtcaacttttttaattaaaaatctctcataggatcttgagtcattctatagagatagtcacaaacactatcatgcaaaggacaataaccattggcacagtaaatgtagcccagtaattactgccattattttacgatttcctcattcaatgttagcctgtgttttggctaaccagatcataaaccagaggaaaaatttttagtatactccaactttcttcaagtccatacccaatgtgtttataaacaggtgatgcatattccaaaacttgggcacaacaagtgagaaagtaactggaaatgggtgaatctcggtttcaaaatgtagtttttctaaggccttgcgtaaagttcagacctttcttggaagacgaaatctacaaatattgcggatacattgcaaaggaggaactctgagtaacagatcgtccgcactatcttcaaaatgacctccgtgaacttctactgagatttcatcacgagtaatcagccatgcccgtaaaatgatcaaagacaacaccgatgcgaagtacataaaaccaacaaatatagctgggtttacgtactgggtagggtcggtttctgcaccattgggaggatcgctttttagggagatcccgataataggagaacagaacccagaaacaccgattgcgatccataaagcggccagcccaactccgactttcttcaaaccaaagacgcgagttgcaatgcctgccatcacaacccagaccgtacccatagttgcaccaaccatcagtgcaaacgccacagcagttgcataattcctggtggggatccacattgcaaaaacaagtgtgaatacaaaggtatgtatcaagatcgtagctgatactggacccaatctatccccaactagtccagtcagtggtctgaaagcacatgcaccaacagcgaccattgcagaaaccaccgacccttgggaagccgaataccccagagatctcgtgaaatctgccaagttgtacatcagcgtgacatatcccagcatagtagtcatggtccataatattagcatgtaggttccaaaacaactccacacctgtttgtccgaaactcggtacacaggtttaatatgcttgtttctggatcttaccagacaaattccaacgaatgacaatgatgcgcagataattgcttgagctctcaatgcccattggtaaccatgcttattcatgacatcttgcattccaacgttgaagataaccccaccaccagatcctgcggctgcgattcctcctgccaggtttcgctttctcttgaaccattgcgggagaacgttcacattggaaagagcaactaaagccattccaattccaaaaagaactccttgcgtgagaaacaattgccagagttttgtagcccaactggccagcatgactgctataaattgtatgatccatcccaaaaccaaaacgaatgtcaagttagtaactccgaccaagtagttaatcagaggtgccaaaacggtccctgaagcaaatgatagtcctcctattatagcgtaatcaattttgcttgctccatgaaaggtatcgtcggccaaatagtgagccagataaatagcatacccactgttggcaccccaggtagataggttgaaaagaaaacagccaatcaccacaaaccagccgcaaccaccgtctggaacttgatgagggttgtcttttgatactgattcgacgttcacgacctctaactcttttgatttcataggtgttgagtcagacatttgttttccatttttgagacctaagaattttttagccgttgccaagctcatcgtgagagcgtcttgaaacggcagttcgtggttcgaaaaagtgtacgccgggcaaaaggagaggcggaacggttactcagcgattggttggtgtttgcttagagatgagactaagaaaaaaattgcaggggccaggaccttcaatagcagctcaagtaatagttaggttcaggtgaaagaaagactattgagcgcaaattgtgaatgcagaatctcgctatcggagaacgataccacgtattgatagtgcacactggaatacttaagtagtagtaagaaaagggggaaaaagactcatatctcgaacgatgaaggccgggctctgtattgtatgggtctagggcttgaggaaagagtcataaatccatggatgacaaatccgctatagtacgcgaccaaaattgaggatacggaatcagtccaatatcagcaatcaagttacaatgcttatactactgctcagcttatctccgttcccgtcgcattagcacactccaaatggaacgagcttttgtggggaaaacggcggaataaacttttcagattacttatgtaagcaatggtttgggggatcaaacatcgcgttctttttctcatttaatttaaactgggaacagatcttcaccacgtcaaagaagctaagctaccctgggattttatcatctagaaatcgtatttgcctacaaagtcttaaatactgatctactgagccttaatgacagattttttgtccaagaccaaggagattcaacacaaaatagattcggtcaccacgatcactgaattgtatcctctcaggttacagatcaatgatctctttcaacatcagggctcttaccttcaatacgaccaaaagttgtacaaagaagcttctgatttgctgatcaatgaacttttgcagaagaaaaagctcctatcaaaacagggcaaattcaggtttagtaatcgtcagcttttgcatcgtttgtgccaaaaacaggctccacgatccagatcgacccttaaagattctacaaacacgatccagtcccatgtcagccccatacggacgtatcaatgtatcaaaattgtttccgaaacttcgataactgagcaacgtctggatcatgtggttttaaaagtggtcgctccctccacacacatctccaacatctcaaactgtatcctcttcctaaacatcaagggccctatctacatgtccagtgtaaaaaactgtttcataatttcaaactcatatcaacttagacttcatgaagtcaccaactcagtcatcgacgcttgtattgccaaagacgacaagagaataacgatagagaattgttctaaactactggtgaatccctgtgtacaagtggatgacttcaattggccaaacagctcacagagtccaaacttcaaattcaaaatagtcccatccccccttgaatgcaatttcaaagaagggcccataagagatggcctaatagtaattgataggctacgagatgaggcattctaaatatccaattagatttcattagctaaatatcacagtcactatatatacctaaattcaactagtcaacctcctccatggcagactcagcaacagcttcttcacttggagcttcagtagcctgttctggctctttctcttcctcctcatcgatgttcaaaccaatggagatcaaaccgttgattctggcagcgaaagaagttggctcatccaaagtgaaaccggaagtcaacaaagctgtgtcgaacaacaaagtggtcaagttcttgacaactctgtcatctgtaccggtagcctcaaccttctttctcaaagccttaatgattggcgactttggagagatctcgaagatcttctttgaagccatgtacgaggacatggtgttggtgtctctcagagcttgagccttcataattctttccatgttagcagaccagccgaattgggaagttctaatagcagcaggagagtcaaccagcttgtaggaaactacaaccttctcaaccttgtcacccaaaatctctttcagggctttagtcaaaggctcgaaatctttaacctcttcctctctagccttcttctcctcctcagactcttccagctcaaagtctttagtgatgtcaaccaatttcttgtcctcaatctctttcaattgagtcatagcgtactcatcaataggatcggtcagcaataggacctcaaagttcttctccttcaaagcatccaagaatggagatttctcaagagccttgacagactcaccggtaatgaagtagatgttcttctggtgctctggcattctggtgacgtagtcagagaatgaggttagctcctcagtagacttggtggagttaaatctcagcaacttggccaatgcggatctgttttggctgtcttcatggacacccaacttcaagttcttggagaaagcactgtaaaacttctcgaattgttccttgtcttcagcaatctcgttgaaagtctcaatcaacttcttgacaatgttctttctgataaccttcaagattctgttctgttgcaacatttctctggacaagttcaatggcaagtcttcggagtccacaacacccttaacgaaactcaaccattctggaattagttcctcagcttcatcggtgatgaaaacacgtctaacgtacaacttgatattgttcttctttttcttagactcgaatagatcgaatggagctctcttgggaatgaacagaatggccttgaactctaattgaccttcgacagagaagtgcttaacagccaatgggtcttcccaatcgttagaaatggacttgtagaaagcattgtactcatcctgagtgacttcagatggagatctggtccacaaaggcttagtcttgttcagctcctcagtctcagtgacactttccttgactttcttaatcttcttttcctcttctttcttgtcttcttcgtcgtcaacttcctctagtttaggcttcttgtcatcttcctcagtctcttccttcttttcttcctcctcttcgactggaacatctttttcaacctccttggtgacgactaactggattggataagaaacaaactcagagtgacgcttaacgacctcctttattctcttctcctccaagtattccagctgatcatctttcaagaataatctcagcacggtacctctacctaacttttcgttggtctcatctaaagaaacggtgaatttgccacccgcgtttgactcccaaatatattgttcgtcatcgttgttcttggaaatgacttgaacgtggtcagcaaccaagaacagggagtagaaaccaacaccgaattgaccaatcatagaaacatcagcacctgcactcaaagcttccatgaaagccttcgtaccagacttggcgatagtacccaggttgttgaccaaatcagctttagtcataccgataccggaatctctgatctccaaaaccttctcttcaggctttggggtaatcctaatgaacaactctggttcagtttctagcactttaggatcactcaaggattggtaacggatcttgtccaatgcatcagaggcattagagatcagctctcttaaaaagatctctttgttggagtagacagtgttaatgaacaaggacaacaactgagagatctcagcttggaactcgtacgattcggactttgacatattgatatttttccaaaattaaaaagttaaccagagtcttaatgacgcggagttcttacacttaaatatatttcgcaagctcatcgtcgaggtagcatggaatattccaccagcttctatgaccgggtaaccgcgccagaaaatgtggtttgcggcttcacagacaaggaaaaattcaaaaaaatcattcagtaatagcgctgcggtgatgataaatgggctatttttctgctaatagggaaattgtccgtctttgatgagcagttccgacattgttggagctgtcaacatcgtttactatcgtttaaagatattgatccacaagaaatttctggaaaaaccatctcgcgaacgatactttatcacaatttatcaagaatgatgattccacataaagtgattccgaattatttgcgatctagtgtcacttaattctgccagcgggctatcgtatcatgctcaatttgatattttaaccttcttagaggaactctcctcgttagtcgtataatggatacggctaggtgtggagtatgtctgagaatcattcgtttggtttgagtctatgggatcttgagcaccgttttcgttttcatgctctgtattttgttgttcttgcagtggcctatcattctcagtgggaaattctagagccttgttggtgctgtcaggagtcagtgtcacgagtcgcttctccccagtgaccttaacccggattttgtccatgacattgtttacgacgtgtaaagttttgatgtctgtttgaaagttgattaactccagactagtagtggctccaagtgttttttgcacaggaagtaattggtttagatcaattaccttgtgggaagcaaaacctagttgtagccttagattcaaagcattcttatcttgaacatcgagcagtctgtccttctccaatactagatctttaaattgcctctcctcttcgactatcaaatgcaggtcttgctctctagtcctcaaaagatcttgaagaccaattatagtgttgttttgaatatcacgttcaacggtccgtgtctcaagtagcttctgacagttggaaagctcactctccagtcgcactagtttcgtttctgcgtccgataacctgggactaggattgtttatcgcattatcaatattggcaagactattcaatttctgcttcagtgattctttttcttgggaagcagaaaaataattgttccctagttgaagaaggtgaactttttgtcgttctataagttgctgggcattcgtgatcagttgatcctttactcccagttgttttgtcaaattagctatgtgggctgctagttcttgtattctcatctctctcagtgtaacagtgtacatgcattgatgaagatggcttgatagttcctggatagttttggcattctggtttgattgctgatttatttgatcagttggcaaagacgatggtaaaggtcttccagttttgaactgattcaatttctcctctgcttctctaagctttttctcaagagtgtgaaacgtgtggcgggatgaggctgattttacactttcatttaagcttctctctaactctgttattttctgcgtatcggcaagcatagtcctgttcattcgatcgactgtttgcttgtgctctccttcaagccgttctattcgctgagttttctctctgttttctgtggcaagtcgtattatttcgttatccctctcccggagcaggttcattagataattatttcgttcatcatccggtgaatgtatagcctgtggacgagaataaatattcgcagaaatactctctgtagtacttccggtgtatgttgaccttccggattcaaattgattaagtttagcctttccttcatgagcttctatctccagttgacggttcgtctctgtcaatgattgtgcaggtttacctgcgtttaggcgtttcttaccagttttcagctcctcaagtagctccctaattatactagttgcaactgactttttttgttttcctataggcaagtttaattgggctgttgctcttgagattatactttgagagtccccaacattcagtggccccatttccattgaggatagctttgaatattttcgttcaacaaaactcaaaagcatcccattcatgttcttgatatcgtgtacttttcgaagtttggataaagcagagttactaatgtcatttttttcaacgccagcaaccttccaaaggcctgggggatggttcaagtccaacatgctctcggcactagatattctggatctcatctgttcaagcgaaagagtagacatctcctttggaaacttgttatacagcagtaaatcaatcacaagatcataggctatacttatgggacaagattcatcaccaatggcgaacaggtcacgaaaccttgcaacgatgtctcccaagaccgtagcatgagtatcggacaacaagttactattaaatgtacgagcaaaaatagccaatatgcataaattgattgttactcgcatgaccttcatgtcttgactttcggtgtcatccatgcaaagttcttctcgttgaaaaaaattggaggcgggcttgacataagaaagtaagcttaggaaagatagaaacctgtagtgaaattctgcttcgtcatttatgccaaggtcaagctgctgaattcgatactccgatgtaatctgggcttcctttgatctttgaggtaaatatgccctctgtggtgtagtcaaaaaccttaccaggtatttggcttgcaaatagagattgaacgtgttttcgtgcacaaactcctggtattctgaactataggcgtttgattcgtattttctattattattgtgtacaatgtcactcttaatcaatatatgctcaattacggccccataccaactcattgtggccggccaatggtggtgggtactgtgggagtgataaatcgatggatgatagataactatgtaggcagcgaaaattgcatacatacacgaaaagagcattctgagtagaggatgctagatggtatatagtcgacaatcaataatgatgtggattgactaagaccatacttagaaaagtcaaaaaaaacaggagcagagcacgctgaaaagtgtcctgagatttgcatgtcttaccctgagacttgcatggctcagtctctggctattgtagagctactcttaagaaaacatagatcccaacaccattattttgctaacttccttttgtttacatttcaaagaataccaacgctctcttctctctctttcccctaacgcattcacattgcttcacatcactttcacattgttcaatgtcatcagagagaacttccaagattggatctaagtacctggaaggcttggattcagcagagaagcttccactgggggcgtcagctaaactcaactctttatcttcgtcaccaacaaaacattcaatatccagcttgaaaagaacttcagggtctttgaaggagaacaaatcaccagatttaaacattgctactaaaaaggatctttctgatatttctcctgtcaagcgaatgatcttggagaaggagagagctttgagggaattagaggaacgtggtgaaactccgttcactggaatgcctccaaaatcactataccaatccactcagctctcccctacaaaagctcgaaattttgtatcccgagatgcgaagactttgagtaagatcaatggggtcgccggcaaaggcatgtcaagttcaccttctttaaagaatctaaacaaactgaaaaaaatagaaaccaaactacaggataaagacgtaaagcacataacgggcacaacgaatagaaggacgactcttatctatgagtatctatgtcgaattcttgaagctaagaactggattgaggagattactaaagaaaaaatatgtgactccgactcgatcctggatattcaggaagaattgagaaatggaatagctttggcaaagctcacaaatgtttttgctcccgatcttgtaggaaagatacacaatggcaacatgggaaaatttcaattcaagtacattgagaatatatcctattttttgaagtttttaaacaaagtccaattaccagatctatgtcaatttgaaacgacggatctttacgacatgaaaaacttcccacaagtcatattttgtatccattctcttagcataatgctcagtcttagaaaaaaagctcccaagatggagaacctaagtggagtagcacaattttctgatgacgagataaataccatttctaacaaggtcaagggtatgaaattaccaaatttttccaacatccacaaagagcatgcagccgaagatattgaggaattggatgaaacttccattttggccaacttaactgttgacaatgatccttgcgtcaaagaatcctctccagtagatacgaatgacttgctgaccgatccactgcttgatagcactgatttgtttgccgatgatgaatttcaaaagtctgttcagaaaaagtatctgaatatgaaagagacgaatcatgtagtgaatactgatgacttcgaataccttgagatgatcactaatttacaagccatgtctcgaggatctttattgagatataagctatttgttgataggttcatgctgaaatcatttactccgaacactatcaaacttcagggtttggctaaaggatacttgctgcgaagcgccaaccagaagcttcttttagctcttaatgtagagagcaaaaatatctctaagttgcaaacactgatcagaaataaacagaatgcatccaaacttaaaatagttaacaataaactccaaccacatttggaaacaattacccagcttcaagctattatcagggcaggagtattgattaggaagcctattcttgaaagacaagccaaattgaaaagttttactaacagtataatttcttttcaaagctttattaagatgaaactaactaaacgccgtactgatgatgaagttaagactttaaaacaaattgagccatgtattgttaatttgcaatctattgccaggaatcgaattttcaacagagttcagcgagcttctttgtcaacagtcctttcgaatgaagatgctttgaaaggtcttcaatctattattaggggtaacaaattgagaaatgaaaccattacgttgaatttagaattgcgttcccatagaagtcagattaaagagctgcagacaatagccagaggtgggatttgcagaaacagattgaattttattctagacactttgtactatgaagagccacttgtcgagtctcttgttagcattgctaggggtaaaagggctcgattgcatgtatcaaaaatatcccttggtctacaacagaatatcagctctgttatcacaattcagtcttcagttagaggtgtgcttagtcggtttgctcaagaattagtactggatgatttagaataccaggagtccagtgtgatagcacttcaatcattactgagagctaggaagattcaatcaaagataaagtatacatacacttactacaaccgtcctgaaaatgtaaggaaaattataaaagttcaaagttacttaaggacgcacacgcattccaatgcctacaatgctctagtagcattttctgatcctccctttcgggttgtgaaaagtttcattcacttgctacaggacaatgacaaggactttgacgaggaacttgaagttcaaaggatgaaagatttgatcagccgaaaaaatcaagatattaccaagcttgaagagatgcttgttcagcttgacgtgaagatcgacatgctaatgaagaacaagatcactcttgatgaacttgtaaagcacgcagccaatgataagaccaaaaaaggacaattcacaagcagtgtgggatctgctaagttagatgaacagctgcgaaagctggataaaccagctagagacttgattggctggtatgaaaagtttttctatcttcttcaaacgaatcctgaatatctaacaagattatttgatgtgatgcaacagcatggcttaagatacgagatttcattggatggtaatattgaatcatatgtccttacctgttttaacttttctcagattaacgtccagtcctttacattgaagcctactcgtgaagagttccttcttatggaattaattttgttgaacattagtaagggaatagagtctttcaaagatgatctagaacaatttaaaaaattcacggcactagagagtcctaaagatttggttcaatacagctttgtatgggagcacgtcttaaaagagtataataacttgactcatcatcgaatcgtattgaaaaaattgtacggagagagagtaaagcagatcatagatgactctcggttggatttggaatcggttcctctgacaatattcagatctataattgcaaaggaaatcgaggaacatggctcatcgattgaatcagatgaaaacatgaacaacactaaagcaattcaagaccctagagtccgtgatatatttgtggacaatttgagcaatctgagagagctcgctaataacatgttgttagacattgaagccagtgttccatctatgccattgtatattcgtacaatgttaaaggaagtctaccttaagattaaaaggcagtttcctagagaatcagaaagattttacttaagttacatcggtaagatcttcatgaagaactactttttgccaatattgttcaaaccagaaatatacggtctttgccctaatgactttgccaaatcaaaggttggaaacaaaaagattaggcaaaatttgatagagctagcaagggtcatgatccaactcgtttctatgcgctcctttagtacgaagaatgtttatcttcagccactgaatgactttattgagcagtccgtggaactcacaagaagagtattactgaaaatcatcgataccgaaacgctagaaggatcctatggtctgtctccgttgtaccatgatatcatttcaaatgagagaccgatcctggaaattggggtgaacgatctgctaagtattgtggaactggttaccaatgacctggatgtgattgcgccatccttggacgactatttgagaacttgcatcgaagaaatggttctgctaggcagcagcattaggtcggttcagaaaccagaactcacgctaagactgaatccctcaactattcaacctgaagagaattcacatattaaggtcctatggctaaatactaagaagaatttgacgtatatcatccaggttcaagacagtgacgatttgttggatatgctgattgctccaattgagccacgccatgatcttattttccaaaaattgaaagaggatgagttgtccagggatacagacattaccatcgaaagtagcaatggctctcgtaaacacttgaaagatataagcttcagagagttaaagactattactttggaaaatgtattaaaattggaatccacaggatccataaccagatctaactgcttccaggatctactcaatgagattgcaaatgatattaagaataagcatgatcaaagacgggaaagaggtagtcagctaaagatgattcgcagtgcactccagagcctcaaagataaggaaagacaactacagaatgagctggattcatacaataacgacattgaggaggctattcgaaagttgcaaagtggacacaaaaaaaatcttttttgaaactgctttttactggagagttttatcagagacgggccttaaagaagttaaatggaggctcaatacctaagtttggatctttcaagtactcttcaaaatatctttttgaaaaccgcatcctactggaaattaatggtgttacagataagcataaaggagtcccagtcaaatatgatttcctcttctcctgtgatgaagtggagcgcttcagaatcgaagtcgccaatgatatgaacatcgtaaaaggaggggttcagaatttgacactcgactctcttttaaaattacagcaagataaacaggcaacggtaacctacttcgacataggagccaagttcaacgtaaatttattggttgcgttcatgttccgaaagttttatgaggtcaaatagaaatatgtaccaagaaactaaatatactacctgacatccgcagtctgagatctaacaacatcttgcatgattttactagaattcgtgattatcgaaaaaccaggcggaggcacagactcaaacaattttgaccaattccagtagaggtctcgtttcaccctgtcatagcctttacaatgtattatatcaaaagatgctgctgccttctggcgtccacattcccgagggccttttgcagcggattgttcctttgggccacctacgtactgtgcattgagattgctttcaagttatacggcggaataatagggctggttctttgcactgttggtgtaattctactagtcatctccttgcaggcgtactgtttggtagttgccttaggtcctggatctccggctgactttaccgagcttcatatcttaaactacgttcctgggatgcagatcaaaccaccccacgaactgctaaacagaacagttaccaccagtggaagtggcaatttcaggatatgcaataagtgtgaagtgttcaaaccagatagaagtcaccactgctcttcttgtggtatatgtatactcaaaatggaccatcattgtccttggtttgcatgttgcattggtttcaagaatcacaaattttttgttcaatttctgatctatacacagatatattccttattagcattgctggtcagtgggaaggttctttacgatttttttgagacgaagaggtataaggatcattatttatctctgaactatgtgttcttaacggttgttagttttgtgacttttctttcgttaacctttttcatagggttcaccctgtaccaactatttcgtaacaaaaccacgatcgaatcctacgaaagtcaaagatacagagcgaaccttaaggttgctgatgacagatactacaagtttaactccagaaaaccaacggataaaagtttaggaaacgtgtttgacttgggctggagagaaaatttcaagcaagtcatgggcaattcctggtatgaatggctgctgccaataagggtggtacctaaacgtttgaatgactattatctgaacaatggattgaactacccagtgaacgagcatgtttaccaaaaacttgttcagaactctgaacttcaacaacgattgtatgaagacatattagattacaggaggaagcagaagcaagaccaggaagcggatttggagaatgaatatcaacaatccggtactgtctatggagtttagtgtttccaacagtgtttgccgcggcttcttacagcattcgggtgccgaatagcttatccctcagttcttaaaaagtatataaaattcgcgcctaatctttcacttctaatcccaagaaaaacacccattaggtcgtctactaaatcacttattcctgcttgttcccctcgtaatgacttttgagctaaagccatttgacccactcacagtggatccaaccaataagaagcgtaagtaatgtcgatggcttttttgtcaatgtggcggctttcctccgtacattcttcttactgcagtgtttactaacctatcaaggtgtcgcctacttctacgattctgatgttggaaattatgcttatggagcaggtcatcctatgaaaccacaccgtataagaatggcgcattcactgataatgaattacggactttataaaaaaatggaaatctacagggcgaaaccagcaaccaaacaagaaatgtgccagtttcacactgatgaatatatagatttcttggctagggtcactcctgataaccttgatatgttttctaaggagcaagttaaattcaatgtcggtgatgattgccctgtttttgatggcttatttgaatattgtagcatatcaggaggtggttctatggagggtgctgctagactaaacagaggtaagtgtgatattgctatcaattatgccggtggcctgcatcacgccaaaaagtcagaggcttcaggtttctgttatctgaatgacattgtgttggggatcattgaactgttgcgttatcacccaagagtactttacgttgatatcgatgtgcatcacggtgatggtgtcgaagaagcattttatactacggacagggtaatgacctgttcttttcacaaatacggagaattcttcccgggtacgggagaattacgtgatattggtgccggtaagggaaagaattatgctgtgaacgtacccctgagagatggtattgatgatgccacttataggtctgtgtttgaaccagtaattaaaaagattatggagtggtatcaaccttctgctgttgtcttgcaatgcggaggtgattctctgagtggagatagattaggttgtttcaacctgtcgatgaaaggtcacgcaaactgtgtgaattatgtcaagtcttttaatattcccatgatggtcgttggaggtggtggttacactatgagaaatgtttccagaacgtggacgtttgagtcagggcttttgaacaatgttctgctagaagcggaattaccgtacaatgactattatgaatattacggaccagattatcagcttgatgttcgtccctcaaatatgcacaatgctaactctcccgaatatctttctaagatcatgtcccaaattttcagtaacttagaaaatacaaagtttgcaccatccgttcagcttaactatgtacctccagacatggaagagtatggagatgtcgaagaagataccgaaaaagccaaagacaccaagggaggttctcaatatgctagagacaacattattgtcggagacaacgaattctatgacacagacgacttgaataaggaaaaggacgtggcccactacaaaaaatctatcattccaaaggactactatgaaaaagaaggagcaaagatggcagaagaacttgagaacgaactgaaaaaagaagattaaatgaaagatgattataaaaaccgtagtaatgttatggttttccaaagcctctaaagctggagttgaatcccaacaagttgttgattcctgtagtccaatcgttttctgattttgccacgcaccaaatcccacttttgtgcgttttatcaatacctttgttggtaactttggcaatttttgaatcatgatggtcactaatatgctgaccaactctatggctctctaaaactgggggaagtttagtatctggcagataaatcgttccagtctcgctgaccacatggatctcatcgtcttgcgagagacctacctgtgggacaccgtctatagatagtttaactgaacattccctagatacgtccttagcaaccactcttacgattatgtgagaagtggctgggataactaatggtctgaaggataaagaacggggacatatgggggtcagtaagatgcatttgactagcggatgaacaatagaccctccagcagatagtgagtaagcggtagatccagtgggagtcgagaatgatatcccatccgcagtggtcctagtcaaaaactctccgtcaataaaaatatctaaagtggtcaacgttggaatggaacctctatgcagaacaatgtcattcatcgcatgtacctttgttggaaactctgaatagttactacctttaggttgacctccttcagtattgatgggaagctcgttgtttttctttacaatatgacattctaatcttgttcgatgtaatactttagctcttgacgtgtaaactttgttgaaagattccttgaaattattaaagttgaatggaagcaagaaccctaacgttcccaggctgtatgatagaataggagggacgatggtgttggagaacatggaaactgctcttaagattgttccatcacctcctagggatactataagatctgtttttgtagtgatatctgccatagagccagtaaacagagaatgagtcattgaagaaccagatttggagtcatcctctagtttgtcctgaatctccttgacaatgtcctctgtaaggatgatattgcatgagggcaactcttgatgaatatggtttatcaggcctaccatagcatccagaacatgaccttgttgaggttttttcacgaccaacacgtttctcagcggcctagtccatatcatgttatgaagctttgaatgtggggaactaatgtactcaggatgttgtctgggcgccaattgtgacacgggtagtatcttgacatattggctactgtaatttctggattggagcctaataaagccagaccaccgttgtacgtgtaacattggccttagagagaatcaaacagtttagtcacagacctttgattgttgccagaagtcaggatatataaaggaatcatgttatcacgtgatgctttttacattatttttttcacctaggtgtcatagcttcaaaattgcagaatttcaaggggttagatgaaaattgccaagataaaaaggctctttgactcctttctatctatgggtggaagggagtgaaaagaagcgaaattgaatcaattgaaagcatgatatcggattaattgagtcagtagtggtgtcttccgcccgtcccctcgtcctcttcccggtaattggaaggtgcacgctcacttgctaggcgcagaatcggatgtcgatgagcacttcacatacatacaccatacatcatagtaagtgttgcactgcatttatccgtcgattatgagttatccagttccatttaacaatgacccaaactcttttgcttataccacctcaagggatagatggcctcacattatcaagtcttctgttggcgatttggagtcttacttagctgagaatccttcttccaagatagagggtgccaaactagtgcaagatctcgagaagttaaggtctgatatattggccaatggtaccgtgaatcccttcacccgggaacaattggatttgatcccgtctttggcttcctataatgagacgctggcctcgtttaagtctccattgaagtggctggaaggcccctggttgtttcttgagactttcttatatagattgatagatgtgatcattaagaagcattcagggttcgaaaattacgatatctttgaaaaaagtaaaagaaaggcttttactgactctccaaaaagtgtttatgagttaattaaacagtaccttcttcttttggatgacaacaaactgaaatcaaatgataaagatggtcaatacctattgttcaaagaatttattgatgtttcactttggggaaacgcaattgacttatctcttttagcaacagccgctcaagactatgatatgagcactggtcaatcggctgctgctaggaaggagaatgagaagcatatcctggctaatgatacttcgaaagcttgggaccatttgctgctgtgtaagcgtcccaagaggattgacatagtgttggacaacgctggttttgaattttttactgatttggtattttccttatttacccttgattcaaatcttgctgattctgttggaatccattgcaaaacgagaccatggatggtcagtgacactatgatcaaagacgttgagctgttgttgaaggacctgtctaatactcaactgttcccagataacagagatgaggtggaccgatttgtctctatcgtgagaaactaccttcagtcgggaaaaataaagctattggaaaacgagttttggaccctagatttagattatacccatatcacacccaatggtaaacacggaggagcagaactgtacgattatttccaagactcagctttagtcattatcaaaggtgacttaaattaccgaaagcttacaggagacaagaaatggccaaaagatactcctttcaaaacagctatcaaggaactgggtgaaacaaatattcctattttggctctacgtacttgtaaagcagacgtatgtgtagggttgcctaagcaaagagaggaagagctagttagaacagatggaaagtcatggtgtgctacaggcaaatgggcagtaattagcttcaatcagccgaaatagtcaagtatatactataattgaaaaattctacattatttcttcgtagggggaataaagggcactcccattagaggaaaaggcatcatcatcggcatgaaaggaatttgtggaacagctaaattctgtgcaggaattgaagacttgagtcttttgttcatttcatctggggattcatcgtcctctagctctctcttttgtgagttagattttacgaactcgtcgatttgtttcttcagatcatcatctgggatcaaagagtccagtaaaatatcttcttgaccacaattagggcatttgaaatcgtcattcaaaagctcttcttcaattgattcttttccatatagttttttgcagcaaggagtcaagacagggtacttaatcaggtctttcgttatgggatctatcattcgatcatcggtgactttgcttaataactgctttgaaagctccttatttgtatttgactgtgaatgtttcttctggtaagtttcccaagctttttgattggccatggctaccacgtattctccattttcgtttatcattacgttagagtctgagctctcggctacctctttatctactgttttcaaataggttttgggaatacctgtagttctagtgactcgttttccttcccagtttggatcgttatttgtaggacagttcttgatccaatgatctttggcaccacatctgtaacagatatatccaggaggaggggcatcctctgatgcttttgagtaatgaacaggagtgtgggtggaaagctcctcttgatgctgttgccagttctgggactgctggttgaacatagactgtattctttcttcctcagataatccggtcaggtttgttggagcaggagcacctgtagtggggccagagggagctgttctgttgatacgaggttttccgaccaaatatctacctgctgttcctcttcccttcttcataggaggacttcgtctcgctattaccgaggaagatctgggaatgactgtgttatcgtcatcgtatggttcatttgtatctgagtggagtagagttaagacaaaatcaaggttcgaattaagcttgttttgaaggataatttcacgtttcaaatcaaatacagtaattcctgtaccatcaaactgaactctagacaggtctttctgggacctgaaccgataaaaaatggtactggacatgggtttagttggtagtagaatatggtccgaaattcataatcaataattcctacggtaggtaattcgcggccgtattagacagaccaatgcccttgcaaacttctcgaaggatgcttccggttgcgccatcagcttgctagacatccttcgaggattttagaacatattctgtccccccctcttctctccccctactaccactccctctctgcctaccataccgtaaatatgaacggaccaggatactacgagttgtaccgaaagagcacgtacgtatacatttactccacaactaccaaccttaattcattgctctaacacatatagaattggaactacactgaccgatgccctggatacattgattttgtaagtgttcttacctttatcattttacggacgatgttactaatatattacttatagagatcaaagaatccagcctcagttggctctacgtatcctgtccaattttgacagagttgttgctgacacgatgaaagagaaggctaaaaccaagatttcatttaagggacatctccatacttatcgattctgtgacgatgtctggacttttattattaaagatttgggaattacattagatcaaaaggaaactgttcgtactgacaagtttaagattgtggcatgctcggcagctaccaaaggtacttagagaagggactggtccccctgtaagttttagtatgacgattttttttagcttagacgagtacatagtgaaatcaatcttttaaagcaccctaaagaccaatcagcctcggctgattgcacccgcttgttgcatcatcggtatgctcatgaaaagtcaatagtagatgggtgaatcgcgtcaaactgtaattccaaatttaaacttttttcttgtccactaatcaacgtgtgatccacatgaaccagttctcttcgttctcaagtttcaacccggattactccaatttgggatccacacaatcattcagagccaaatgggagttgctcaggccgtcaagggagtttttggacttgaaaagagttactaaaccaacatcattactggatttacaatcccggcttactttcaatttgagatatttttactacaattacgttctgattgcattggtatttggagtttacttcttactgcagaatctcttgctactcttattggtggttttcattctctcagctgtgtttggaatatcaagaattcagcaagacgaagtagatttgatcgcgtttagggtaaatgtgagccacctttacggttttgtggcaattgtttcaattattttggtcttcatctcatctccagttggcacagtcttgtcttgggcgaccgttagtggtatcactatattccttcacggctctttcctcgataaacccatccagagtgaagtgtaatatatatgtatttatttagaccattttgataaggcgcatagagacaattgggccttttcactactaataagacggtgaaaggattcttgtaaaagttggtatatgaatgggcttgaaacaattgattatgtaatcgcgtttgggttacacctgatctctttcccacgacagttaccattccattaaatgtctgaacttccgctatctgaacagtttcagagtgctttgaaaggcgttaataacatagttaactccaatcttagaaaagattccacagagttctccttgaaactggaacagattatacatcaactagataatgtcaaatcctcaatattgaggctcgcactgttcagcatcaatgagacaatcgaagaaattgccaccaaacatatccaatacctgtctatcgattactacattgcttcatgtcttgagcttaatatggacaggaagtcaagagcaaaaacattgaagtcttcgcagaaattttatctacagttccttcattcgttggacaattacgaaatattagacaaatcgcaatcacaactactagaacacttcaaggatccatataatcccaccctagaagaactaaggcctagtgatcctacgcaaagaagagagtacaagattgagaacttcaaacaggaaaaagccctgaatgaacgtctgaaaattattgatcaggtagacaatctagacgacgagatagtcaggcaagtgtacattgaccagttgaaactgtttgccctcaatgcccttcagtcatacgaggggaacatgctagagttagaggtgttgaagaatattcctgaaccgaaaattgaagaggaagatcacccagacgaggtattgcccttcgaatatactgacaaactagagactttgaagtcacctcttgtatcgaaacaaggaagggtactgaaaccgttcaccatagttagtgacaggaaccaattgaggtccaaggtctatggtactggtcaagttcttccttccatgacagttgaagagttagtagaacaagagcttcagaacggcggaatggtcaaaccgcaacaacctcaagacaatgacgaagaagccggggatgcggacaaataccatgaccaagaaacttacaaagcccgccaatgggatgaatttaaagaagccaatccaaagggaagtggtaacactactaacagaggatgaatgaaatatgattcgcgacataagtagagacagatatcaattataataattttctgacagttctccagttcattcgtctttataccaatgtccaaaaggtcgaacgacgtagaagatgctcctacaaaaagaccaaaagtagagaagaatccttcttacactctatatgttaagaatatcaatgacaagctgaaaccgcaccaacttgaacaacaattgtactacctcttctcagtttatggtgacgttgtggcgataaattgtcccccaaaaatgagagggcaagcattcatctcttttagtgattcaaatgatactattgtggctagaaataaactccaaaatcgagtcatttttgggaagaagttgattgttgaatttgctaagaacaactctaagaaaattgaagattcattttaatactcagcatggtcattttagtttgacttgtgttacctcttactgagtctccaactttgttgctggtcgaaacgattataaagcggctgaattttcactgttcgttttctcttgtttacttgctcagtatccgccttggcgaagaaccttggagcttgctcaactaaccaagtgggttcaattacactcacacaatgcatatactcctttgttgtcagtaatagagtgtgataaatcacatattctgatgatgattttccaaataaggaggatgaggggtggagatacactgtggtattctccaatagagtcttatagcatgatgtttcactatcctttttggcagtattcttgaaaaaaccacagcacaagtttactcgaatcaagttgctattctgcccacaacttctcatctcagaaccatatttgttcattattttttttagttgtgtcctaacatcccttacccgaagaagactcctataatgaatgaagttatctttgcaccattccttggagctaccgtttcttacccatttctcgtacacatttagcatagtcatatggtctccatgaggatggttaaatcggactcttttttcatcggccttttttctcagttcccccgtaggtctgtagaagattgactgcactgataacatagatacaatacttagcatctcctcactgcacccaaattcaatggatttgatcaaaaccttggcaagacccggatccattgggaaatccgccattctacggcccaattctgtcaagtcgccatcttccgtcagagcctccaagttgtatagttcttccaacgcacttagcattgtttttaatggcggtgggtccatgaactcaaacccaattaggtcttgaacccccatcgcctttagcataagaattgtatgtgcgagattctgtctttggatttcaggaatactattgggtaacatttccttattgtatccggtttcagtatacaatcggaagcatttgcctggtccagttctacctgctctaccagctctttgctttgcttgtgcttgagatataggtgtcaccattaaagaatccattccaagttttgggtcgtaagcatttaccttgacaaatcctggatcaatgacgtagtatatgccatcaatagtaatagacgtctctgcaatgttagtggctataatgacttttcttttcccaactggggttggttcaaatattttagactgcatttctgagggtaaagaagaataaatgggtaaaattatcagttcattttcttgatgaagatctattaatttttcgtataacacttcacagcatgtatcaatttcctcttgacctgttaaaaatactaaaatgtcacctcttgactcattcttatggatagacagtacacattctaatgttgcctgcaagtaatctagttcaggttccttggtgtagaaaatttccactgggaatgttcttccgggaatttgaattattggacagttttcaaagtaagtggaaaactttccactgtctaatgttgcagatgtgacaatgatcttaaggtcgtctcgtttcatcgctgctgtctttaagagaacgaataaaacatccgtcgcaatggttctctcatgagcttcgtctagcataatgacagagtatttactaagcattttatcaaccattgcctctctttgaagcataccgtcagtcatgtacttgatcttggttacatccgaagtattatcttcaaatcttattgtataaccaacttcctgccccagcctacagccaacttcttctgatactctttttgcaacactcacagcagcaactcgtcgaggttgggtgcaacctatgatcatattccctttattaaatccttcctcggccaaatattgggtaatctgggtagtcttaccggaacccgtctcacctacaataacgacaaatttattattcttgacggtttccagtagcatttgcttcatagaaaatacaggtaaagactccctttgttcttgtaggttcttggtggtggttttaccatatgagtctttcttaatagagtctttccattctgagactttattgctgatctcaggcctcaggcctttctttaactctttgcgctccttcaacaaatcagaaccattcatcgccgatctattcaaagatccttcaggggtttttatgacccttatcggtgatatctcccttagagaagatgatttaccgttcaagaatgggggaggcttctgttttacaacgatctctacttcttcatccttctctctatcgttgtatcctcgtttatgctcatccaggactgattggtattcatcatctagttctgggtaatcagaagccttcagagctccggaagatatcaactgtcgaatttcccatttttctggggatgatagttgttttcgaactttagtgtcccgaacttctgatcgacctctctgtatttgacctcttagctgcaattcgtctgggtttttgagactgagggatattttattggaggaaacactcagcacggtcgctgtcaccttatcgcccacgttagccacatctaatgggtgtctaatttctgaactggacatttctgatatatggcaaagtccagtgggccttcttaatgcttgcaatctgatgaaagcaccataaggcgttatgttagtaatctgtcctgaataactggccccaactataataggttggagcctggaatttatgctatcttttttctttctttcttggttatgagccgtgatttggctattgtacaacgtattagtatcagtatgatgtggcggttcctgtttgtgtggcttggttggttcacttatccactttccatctagtagcttgtcgattttgaagatatcagtaactgaaaattcggcaccattctccttcaaaacttcttgaaatgcgtctaaagtggaggatttcttgtataagtcggatataaatccctccatcaaatctaactcgcttgcagataaatccggctgcaaggatctcaacaaatctaataacttcattagatgagatggggtagtacagacattctgaagaactaaataatacggagcgcgagatatcagaacctcagaatgattattacaacagaggagaaacaagaagagggcatctagagaacaagatcatactggacctgtcacatatctgcacccttaagaactgatcgttccataaggagcggtgagaaaagaaataaaggatcatcggtacaactcttttgctattgattatctatacctatactgtagctgattgagaatcatgcgagaatcattaccattctccgtccactaccttgactccatctttgttcacaacctttacttgcaaacctttaaagtcaattggcattcttgtgttcaactctttgttacagagcttcaataaccttaaaccatcttccaccgtcatgtccttcctataatgatggtccaagagagacaacgtgtaaaatgcggcatacccgtgtgctgcatatggaagatctgccttggtgcctaagtaatcaatccaactgagacttggagtcttcttgtctgtgtcataacctgctaaaagtgcattcacttgataaggtttcctagatctgagggatttagccagtgtgttcctgacaaaatgagaaactgcatagggagacaattcatggccctctctcatattataaagttgaatattggcctggatgtactcggcaaattgcaccgtgtctccagactctccagtgaatgccattaagttatgatcactcaagtcccttgttttgtcgtcggtatccttcaaaattgatataccacgagtggcagctttggatgtggctatcacgacaccgtcggataccttgattcccagtacaatgtccattgttgtattaggcaagtggagatagagagggaggcaaatgcttgatgtatggtaacctagcgcgggaggattaggtattgattgggttacacacaactttttcaatcatctttctcagaaaaataacatcgagcgatgctcccctacagataattcactatcctcccagctctccttcgcggctgattgggtaaagttgatattcccttcaccaacgttcattcatatgttaacacaaagggtgtgccgcatacttaacgctaatgtcaccgttaggaatctgtcgatagttcaggcgtcttccgtgtcgtcagagaagcgaaaagactcagaacagccgaaacttctctccagcatagatgacattggagtcaatcaagcgtccaagccagtttttcaagtaataggttcgccagctacagttctcaatgtcagtatccccccctcgtatccactctatgtgagtaagggatcaattatatcactcaattcaaaggacaaacacagtgtactggactctttggttagtcaaactcggttgataaatcccattaagagaactctttttgggttgatcaacttcagatatgaaaagatttttagcactatcccatttaatgccctagtaagcagctccgtttctacattcagttggggttcgtccagcaaaatagtgagacaaagatcttttgtcagtctagacttggatggtagattggattgggctgtgtttccacctaaagcagtgcaagcctatgctggtgacaatttgactataacgaatccatttttacccaagtcattaacaaagtttcccagggtatatacgttgatttctggtagaggtctgttatctttgacaggcgaaggccagatctataaaattacacttggtaatgagactattcttattagaaaagaaaacttactcgccattagcgtaaacgggaattcggaaataccgcaatctttgaaaaatgtaaacttgaataaggagttaaaagaaggctccagagaacaaatttcaagtcggccggttttaaaatacttcagtcaagcaaaagacgttattacgtcaagttatagatatttgactggaaacaaccagtatataaaagttcatgggcctagaacgctgttgctgagcacaaattctcagttggaatcatttcattacaaaaacgggcagggaagtgaaaattatttcagtcttgccaaatctattggctttgctaatccggaaccacagccaaaggactatctaaaagttgttacaattgagaaaggggaaatcaaggggtatgagtcaaaaaatagctttttagaagagcaaaaacagcaagctcaataagaattatcagctatatgactaagtcctctatctcatttccaagcgcatctagtttcttttcaatagtaaggtgagtctgctctgcatcaaaatctctttcttcattatcctcttctttttcgtcttgataatcatcatcagcatcatctttgtccttttcctccagtgttcgtctgttctgattaccaaattccagtatatcatccaaagttaaatctttctttgcgctcttttgcttttctgcttctattaaatattcctcctctgctttctttacactctctgaatctgtgcattcttgatacaattcaaaaagctcctcattgatatccaagaatgttagtccccaggaaaaatgttccaacagttgttttgcccaatctatatgaccaactattgcaaaacaagcggccagagcttctacgcagttcaatctccacggccttccgtagtttacaggatttgcagctatcaaaaatggtaataacctttcatgtcttcctccaatcttaccaaaaggtatctcatctaatcttgcccaagaacattctacaacggccgccccataagcctcaacaacttctctgtcgtcagggcaaacaacaccggacccatttggtgagactacaatgccgttaaatttgactcctacccgtaaattcttgatcaggcctaaccgttcaagctttttaccgctacatcttttaggatcacagtgatcaaagtcccacatagcaagtttgacaggaaagttcgccgtctctctccttttcacttcattatgcccctttctagagcccttactatggccgttggaccctttagagctgcgaggtctatcatcatcgtggttcttgttctttcccttagccatatcttttgatttttttcatcactgtcttacacttttttgatatctacccatcttccgtacaccacatgagcatcctatcctccttatcaaacccgtaagaacagaccagaccctccattatttcgaccttctaccgcctctagtcagtggatggtttcaacatggcactttctcatttgcctttgttgctaaatccttttttgaatgctctttataatcatccacgccctcaaaagtccaaactacacggcgtcatcaactacttagcgacacacaatgattcagtcgctttgttggtaccttcgacgatatccttgtactctaatatacagtccgactcaaaattgacttacaccgatttatgccatagtgactcgtttattagttcgcatatcattgacttaaatagcatgaccaacaaaggaaaccatcaagtctcctgcaagtccctcaacgggaaggaagtcatgatagggagttcaggcgactatgtcataacagggaacggattcccttacgaccaaaggataaaaatagttaataaggaattatttactgtctttaatgactacatggagtttggaatggagtttttggtagtttttttagagaaaccactcctggactacggagaaagagagaaccagttgtcgttgcacaaagaaaaccacaaagacccttctgaaagctttgatctggttagcattttgagggagtttcctctagttttcaataaggtcagtgaggaataccgggctctttttagagactacaagctgtccgccaccaacatagcagactcggttgaagaattcaatgatcttatccaacgaggggttcacatatttgaaaaattgaatcaatctgacatagacgaaatattaacaaagtatcccattaatctacatgaatgtgttttcaattacatagaatccaagttatatccagaagagttcccacatttaatgaaactgttacccatggactcattgaactcgctctactcgtcattagattcactctccatcactcaggtcggtattccatacttagaaaagaatctctcgatctatgaatcgaatattgtaaaagcatccaagaagttcagcacacttactctgacagacaactccaaagacaaatgtttggtctttatagacactttccaggcattatcttctaatatttcaatagatgcagataccttggttggcctgctattaatggttatagtacggtgcaaggtacccaatttgtctgttcaccttcaatatgtgaagcagttttcattcgacttcgatactgagaatgacattggctttcttgcgtacgttatttccacatttgagggcgtcttggattacttaaatcaacactcaacccggaatcatttaatatcgttggcacaacagaacaaaaaagcgtgggatcttatcaaacgctcttcggtggatataaatttcaatcatcagcaattcaatgattcctctgaagatttgagaaatgccaccaaactacaaaatttattgaagccgtgggaaaatgaagacagaataccacatgattccttcatttggagcagaaattctagaggggaatccctcctagcccaggcaatcatatcaaacaactatcaaatatttcattgcattatacaatttgacagaatattcactatggacgatctgattaaagataaaaccctgaacaatagtacacttttttcacttgccctaaatacaggaaatgacaatatcatctatgaactaagttccatttttgaacaacttggagatgacgagaaatcattgtatctcaatatcactgattccaagaaaagaaatattgggcattatctcaattgccaatttagacttttctcccaattcggtctatttattgactggactgcaagggatatcaacttgcagactcctctatttatcacgttgagaagttatgaccatcctgattatgaagaactggtagtatttgttctagaaattgtgtttcaatggtacgagtttcataacaagaagttttctcttaatgaccatattgaccacaaagggaataccctgctgcacatagtaacatctgggaaaggattgcaactaattttggataggtgcattaatattgatgtcaacatcctaaatggcgaacgacttactcctctgatgctgtatgttaaatacaataggttggaaaatataaaagtactcctggaagataaaagggtgtcccttttaaaaactgatggcacaaaatataacctaatggcgttagactacgttaagaaaaatcctgtaccaaaaagcacggatgcagttattgagcacctattggactcttattttctagaaaggtaccagccttacaatgttattgataataagaagttcaagtttggggtggtacgcataaagattgggcacaacgataaattgttcctgttcttcaagaccattgttgttcaggataataaggaaactgtatacagttctacaagaacctttgacgaattcaaattactaatacgctccattaaactaaataatccgaactcgtttctcaactacaagatctttgatcacttttttgatactcaagatgaaaagtttttgacaaaattcaagtgcaatattatgttcgttaaggttaattcggtttgtagctcactgttgctaaatgattcgacagtagtcgacgatgttctatggaagttcttgtccagtaatgaaagtttggacgaacttagattgaaccatatcaagcactcaacttcgactttgcaaccagaagagattgccaacattaaaatgttttgtgattattccagaaacgagttagttgctcaagagcatattttgaccaatttcttcaagatgcaagtactggtgaatatcaaatcaaaagaatacacttatctgaaggcaaatatgcttaaatttcatgactacgaaattctgcaagatttacagcagataaatgatgagatcatctcccagttgcgaggtggtgataattctttctatacttatcagctatatttgttaagaatgagcacgtcccaaatgatcagtaacattgacgaattagtaaatcatagtattaagaggtggtgggaaatgtttggactattgatgaatctaaatgatgagcttttgaaatttataaaaattgccaaatctaaatcgttagaagcaaagatcaacgaggcaattcagttactcaatgatcgagattttatggcgtgtacgttaattgaggagattgctactaagcttctgtactcagataatccacttgatgatggagatgattggttcttgaataatttatttgagaaaaggcgagttgaaagaacatataagttactagagaaattgaaggcacaaaaacaaaagctattgctactgaacaccaaaattaaacaaagccatgaagagttagctgttgaattgaataattttaacatctacaagtcaaagaccatcaaatttctgttcaggcaattatctacagaaaagttacactttctacatttgagctatgcgacattactgagtagatagattgttgtactataatactagagaaagattataaatttaaggcttcttatcaccgcccatgaactggctggcaagattctgcaacattggattgttcatcaagtcgttcaaatttggacctgaaccggagtcttcaccatcagcactaccttcaccatcagctttgggagctgagcccccacccaaaccaaacttctctgccatttgcctaatggaaggatcactcataagtccttgcagagcagaagggttctgcattaaactttgagcagcttgcatgagttgagggttattcatcagaccagctagacctccggctcccccagctccccctaacaaagaggacaaatcaggtaaccctccagaaccgggtcccgtagattcattggaggccttagtagtggactcttcagtatctccacctttagtattagtagattgaagttgattggcgatctgttcgctgagtttctgcttggccgtattgtaacctttcttcattgtctcactagcattctcgccttcaagatctaaacccttcttgtacgcttccacagatcctttgatgtctccagtaacatatttggcaagtcccaatctggaataggccttaacatacgagggatccgaatcaacagatttttgagcatcttcaatagcagattcatgttttcctaaagaagagtaggcagcagctctgtttgaaaggtaaacactattagttggaatcaactctatggcagaagtgtactttgccactgcagtttcaaaatctctagcgctcatcgctttgtttccctccagcttgaaagcttcagccctttgttttaattcttcatcttccttagggatatgaatgggaacttgttgtgatgatgccgaggatgccccaagaagttcattcaatgtcttgttaccgaacttggctttaacagcactctcaacgtctttatcgacttcgaatgcatccgcgatgcaatctatagccatatcgactgactcaacatagtcttcggacacagaaccgtctttggaggagcttttcagaaagctgatgattgcttggactacttctttattggtggcactcatcgaagattacttaggggggagagtataatgaggttcactgaaacttgagatgctgaggggcgcgactgaaagagcgagagatccttctagaagtctacactgcggcactgggtgtgcttaatcaaagctaagctttaggtgctatctgtcctagttgaagatgcatgtataagataaggtatatgtttgtattagccaatgtggtattcatcaaaactgtacttcctttgtgacggggaagctgtagctgggggcccttgattgagctggtcattagaagtatccactgcagcgacattagttgaggaaccaggctcttcgctggcccttgtaagatcctcatcatttatgttattgataaagttattctgaccaagtttgagatggtaattgtccgttttggtaaggtattttacccaaggaaatgtctgatatgggaattgatcctccgttatcgtaaggtactcaaccatgatccctgagtaagccattaacggcagttgaaaggagagactaatcaaagcacttgggtttcttagatctggaatttctgtatcctcgtccaaactgtcattcagacgtttctcttctgtttggatcgaaaggtagtaaatggaattttgattttgtttgtcaaccgaagaaagttcgtgtagttgtcctagtaatgagtgtctgtctattaactgaaattcacacgtgagtttgaaatcatccacgttcgggttatttgtaacgtttcctggaagagcatgaatctcccatattatgcagttggtctccaagttgactttggcattccctaatttacatttaaacttgggaggaatgttataatcaactagcaattgtgttgataaagagcttagttgtgatttcgtttgattgatgattatcggtatacatatttttaagtcattgagagagagatttcgcttgaagtgagtggtaagtgatgcagttatgcgcagccgatatgtatttttttgcaaaaaagtttgtaaatggggtcaactagaaccaatggtttgagatgtagagacctttgaaggatttgatatgtgaaaagggtgaattttccatctgggggggtaaaagtgattactttactttgtttagaatcttgctcttcagaatttatgcattgatggtagttaacattgtcaaacaaactgtcatccttagctacgttcagggcaataatcaaacggggcattccgctaaggtaacattggcaagtcacttggccactgataaagtttcgttgaagcttcttagtctctagaagataaagcaaattcagtgattcaaccaaattaacaaaaaactcgttcttgggatagaatatgccttttggcctccaagataaattggtagtagcagttctggagatactggtgttcaacaagtttgaatttgtggtgtcaattttttgggaagatttcgattttgaatcaatatttgatgtttccgagtcagaatcttgatctgaaagcttgatatattcacgcagtatattaaaatcggtaagttgcggtattccaaaatcgaaagtttcgtcaaacaactggtacacaagtacgaaattctctctaatactggaatcgtccagcggtcgaccatccaaatattcctttaacgcattggcaaactggtggcaaaaatacagattggaaacgcaattaatgtttgagaaagagaccatcaatatgatgatatcatctgcttggtaggaaatgtagttgcaaccttgataatgaaaaataggttgagattttttttgagagacatagttcgacaatatcaatgagtcgtctaagtcctgtttgtatttccttgatatcagcaggttgtgccatatatcaaggatgtatatagccgaagccatttatcaaacaaagtttagaaggatatttttgataatgtgaaggaaagagaagtagttagaaggatcgagggtggaagaatagctctcatggcagaagctcgcaaggtctttggcgaggtactagtagataatgtactttacgaatcggcattcgttattaaagaacctgctgacaaattaggtcttgacattaagcctgttgattgcaccagaggacaggtaccgcatgtcaggttctgctggagacgtgcagactgtaacttaaatgatgtaggctgacataagctaaactctcatgtttttatgaaagtaacctcacaacatgaaactaactccatctcaacttagaaccctcccccaagctcttccgaaatggaaaattattgacaaccaacttcacaggacactcaaatttcaatcattcgaagatacgtgggggtttctcactaaattggctatgcgatcacatttgatgaaacatcacccgaagatcatcaactgctacactgatgtcgatatttacttaaccactcacgatgagaatggtattactgaattggacacaaggctagcgaagagaatagataaatatgtggctgagtaaagtaaggtataatattataggtatgttgtgtggagctacaacttacacagtactgcggctcattagtttcttctccaacttctcaaattccttcaggctgatctcttcttcaggatccaaaatagccttcacttctttgacttcttccacgtagtgttgcaacattgactcaattccatgctttagagtgtcctcgcttagagaacatgacttgcaagctcccttcaacttgatgtagacaatccccgcatcaggatcaaatctacggaattgcacatcacctccatcatcctgaattgccggtcttatccttgtatttattagttctttgatttcatatgttacatcatcatctgtgtctaacggttcttggctcacgatgtaatcgtcgtggtgtacattggaaatgttctcaagaaactgcggcgttaagacattcactttcttttcagaacttttactcaagctccggtctatcacatttataatctggggctttaaaaactgccatcttgaatgatcactattactaagtttttcgtccaccttattgaccgtgatgaaatcatctcctatgaggatgctcttaacgcccggtactttaaacaattggagagccaggggagacttctctgtggccgaggccaaatcatctatttctatagttgacttctgaatatggggtggtaaaagacgaacgccttttgtgataaactttagagcgttgtcattcggtgtggatgcagtttggatcgataacaaccgacggaattgggaagcaaacctgttgctatacatcgcattaaacgttttcatcttgcaaatatgatctgtatttgagtccagaacagagaaatcatttgctatttatctgcgcttaagctgattacaaccaggcgcgattggattggggaacggttaaagaaatccgtactacggaaaaggtcatcttctgttggatattaccccatttggaaataatgttaattatttgattatgatgttttctctatgtaagtggggaagggaaccatgttaagctctacttcttaaagacagcacttcgattctcattgaacttagcgtgtttcttaggttcaggatgtggatctttattgctctgcgcataaggatcaaaactacgtttcttgcgtgattgcttgggctttttcctgggctctatctctagcatcactttatctgctcctgcaaaatctaatggtggttgatcatctacctctggtacaactggttgtggtttcgaccttgcacttctatttaaaacaatcacttctcttggatcctctttctctggttcagccttcgtttctggagtcttgacttcctcctcctcgttctccgattcacttacaactagcgcttggggtgcaagaatcttcagtacctgactagtgccacgttcatctagcgattcttcactgacattattctttgaataagatactgcaacgttggatgaatgcagtaatatcctagaatcctggatgagcaagttcagtgcttcattgtctaactgtttttggctgtccattagatgggagtataatctatcagaattcaaaactgtctgataatcgacattctctgcttttttttctataccattactagtaagagacttgacatcctggttctcagccccttctttcaacgtgcttttgataatttccactaactcagtggcgtatttcttcaagtaaggagttcttatgtttgagcaggacatcaaactggaaacatcggtagggctgatacttgtgatagtcgccaacaattggttaggaaggacatatcttgtagactcatcatcttcacgagcaatctcatctctccagttatacaatgcgataaaaacaggttgtcttgatcgtggaatattgtagagataaagaagttgcttccaaggttcctttcgatcatttaagggagacacaaccaatggggtaggaaagttaggtctgaactttgtatactcgaaccttcgcaaggcaacttgacgagaatcatacaaaacttgagaaagttttccactttctatcagcatattattcaactggtcaaaaatgtacaacagaaaatgggtgtctgacctcgcgtatgctagtaatggtttagttaatggtctcactcgccagtctgcaagttggtacttcttagatgtcttgaactttgcatatgtttctaataggtaagccaaactgtgcttaggaaatcctagcagctttgacgcatgaaaagtatcaaacaaactgactacgtaaagaccaaggtctctttgtagccaaattatatccatgaatgctccatgaaatactttgacgatagaggggtctgtaaaaactttattcaagggttgtagtttgaatcttaactttagcgtatcaacaatgtaatcctggtttcgagtactgatttgcatcaagcacaccaaaccgtaataagtacgaagatcatgatgctccaagtccactgcgatgacatctgctttacttagcgtatctatcatgtctccgacttgttgctctgtctccacataaattgcagtagtcgactcccaaggctgattcacaatcggctctcttctttccaaaatccattttggatattcctggctattaatttcaaattcataagggtggttatggtgttgcggattgtcatcagtctccgggacaagtttatggacctcttcgaacggcactacactattatacttttgattgagtagaggcctgaaaggattagactctgtgttgtcaatggggtaattatattcgatttgaggcttgatcatgtctttgcttgattttctgctagcctgatctttgctgatactgtcttccaaatatttgacatcattcgtactactaggtttacttgctttatctaaaagaatgtccactctttcgcacagactatccaggccatttgtaatctctgtataatcagtgtcaatattagaagggtcatatttgagcgttttagcattcaaacatgtaagtattttatttgtaagagagatcagtttcttactcgattccgtcacagatgcttccaacgatttatccaaagattcataaaacttaatatcctgagcctctatagctgtagctatccttatggcattcgccaattcgggaaagagctcttgaactccttctactttgtctttcatttgaaagagattggcttaaacgtttagagagaagaaaaaaataacttcacagtttcgagcatatgcaatttgatagatgatgggcagaagatgtgagcttgagtaaaaaacgcctctcattgtgacagattataaaacagtaaatatttccggtttaggatgctttgaccacattgagctactagttatttatctttattttcctcttttcacttggggagacatgagcagaaaagtaaagatgttgaatctgctcaattgtagcttaaattgttgattaggtaattcggatctgtagtactctgaaattcaccaaagatttgaagaatactttatgggtgtccagaacatttctttctagttaaggaaaattacatacagtttctgctacttttttttgtacaaaagttagagaagtaggtaatttgtgcggttaatagttgaattgttaactaatgatgaaaccccaaaacttaccacttattatagtcagcaccttccaacacgttggcttccgatgtagtgtaacggctagcacggtccgctttcaccgggcagacccgggttcgactcccggcatcggagatttttttttttagttattttcctcaaatgaagtgagtctgattgattacgttattaatcgcccgtagtggattttatgcgaacctattgttacctcaaacttaattgttcacctataccatcagctaaaatatatactgccagcaattacttcaatctcggctatgtacgacgagattgcaccagatgctcagttcccacgcttaatcaaaccgattgatgtcgtggttgttcaaaagagtttccccagtaacagcaataatactctttcactggttgaaggccaggtagtgcatgtcctcaacaagctgccatctggatggtgggatggattgatggtcatggaagattctaagattatcaggggctggttcccgtccaatcacgtcaagtcttctcttccttcagttgatgcaaacactaatcgagttagtaacaatctaatgacagctactaataaaccacatataaacttgccgaagtcaattttgaaaaacattgatgactttgaaaacaaaggcaacaaatcgaggcatagcagtacggtaagttttgtttcgtccaacagtctggaggcagtctccagcaataatactcaaggacccaagagaccctccatagtatcagagaatagtagggatgcttcaagtaaccattcgggttcgaaagtgttcaatctggctgaattggaatcatatcttgaagaccatcctaccaacgagacgctgacttggatgcctgtattcaacgccaagaacgtgctcctttattactctgaagtattggatatatgttgttctgagcttccgatgacacatcaaggaccagtcggagaagttgcactaccatacaagacttcatcaaacgtcatcgaacctgtggaatatgatggctcatcgagaggacctgcctatcaccagacgcatgactttgcagctagacaagattccctgactaattccaattcgagttttcaattcaggcaaaagaagcgttctgtccagtttgtgaaacctgattcaggcttactcaatctacctggatatttctattctaatccaactgatataaaaacctgggatcagtttttggcagcatttacatctgcttccgaggcaacaattgatagtctattacaagggtccaaaaaagagttcacaatcaatttgatgcgtactagcttactggtgacgttgttgcagctgatcacgaggctcaaacaaagcaagattgcaaagacagattctttaaagaatgtctcattcaaactgaagaagatcaccagcatgttgacccaattgactgtcaatggaaatcttcatttttcagcctttgaggattctccaaactatatgggcaatttgaaagacatggtgaataagacctccctgaccgataatttagagaaaagcaattcggaatatgcacatgagattattgacagattgaatgaaaaacatacgacgggctctaccctcaaatttgagccaagcctatatctgcgaaaagctgaagtgaaccgtgctattttatctgagcgagtgaaggacaccattcagattttgagacagatttcagacgcaacttttctaccacaaatatatccaaggttttttcaaaatgggtttgaggcagctaactggtctgtttattttgtggatccccctccaaacattttccaggaggaattagattcatctcctggctcatcggttacctccaatacgtccgattctacacccaatgtcctgagagcactgcgtacaaaacatacaagacctctgaatgaaaggacagctatcgatttggaaatgatctcaaaggatttgaactttattttccaagacatcctgaggagcctaaaatctgaaacgcctccgaattgtagtcgttacaaacattattatgatattactgttgacgttgctacaattgctcatagtctcattccgttgatgtcaaaattcctcaattacctggacgagctagatttctcattattcaaggagttgaagagaacttttggagatactttaagaaccttgaagaggagcaaagatgcggatcaaagcagtcaaggggataatgattatactcaggctaagagagtcccaaaaaatggcgacagctcgagatttgaagataatggcactcgggatgctgatagtcatgaccaaacctcgacgagtgaagcgtttttagtttgtgaaacgttttttaaggcttcatttgggcttgtgacagaattctatgattctaaacaaattttgtttaatcttttcagtgatattgtccttgatgtacagtctttaactcttgatgacaccgagtcgtttctggcactgagagaagatgacttagaaactttacttgactcacctgatttgacaaccagattggctgctagacttgcaaaaagaatcaaagatagagagatctttgcgtcatctacttctattcattttgatccattgaggaaaatgccaattactataggtaatattcagaacagactaatgataataattgagctttgttctcagcttttggaggaaaagcaaattttacttaactatacggcaaggtctatgattgatggtttgaatttccttcctactttgaacgatagtggatccaatattggaaataaccagatgtcccaagcaagtagcactgaggaagttttggaaggatgggatattcatgtaccaggatctgagtttgagccatggtttttgagctcttctaccagagagaaggaactcatctataatagtaataagacattgaagggcggctcgaaggatggactccttgattatttaactagttctgccaacgaggatgttatgatcagacataccttccttttaacatttaagtctatgttcagggaggttgagtttgtaagcaagcttattcaacggtttaatctaaaagcaccagaaggtttaagttatgatgagtataggctctggttagatcgaaaattgagaccgacacaagaaatggttttgaagattataatacccctattacgtgattattggaatgtgcattattattcgcccaaattaatgagaattttggaccagtttgctacatccttagctaggacctctttttttaaggaaggccaaactattaaagaattggttaagaaagtagcaaaactcagcatagatgcaggtccagacgaaccaactaacaattcacatttaccaataatacacaccgataaccctccacctccaccaatcctgccgaaatcttcctcaattaggaagttaaaactcaaagagattcactcaagagaggttgctagacaattaacgatcatgcaataccgatactttgccaaaatcaatcagatggagctgctatctcgatgctggaacgctaaaaaatatggatccattggttcatccccgaatatcaccaaatttattaacgactgtaaccgactgacacatttcacgtcgtatatgatccttagaaagaaaaatgatatcaagaagcgtgcagagtatattggatactttatcagagtggctaatgaatgtcgctcaatgcgaaacttctctactatgactgcgattatttctgcattgggatcaactaagatatctaggttgaagaaaacatggaagcttgtaccggagcaggaaattagtatttatcagagcattgacgctttaatgtctatcgagaggaattacggagaatacagaagtattctcatgaatgtttctagtgagccatgtgtcccgttcttgggtgtctttctttcagatcttcggtttatggctgacggtaacagcgattatttgaagaatgtgaaaacaaacaaattggacaagaaactcatcaactttgaaaaacggtaccgtattgctactttggtaactgatgcgcaaaaatttactcaaatcccccccaacttccaagaggtcaaagagattcaagatttgattgaaaggttgagtgaaaattgtcctacagaggacgagttgtacgaattaagtttgcagattgagccacgacttacagtgtcgcaggtgatgaataagtctaactaatgtaattaggtatagttctaggtacttcattgctatgagtataatccatgtaattatgctgagtagtttactggtaggagattggaccgtgattgacctgagttttgcaaggtcgcgtttagaagtatctgaatgaaaaaaaagattttttaggcatttgcttttcccatctcctatcaacaagcaccagtcgaatgagtgagctacacgaggtctgtcgttttgtagataggcccataaatcatgactatgtattcaagttaaagaactacttgaaagaaggaattccggctacatacactcttgaggaagcctaccatgttgagaatgacattgaagataaagaacttagttccaccacaacacctctacacataatagcatctcacattcctcaagatgccacggaagatgaagaagccattattttagaaatgttaaacgagctcttactttggggagccggttggtccctgattgataaggatgatcaaactccaggttgtatccttgataagagaggctttcatggatcggaatactggaacaccattgtaaatgctggagtaagagcagaaatactactgcgaaaggtcgaagataatatagagtttattgaagatgaaagtgtgaacatcaatgaggagactataggggaggaagcagataatgggcaatccgtaaacacaaaagcagatgacgatgaggataatgctattcaagagataaggcagcagctacgagatgatccttcgaatacaacgtccacctatttgaagactaagcttgagtacaaggatggagcacttgtgactaaagaacgcggagatggtgtgatgatgtcatgggaagaaaccttgatgcaggcaggttgtgacagcatgtttaaaaaccaacaaccagacaacgaccactgcgtcttgaatattggctttggcatgggaattattgatgcaatgattcaaaagaaaaagccgagaaaacactacatatgtgaggcacatccggatgtcttagccaaaatgaaagaagaaggatggatgaacaaggaaaatgtcgtggttttgagcggaaaatggcaagaccaagtatccgagttattatcaaaaggagttttttttgacggaatctactacgatacatatagtgagcattatgaagatatgctagatctcttcgatttagtagttgggctgctcaagcctgaaggtgtgttttcatttttcaatgggcttggcgctgacagacgagttgtttatgatgtttacagaaaattagtggaacttgacctaaacaattacggcttaaaggtttcgttcaaggagttagtcccccccaaggaaaccttgaataaacctactgacacaggtgactcagtgtgggatgatattcgcagagcttattggtcttgtcccgtatactatcatcctgaagcagagttcatgtagctttaatgttaatagacataaaacccccctcccccgactgcatccttgaatatccgacatttagcatccagcatccagcattatgtatgggagacacattgcaagtacaaatcccccctaccttccacgcgcgctagtagtaaaccgataaaatcagaacccaatcacttgtagaatcaattcttttgaaggtagatgttctcaaaactttcccagttatcccagaatttaggcgaagagctctctaggattaatgaggaggttgctgcctctagaaggaaccaactaaagaaaagcagggattcggagagggatacaaagttccttaacatcaaaactcccgatcctgaagctctacaacaaccgggtcatgaggtgaatgaaggcgctgaaaccgaaacagatgctactgagtcaaagggccaagtggttccaaacacaaatatacacttcaatgatctgcctatggagattagggcccgcttgaaaaagtttgcgaaatatgagcagaaatatccgttgttgttggacgcttacaaaactgagaaggccaaatctgaaatagttcatgcttttgaatcaactttacaagaagtcactcctttgcagacaattggagaaattgaacaattcaaagactttatcagcaatatgacccaaaaggctaaattaatggatgaagaattgagagccaaaactggcgagttgaatggcctaaaaaacgaagtgacagaaatgaaagagaaattgaaggctgttcaaggtgagatgaaagccaagtctgctttagcagaagaatctgcgatgaaagccgatcaacttagtgtggatcttgaacgagttgtgagtgagctagaaaatttgaaaaaggaaagggaagagattgttacggagcgtgatgaggcaaccaaggaacgtgacgagtcaacaagagaaagagatatcattctagaagaagtcaaatctaataaaaatcaagaacttttggaggaatacaagtctgagttagaagaagcaaagaacgctcttgcattgagaactgaggagattgaaaatctaaacttgaagttggagtctgaaaagtcggcaaagttatcattagagggtgtagcagatgagcgagatggccttaaagcaaagttagaagcgcaaacaacttccttccaggaagaattagaccaactttctcaagaacgggatcgtttgaattctcaactaacaataggagaaaagtcacagatagaaattgagcaagaaaaaaatgagctcaagagtcagtacaattctgagattaagtcatcgcttagtaaactggaatccgtaattaaagaaagaaatgagctacaacagcaattggaatctcaagagtctttaactttcgaagtggataagctctctaaagagagagatgagctaaggatgcagttggatagagaaaaagaaaattctgcaaaggctagcatcacgccccagaactttgaggttaaaactaaagttgaatccaacaagaacattgaagcacctttatctgaagaactcaggcaagtcaccagagaaagagatgagctaaaagctcagttgttgctcattcaaaagaacccaggaccaagtaagaagaccaatgaaggaaaccgtaacttagagcggaacggtgaaaaaaagtcccatgaccaaaatggtgctgacgatgatcttatcgaacggaagggtgaaagcggtacagatgattcaaaggataatcagctgaaactaatagagcagtcaaccactattacgatgttgaatgaagagattgaaaacttgaaagatatgctgcgtgacgtcggagacgatcttgtagtggctaaagacaagctttcacaggtctctgctgttgatgaaaaaaaacagcacgctcttgaaagggaactggaatcctcaaagttgaagcttgctgagattgaaaaggattacaacgacgatagagttgacctcaagaatgaattgaaactcgttaccgaggaaaaggaaaatcttgaacatgagaatgaaacattgagtcaaagcttgaccgagcttgaaaagctgaaacaagaagtcaaggagaaagctcaagccgttcagaattatgaatctaagtattcgacactatcggatgaattatctttagtcctctccaaacgagatgaattggaaaaagacaaggaaagtttcaggctgaaattgaaagatttggaacagaaaaattccgagactgaacaacaagaggaatcgcagagaactggaactgcagaaatggaagaggagttgcagactttgaaaagggagctagaagcaagctcccagcgcattgaggattataagcaaaagcaactagaactagatgatgaaatatctcttgtacgttctcaaaaagatgaattacagaaaacgataactagcctgcaagaagacctggggaaagagaaagagaatgttaagttactccgtgaaaatatcattgccgaagaaaaagccaaaaattcccaaaaactggcagaaaatgtggcgcagctagacaaattcaaaaagcaggagatatcactcaagcttgagattgcaaaccttgaaaatctaaatgctgaaaaaggctcaaagatcaaaagtttggaagagcatatcacttatcttaatacagagaggcaatctaattatgatgagaatcagaaactgatctcccatactaatgagaaatggaagcaggattacacggagttagtcataaaattgaacaagtgtcagtcagagaacaatagacttacaaaagaattgaacgaatacaaagataaactaaaagatatgaacacctcaaagctgaacagtagcgagacaatcgagtcaatcagaagacaatgcgaagaacttaaaatgatgaataatgaatattctttgaagattgaaagtctacatgaagaactaagttcttcgagttcaattttacaggaacgttccagagaaatgaatactatacgtaaactgctagctgatactgagtccaaatgtgacgaaagaatcaaacagttaaaagcaagaattgataggttagaagaagaaaaggagacgactagccatgaaagctctgtccaggcaagaaagctgagtaaaacaatcgaccagttaaagaaaggcaagaatgaattgtcagtgcagctagaacaatgtaagctagagctggaacatctgaaatccgtcccatctagagtggatgttgacaataaaaacggtgcttcaaatgaaaacagtgatgaaaaccaatctgatattgaatctggaattatcgaacagctcagaaactcgctaaagggatatgaagaacaactaaaacaataccaagattccaacgtcttactcaagaaggttaacgaagagcagttgctgaagttcgagagactgcattcaaatttcaagattgtatctaaacaatatagaatgctgaaagatcaaaaggacgaagtcaatacgagaagtagaaacaattcagttataagttcaacgagcgcggggagtgatgaaaatgagagagataaagttgcctatattaagaacgtccttctaggatttttggaacacaaagatcaacgagctatgctttttcctgtagtgaagatgctacttatgctggacgatgatgaagagagaaggttagccagctcattaaaataagctggtttccttcgggatggtttatgtacatgtacagtattatttagacagatattctttccttatcatccataaaactcctaagtggagcaggaatctctattgtcttggagagaggatcataaaagttttctattatggccacaatcgttctgggtacagcacacatggtgccattcaatgtgtgaacaaattgcagcttgttagttgtagaattcctatatttgatgttgagccttcttgcttggtagtccaaacagtttgaggtggatgagagctctccaaacttaccacgtccgggcataaaacattcaatatcaaacttttggtatgcaggggaccctaagtcatttgatggcatattcatgaccttgcatttgagaccaaggctggtgaaaaatccaatttgaagattcaatatgtctttcaaaaccttacttgaagtattgacatcattttctgtccactgaaaaagctcaactttggaaaactcatgaaccctataaaggcctttggtatctttaccatgggctccagcctctgctcggaaactgcgggcgatagcacactgtctctttggaagatcttgggcagagaattcggcatctatccataaagcagccagtggtatttcagctgtgccattcaggcattggttagagttggccaattcatacacttgttgctcattgttttggtctcttggcttaaaaccacaggcataggtgacttcatttttaacgactgagggaggaatgaccatttcatacccattttgtcttgcaaatttaagagcatactgaataagagcttgctccaacaaagccccatcattaagcaggtagtaaaaagacgttccgcttaccctgctagcagtctggaaattggctaaattgagatcttctaagatagatttatggtcaaatgtggggtctggctttctagttgacaattcttcgatatcattcaatgagcaattaattgttgacacaatctcctctttgtccgaaacagagggatgaatcaagttaggcaacgattctgccatctgataaagagattcctgggtttcattgtagtgggaagatagattcttgatcctgacttttaacaagcccagttcttctaaaagatattgattgggtcctagattcttcacttgagagtttaatttggatctttcattcttgagattccgtagctgcacatctaattttacaaaatcgttatatcgatcaagtatacttgatgcgttccgtaaagtttgttcgttgacaatccttctagaacatgaatttagatattcatcttgaagctgtacaatggatttgaagtcaaatgaaggcttccttaggacgtttgagtttgtggagacagagatataacggatgaacctcatctgtactcaggtggtcggtccgctcattgtcccttgaaaaattagtacataggagagaaagggaagacaccagaattcgcgaaaataataaccaacaaccggcccgcaagttcacctacatcagtgggagaagagcctattaaccagttactggacgggcgaacgaatggaaccaagtaggacgttagagcatgcttcgaggtgtttcacgggcaactgaaccagctaattagtttgagagagcagactgtaattgggcataaactgatcccgtcttatcaaataggtgtcttaagaattgaaaactgggggagaaaaaaagacacctaagaataccactttggggacttgggtactagaaagaaagctcaacagtatttgagtttcgaaatatttaagttttatttgaatttcgaagacggtgagagttttccagtcatttcaactttgctaaacccgaagagattccccctagaaacgttgcgtagagtttgccgacaacaaggatcgaaggacaatagatagcgctgtttgcttacagataaagtaccagcagtgattcatatggttacaattgcctttgaaacggtcaggcagatgattcatatggcccgccagttttattgtgtacctaccttctcagcgacatgttgttgtatgcacatagatatcgccgaaaaaacaggccagcgtgcattcctaaaagtctgcattgctgtatcttattgtgctttgaaatctgcaataatacctaaacccagattgaaaacatccaagattcaactttgagctgattgaatgttggtagggttactttcaaatgttgctaatctgcctggtcattaggcacacatcatactaatgggtgtaaatggttcgtaattagataattattcagtgggatgaaagcagttaacagcaattcgcgggtctagaaagtggtgagcaagtgggatgcaatttttttatccccgctttcacaattcactgaacttacacagatgtcccttttctctgagcacgtctcaccaactctacaatgatcttcttgcacggtgcaatactggatccgttcccaactgtcaccatggtaaacctacggttgctgctaagttccagacagggaactgattcgctatgtgcgagcgaatttcaattatgcatcatttgcatacaggatgcagtagccaatttgtggacgaaaacagaacgccaacgtaattatttctgtggtttgatttaatttagtgtaccagtagcccaaaaaagctaattgacattggatggagttttccattacctgtagaaatgaaaaggtagtacgagcggacaactctgaaccttgaacgttcttgtgtcattgcgaaacaaagtttgtgcgcattgtgtcattctgattttgtgcatactaaaactcacaacggtggatgctaagtctttacgtcttaattagccgttcatactaaaaaaaaaactaagtagaaatcaacgactccctcaatagttctaggcgtgggatgcggtaaagaacgggcaggagaccctgatgtcatcagtaatgaacaaacgtataaaggtttactgacaccgattcgcgaagttcctctgtcccagaaaatagttcgttcctttacaggctcatttcattcaaaatccactggcagaagctttggatgcatctttttcttcctccctttttttctccaagcaaaacaacattgtaaattgtttttaactcacgtttcccactagtctggtaatagtgtcttatcaccagcttgtcagtctccaaataccatcgtgttagtacaagcatgagcaccaactcctcctttacgagcaacaacatgaagctgggtcttcgtcgaggtccatggtcaacggaggaagacaataaactgatggatctcatcaatctgttaggagcatctaattgggttaggatatcacagaaccttggttcacggactcctaaacaatgcagggaacggtaccatcaaaacctcaagccttcgttgaaccgtaatccaataacaccggaagaaggtgcatgcatcgaagagttggtgatgaaatacggtaaaagatgggctgaaatagcccgccatttgaatggtcgaagcgacaatgctatcaagaactggtggaacggcggcgccaataaacgcagaagagcctcattgcaacatagtagtcagggatctgccactaatacaacccccgttacagaatctaacaacaatgatgggttgcctctgcaatctatacctcctcagcatccgatagctttcaatacttcaatgttcagtcaagcaaaccaacaaaatgcccccggtgcccatcaacaacaaccaccgccatcgcaagagatccatccatcatcatatccaccgctccaggaaaatcattccttatctcacccaccccctccaagcttgcaacaacctcaatcactttcagtagcaggtctcactggagtgaatcaattattaccacagccggccatggggtctgggagcggaacaacactaccaccggtctcacatggcgtgtcgtctccttcccaatcattgctatttccttcgcaacagccactccaactttttccccataaaagatctaccagtgtagacatgcgttttgatagcaacttgacagaaactcctactcatctttcctcgttgaaaaagaagctctatgatgatccacactcattacgacgtcattcgctgaataacacctatttattcaacaatcaagtcccaaatatcaacgcgtctcatcatgcacagtatcctccaagttttaacaattatcacgtcaatgctatttcattgaccgatcctgtttatcacacttccagaagtaactcgattaacccattatcggattcctcgtcgaatcattctgtggtgctaacttcgaacaacaactctcgaaggtccagctatatcaatgctgattccattcggggtaaagcatctccatctttggtacctcacaggttaagcatttcatcaatatgctcttcaaggaatcaaaataatagctctcctaggctttctgcttcaatctctagagaagaaaatttaaagccggaggagacttccgaccgggaacgtagcaatagtaaagagaaggagaatcagattgaaaccaccgcaggcgagaatgagagctttactgaaaagggtgatgttaaaggcttgccttcatcgttatctgtctcgcaaaagaaggacaaacaagagagcaagatagataagatgatgatatccaatctactagcttaatagtaggtggatgtacttagttctttaactttaatacattactttattataccaattcacggaatgcaaacacttagatacgaaacttttttaccccccctaattcatctcagatcatttgatcatctccaagatttgttgggtcaggttgataatgtcatcaccatcattgaactcaccttcctctccatcgttattaattatgttactcgtgtcactatggttgttcaatgtagacgtggttaaattattgaggctaatctccccactgttgatctgcttcttgagtttagctttgatagtctcgtcctcgctctcaaggagttgcaatgtcgtccataaggcaatatgctcaaaagtggggttttgtgagttcaagaatttggcaataaattttgagatttgttcataatttttcaatattatggtatagtcaggaattctagagcacaagtttgccaacgcagctgcagcattaccacagacttctccattttcggaagacgtcaaaggcagtaacacttcgatgatgttagaatcaaggagcttcatcttcaaatcatctgctagtgccagaatggcaaagcatgcgctaatttcactttgcacagatattggagagttcaacaccaacttctcgcacttttccacagcaccagattctaataatgctaatctattcctttctgatgaagcggccaaatttctcagggtggacaccgcgtggcattgaatctcaacattgtcattgtagtccagaagggagactaatggcttgaggaatccagcatcgataatcaaggcttcgtttagcggatgaatggaaatatttctgatacatgccacggcagcgagaactagcggttgatgagtggaattcaacaatgtcaccaagtttggtagacctcctgctcgtactatctccagttggtaattggcgtccgatgcaagatttcgcaaggccagagtagcttggcattgaactcttggtgacgtggagtccatcaattgaactaactgagaaataagttttggctccgtacttgccagttttttcctgttaccctcatcaacagctatgttggataatgcagtggtacaatagtattggacatcgggatccgttgacgatagcaactgaactaatattggaacactacccgcgttaacgagttcttgtctgttctcgagagaatgagtcatgttcagcaaagcacccgttgcatttctttggactcttaagtccttggactttgccagcttagtcaatggtatgagagcaccactggtagcaatctttgatttattttgatcttgagttgccagattggtgatacaaccaactgcattgcattgaacctcgatgtttggagacatcatttgtctaatcaagggctctaaaccacccatgtttacgatcaataccttattagaatcattgacggcaaggttgcctagcgcagcacacgctgctctttgaacctccgcatcagagctttgcaagaggatcaaaattggctccaagacgtcccttgttacaggtctgacatctttctcagtaacttctgcaaaagctagagcagcgctcctttgtagatcaatattttccgaataaactaacgttgacaacgctctgagcggtccatcggtaaaaaaatctacttcagaccggttttccaaatactgaagcaacgatgaaatggcttcccgttcattttctgccaacaaaggtgggtatgactggtcatgttcatacctcttgaaacaactacagcagactcccataatttaacttaatgcgaaaactcgagaaagtctcttttatcttaacagcaaacaaatgtaatgttttaatggcaaacagatgaacgactggtgatggaacgattgttatgctggcgtttccaggcatttttgtgataggagcagcttgttgtttgcactaccttcttttttgaaagtacctgggtgacccgcgaatgggctgaacccaattacataatatgtatcatggaatggtatatctaaacttgcatttgataatactaccccgttactctaaccagtttcggacctgatgatatcaaaatatatatacataaatagagtacttattctaaatcgtctgcttgatgaatagctcaatgaatcccttgtcttcaaaccagtctctatcaaatttcctgagagatcctttcttgaaaatggccctagggacagataaatctaccagataatgtatgcaatctcctggagttaagactccaccttctttatacgcattcaggactccgtttaatggcaacccgacggaaacaataaattttgactgcaaaaatgcattctcagaatttatatgagctgagcttggctcaagaccacttgggatatctaaagacagaacattgacgtactgttgattaacccattctatgaggctgttggatgtcgtcaattcaacaccaaaaagatcatccaaatggttatcataaccttgtaagccatcaacgacaaattccaaaggggattgcaaactgtctagcagcacagtcaattgattaatatcgtaaactagtcgtccaccaaatttggtaaatatagttgattgtcttttcactgagtctatcaactcgtcagagtttgtattcgtcaagatggctacacatctggcgccaatatttaccaaccttctaccaactgacaaaactctggcacctgatcgattgttcccgaccaaaaataaaattaaaggcggtaaattgtggttggtttggtcgaacctagcgtaaccaccaagactcttaataacaatagaagaaacatttatggcaacattctctagcaacatctcgataggaaccttgtattcatcaactgtgatcctctccatctccaatagttgaacaggggagcaggatggcaaaagattggccccatcggtcaattgaataccaaaacccggctgcctaatggatggttgtctctgtagatggggaaacgtagaggtactgcttctagacggggctatcggagtaggaatcgattgctgattatcccaagtatcgacctctttcttgacaaccatttcgttgtgatcatagttgaccttcttattatgccccgctaatctcaaatttggatcaatattatctttagcgctgagttccctgaatacactttctttatcaaacttgtccaaattgctctgaaaatcaaattcttcgttgagcttatcgtcaccattccacgctatatcattatcgtctttcttggccttagactttttcttgtttttgtttttcttggactcattgttctttagtactttatcacataagctcaacacttcaagcttggcaatatctcttcctggtattttctggtcagggatagattgtcttgtctcggtgttgaggtcaaccacagagctcaaggatgcaaccttattgtcaaccgcatctattttcccttgaaatcttttgttgttcttcagcaccagtagaactgtgcttcccaagaactgtgacattttcaaatagaactgttacaacaattagttgttgggtaagaatgcgtcttgggagtgtgaactcgatgaaatttaggaatagatccttcgcgacaaacactattgttagaaggagattgagctatagaaccacccttcatccccagattacggtactttctgaaccgttgacaaaggaaaataccaattaagtagctttagccgtccacttaatggaattcaagcaatcagattttgaacatttagtggaattaccctcggaaattgataatggcgaagtattgtacagcccagttggagatgcttctatgctgagctgtggttgcgtgataagtgaaaacttattcacctcattgaaaggcctatgtgctgtttgctatgcaaaagacatacatttggtaggacccgtttatcagcttcgtgaattgtatcatcttttaatgagccagaatgctttctcaactgagtacgtaaaatcgggtcagatcaatctctctaaacaagataatctggatacaaagcataataaagggatccctattttggatgcattccaccagattttagttggtgcaagtaaggaaacccaggccttccaagaaaaatccaatcagggaacggtctttccgaagaacgaccctcaagatatagccaaattggactctgacttactgcacatttctaaatcagctcagctaggtgtgtccacatcaactacccattctaatccagagttggaactcaattttgctaggaatttcccatttttcaaaagacaataccacttcataactcaaaaaaccaagatgctactaaaaacttccaaaatattcattaataacgctatctcaccagcattaaatcagtttgttcttttgaatgaaaccaagtttcaagtgtactccattgaccccatagattatagttcttctcctaagatgaaatgttgtggaaaatcaacaggtgagtttggaccttcattcgattccttaaataaacctgttgtgcgagataaagaattaatttcaaagctcaacaaatgggagtacttagcctgtcgtataactaagaacatgttgataatatcaggaacgagaggaattttagaaatatacgataccaacgacaatggcaaatgcatttatacgtaccagtccaagtttcctatacgatgtattgatgttagcaatgatgaatcactaattgctattggtattacaggaaaagataaatttacccagtctgagcaaacgttgattacgtttcttaggctagattttttggaaaatgagattaaggttgatgtaatcactgtgactctaccctacaaagatccattgaacttactacaattttctcctgattcacagtacttgggttgtgctacagctcttgaatttaggttcatggtaatatcagtcattgaccctcatgaaccaaaactagtaatgaaatccctgcgttcgttggactcctccttggagagtgagggaatcaccgacatgcaatttttccccgacaacagaacactcaccctaacttcagttgcctttaatggttcaccggtagtcattgactctaaactcaactctatcgtaggtctacaggcaattgctcaacccacaatgctactgaaagttgatgaagttggttcagccattcacaaggcttgtatttctccaagaggggacgcagttgcctatcttgaccgtagtggaagttgctaccttcttctttcaccaattatggacggaaatgaacataagcgtgtggtgatagttgcagaagtggctaatgctgttcggttcaaagaggctgcgagcatgcgatttgacagtgatgggtataaattatacatcctggatagaaaagggtcactctatatagaggactttacagcatcatcagacttaactcgatgcaaacttatctcatagtgtttcaaatgtaatattaaaaggacaacctatttatgttttctcttctttctgaatctcaaaccgtcaccatcttccttgactacaaaatctttgaacactttctctctccattcacctagacgcttctgtcttccatactttcttttgtccctgtccctttggtctttctctctgtaaggggccagttttttgataccaataaattgattcaattgggaatcatcagcaataagaatgtctctgtttgaaagaccaaatgattccggagagacttctctataagtgaacttgatggtgtcagaagatgttgctgttctgcctctttcttcatcaagctcatctaataatttggaactgttctgtgtaacgattttttctgctgtttctttgatactctgtttctcgttctttgattttatattcgttttagctttgtcagaagagaagcctttttcttttaacttcacagactctaattcatcagcatttatattatcctcttcttcttcagaatcacttccttcatcactgtgctcttcgtcattgttgtagctttcacccattatctcatcatcatcatcccacgtaggcttcgtgacttcagcctggtaatacgcatgatcaaatatctgagacattttttggtcccagtcggcatcattgaaatcatcattcattaaatcttcaccaaataccttcttgataagatcttcacttacaccttccccgacttccctcttgatcttcatcaatctgtcagtgactaaattgatttttttgagctttttctgttgcaaggccttttctttgttctgtttctcttcgagtttctgttgcttcttaatttctctctgtttctttctactatttgtttgtcctcttctgagagtggcttgatctctagcataagtgacaatttcagcggcgtgaggatcctcatatctaaagttgtacgcttgttcgaattgctctaccgcttcatcaaactcctcatcatcttcttccatatcaatttctttatcagcttctttgggaatccaagcttggttactgatgaatttgtccaaaaactcctcctgattctcggaaggatctggcaggtcatctgcagcctcaacagttctttcgttttctttgcgtttcaaaaagtcatcgtcttcatcttcatcactgtcttcgttctcctgtctacctgaaaattcaacctctttcttgatctcattcaacaacttatctctctcatcacgttgttcaatgacatacggcttttctccatcttcaaactcctgggcctcacctaacaaattctttctgtggtaatctttaaggtaaagaggtttgtattctttcttgagatctaatttttcgacagccttttcaggatcctcaaaaaatctcacattgggatcaaacaaggatttgtcattagatttgatggcacttaaaaccttgttgattccttgctctacttcatcagtgattagatcaccaacttcatcttccagatcagaggacgactctgaagagttatcttcctcagactcttcttgatcctcactgtcatcatgctgcttttttgatatgtccaccccaccctgttgaccatctttggaatcaagtgaagtttcagttactgatttctggtttccacttttctgtgcggccaacttcgcctttttagcagcagattttctagccatgattgggaagcttttttgttgaagttaagtttttttttcttcagatttgaagtttttttttataagcattttgttcgcgcatgcataaaaaagtatcagtagtaaggataataggtaataggaactttgtacaaaagcacgatgctacagaacgacgatagaaaatagaagtaattgaattcaatatagaagagaaaaagtggaaaaagaaagtggattgacatcttcaaatatgatcatcaacaaaacacgggttgccggcggacctctcaagcaatcacacagccataaagagctagatatctgttaccgccgtagtaaacctgattagaattgtcctcgttgtccttgttttgggactgagtggcatttgtttgggtggaaggcttcatttgtggctggattttcaaggagggttggttgataattgattcaatctaatccagccctttatataccagacaattgtagatgaggctaccatagtcgaaccattgaagagatagtagtaagcatttgcgtacctattgatgattgtaagtgattgacagggacctaaataggaaattttcaagatgtacctgatactgaaaaattacatccgcaatattacgagataggaagggtctttcctaatgaggagaatgacaatgagcgcacacaatatcggaacacgagcttcacctaaaactggctgctccactaatttaaaaaagattgatttgcaattttcatttatttattgtgaaaaaatagttactacagggatatctgccattgaaaaatctgtgtctcttcgaacaatatcaattgtatcgtttggtgaagagaaagaggatcagttatttctaaagaaaaacttcgttacacctcctctttcgacggatgttaagagcgttctaatcaaccacaaaagactggctagaggtatccaagcaaaagcccacaaatactactcatgaactttcaacaccacagcagtgactctaacagtcgtcccatttttccttcttgataatggcaccaaacgcagtttcttaatgaagggtatatgttgctattcaattcattgcaacatattttcgaaccgatatggctttatcatcagttctttcttatgctgtggaattggattttactttgcgtactgtcaataccgacgcattacaattctgagtcccatttgaagactttcagaattgaagattagaggtgaatgggtgtgcgctgaaattctgaaaccccagttctaatttcactaaatcgacccatcaagaatgcatatttatgggatcttattatgaaatggaagagcttcaactttgatgttggaaatgacgggccatgaattgatcaaaattgcataaccagaagaatctcaaaagaaggcagcattggcaagaagcaaagactctaaataacgagttatcttgactgactatgacccaacatgcaaactgggttgggaaacgtagggctgaacatctggatgttcatcagttttttggccaggagccacaagacccagctacgtaacttgaaactggaacatgttcagtaacgtttggttgaacaagttcacttaactatgtttcttctaatattgacagagaaaaacatcagggacatgtccataatcagcaagtccaaaatctctaattcttttagatctgatgcctgcattcattatctccctgtcccaaacatattacgtaagacttgattgttggaaacggcacgaatttgcttcaaagctggtaaccagtatggttgaacagtagccaagagaatagatcgcgcaatatcaatgcgggcagggtaatagtcaataatatcaacgaaatgatcgccctatttgcatgcccagctagggactagttgtatgctggtagtatggtctagaacgaaaagatattgtcgataaaactttgactggatgctactggcgatctcacaatcgtccttcagcctttagtggtagccaaatctcaattagtccctaagcctccagggagcattccgaaaagaattatcaaaaaaatagcaagatattccctggtgaatccagctgcagccacttctcgtcattttctacaatggataagcagtcattgagactcacaattatgaaattgggtttttatttccccccgtgacaataaagaaccttaccaagagtcacctcctactttgaacactgccggatgcagttgaagtcaaacttattcttcaggtgaaacaagactcacagaaaacagcattgtactccaattttgaactccactatacatgaatagataattttatatcttgtacttttaataaggcacatcaagtcctgcatatctcatctcacatcgagctgtaaagcgcttaaaatcgcgtctatatagctcacatcgtggtcgttctcctcgactgagcacatgtctgcgaacgcctgaaattaaattttctcacttaacttgaatttctctgcattccctttctgctaactgtttacacaacattatgaaataatcaccctatcaagagtcgatagtgtatctcatagtaggaagtttaccatcccatctacatttccggaaaagttctaagtgcgattaaggcaattttgaccaacatgtcccccatcaatgatagtagcagttcccgtcattcactgtccccagtgattcgccacacctcatcgcatgacagtattaccaatagctctgtcatgtccgataacgaggagttacatgatcacaggcaccagagctcgtctttacccatccgaaaagaaggcacctctccatctttcaagctgaacgatcgggagatgccacctggtggtgagttaagattacccccaccagcgacaagaacctctcaaaacccctcacagtttgtagaatccacagatctacgtgatagaatgctttacagtgaagattctgataacgaggatattgccagtccctatctggcttcttttaacaatagttctagcaagaagcataaacagcctggttttatcaggaggactcgctcaaagtccatttctgagcagttcaagtctttgattaatacaaatgttcagcaatctaccaatcctggagggggaatcctactgaatagagagactcggccctcaatctcaggcgccaatatgaatcccttggcaaaacagccgtcaagaacttctatcaaatctacaggtaagacctctcttcaacaggaaaagaaagaaaggcaaaattccagtagtgatagcgatgttgattcttatgcgtccaggtcatccaaggaaacagaggaagatgtctgttttccaatggttccagaaaatgtaagggttagggggattgactttatggaattggaaaattttatcgaagaagagagattggagaaaaaatcattaatgaagcgagaggaagctttgaaagacttcgattctaatattgcaagaggtttcagctctggcaacagcaagccaagctctgcggccttaagatatataccaaagaacatcactcacaccacaaatgcggacaattatgtgccctttcctcaatcctacgaccccggtgatgtctaccttgaagaaaaatctaatgattcatctaataaaaaagaaagttctacagaagatgatggagataatggtgtgacttttcagaaccagaaaaggaacgccgaggcagcttctatattgcctgataggtatagtttttattcatctgacaataatgaaactattcatgctccagatatatcttcattggtcaatgaaggtcagaagattgaagagctttttcacggtgctgaagccacttggtggctcgattgcatttgtccaacagacaacgagatgaaagttttagccaaagcctttggaatccaccccttgactgccgaagatattcgtatgcaagaacgacgtgagaaagttgaacttttcaaaacttactactttgtgtgttttcactcttttgaaacagaccccgaaagtgaggattttttggagccaatcaatgtttatattgttgttttccgtgaaggaatattatcattccattttactcctattaatcaccctgcaaatgtcaggagacgtgtaaggcaactaagagactatgtcaatgtgtctgctgattggttatgttacgcaatgattgatgatattactgatggatttgctccagtaattcaagctacagagtatgaagcggatgcaattgaagagtccgtgtttgttgcaagagatcaggagtttggtatcatgttacagcgaatcggtgaatcaagaaggaaagtgatgacattgatgcgactgctttcaggtaaagcagatgtgatcaaaatgtttgcaaaaagatgccaagacgaggcaaatagcacttgggcctccaacgcttcaatacaacagactactactccaagagcagatatagcattatatttgagtgatatttcggaccatattattaccatgtttcaaagtttactgagctatgaaaagatatttagtcgaagtcactccaactaccttgcccaacttcaagtcgaatctttctactccaatcacaaagttactgaaatgctttctaaagttacgttactaggaacaatattttttcctatgaacatgataacaggtttatttggaatgaatgttaccgttcctgggcaagatacaggatctttgaattggtggttcggaattctagggtgtcttttggctgtagttttcacatttggtttcctaggaagctactggatgaatcgttcattagcgtccaataccacactgactcctgctagtggcaaaagatcaatcaggagttttagatacactggtggcaacagtacttccgacagagcaaggtctatattaagtctcccgagaaccttcagcaaatacgattaagtttttatattgtgttagtataaggcaatgtaaccatattattcatatgtattgatattcaagactatgggcggagacgttttggatccctagggaatagagatgcacgccttatattcttcaggtccaagtaaaacatcacgacacgctctaaaccaataccacctccaccgtgaggggcacatccataatcaaaagcctggacataatcttccaagccaggagagttggaatcgagtccatgaactgacattcgttccttcaaaaattcactatcatggatacgttgagctccggaaagaatctcctctcctctcataaagaaatcatatgagttagagtatcgggggtcttcgtgatcaggcattgtatagaaaggtctgacagccaacggaaacttgtctaaaatgtaaaaatctgtgtcgtacttttccctaacaagtttacccaaaaacttctcgttctccgtactcaagtcttcaaaatcatcaacttccttaccattctctcttaatagcttgatcccttctttaaaagggattcttaccatctttccatcttttggaagcttaaactcttcgactgggtactgttttctaacaatcgcaatctccttggcgtatctggtcttcaattcagaaaagataaaaacaaaaagctcagataacaaatcaatcacctcatcgtaatgctcttcgaatgtcatttccaagtctaaaccagtgaactcggtcatgtgacgatgagtgtttgagttttcagctctgaaaactggagcaacttcaaacactctttcaaagtcagcagcaattagctgctgcttgtacaattgtggagattgagcaagaaatgccttacctttaaagtaagtcacttcaaatacattagatccaccttcagatggagcacccaataattttggagtatgaacctcagtgaattttttcttcgtcaaaaactccctgaacagtaaacatacaccagattggatggtgaaaatggcttgattggtaatggttctcagatcaataactcttgcgtcaagtctcgtgtccaaattgactattggcaatccagatcgttcggcttccgcatcagatctcgaagcatcttccaccaaaagtggcaatcgctcaggagtctcagaaatagtatatattttgttgattaatacctcaaattcttggatagtagcagatttaactggttcgaccactttggatatggtaccatggacagttacaatactttccaagctgatggcactagcccatttcaccatttgtttagatacggagtctccatttgctttcaagacagcttgaatcaattcagttctctgtcgtaaagacaaaaacaccattgtggtaccttgttttctggtgttgtagattctagctctgaacacaacctctttaccatcgtcagcagcagttagagaccctatttcaatgcgtttaatgccgggcttcgtagtagattgatttaaaggcaatcgaccgtagttttccttagcggtgtcgtttgcagcatcaagagcagccttttcggtttgctccttggccaactgtgcagctttttccgctttctttctctccttctctttttccttctctagcttctttaaagcctttttcgacaaaggctggccatcaggtccaagaattaattcttcagaagtggttccttgaacagtcagagcttccaatttttgagtagtttcttcagccatattgattgtggtagaaatgcggtaggattgatggaagaaaagaagtgtcacatctcgaaagtttgattttttttagtgggaagctcaataaagccccggaatagagagtctacactatgttagactcatttgatcagaaaaaggctcagatattggccgaaattgcaacgactaatgaagcaaatcccgatttatctcccaaggggactattgacgaactttgccttccgatcatgaactccataaattcgcatagtgatatgataactacctcatcctgttctggaagggtcagcgttttcttagaaggggacaagaagggaaatagtaagattggagccaagggagatggtggtcattggttatttgtgacacatgacaagaggcaagtttctcgttggtggaaaaacatcgattttgagtgccaaatagagaaatccaacttcaaaccctccagatttgtcttattcaagtttgagcctcttattctgcatgtgaaatgtagagaccttacaactgcccagaaactatatcaaacagctatgagctgtgggtttagagaatcaggtattggcgttaataatatagtggggattcgaatttccatcaagttagatattcctattgggtacttgaatgaagaaggaaagtgtgttttacttgtggatgagaattacctggaatttattgacaaccaggcaatcaacagattcaatgaaaatgaatctaaattgaacctgctacacagaaagatcagtgatatgatgttcgcaacgactgagatgaaaattgaggaaacgaaaaatgaaagaagagataggaaacgccgcgagggactcgcaaagcaggaagctttaatgaaggaaaaaggaaagaagttagagatgggacagaatgaagaacctgaagatggttagttagagaagtatatacgcattaatctgtaactcctattacaaaactttacgcgggcagattaagctttaaagagtgatcttctggacttaaaatcgcgaaggctactgttcccaggttgcgacaaccatcgagaactctgacatactaagtcctctgacccagaatctattttttatatcacagcaatcaataagcatggaaggccacctcatcccagatccgactaatgagaatgccacaatactgttgatggggttgagaaggtaagtgttactaaagtttggcgaatacttgtgataacaactgttcctcccaaatactgacgtactgagtgctaactgaatgaattaggtccggcaaatcaagtatatgtaaagttgttttccataagttgcaaccattggacaccctctacctggaaagcacatctaaacctaccacagaaaatttcagaagtcttattaatttgtctgtcatcgagcttccaggacaactgaatttctttgagccaacatacgatcatgagaagcttttcaaatcaattggcgctttagtttacatcatagacagtcaggatgaatatttgaacgcattaaccaacctttccatgattatctcatatatctacaaggttaaccccaagataaatgttgaagtactgatacataagatagacggacttagtgaagatttccggttggatacacagagagatattatgcagcgagtaggggacgaactactggatcttggattggaaggattgcaggtatccttttacttaacatctattttcgatcattccatctacgaagcattctctaggattattcaaaagttgatctacgaacttcctgctttggaaaatttgctggacttactggttcaatacaacaaattcgaaaagctgtttctgtttgacgttaattccaagatttatgtggctactgatagttcaccggttgatattcagacatatgaggcatgtgcagagttcattgacgtcaccatcgatctagatggattatatggagatgtcaaggatagtgatgaatcaaaaggtaatccaacaaaatgtatttctagactacagaatggatccgttttgtacttgcatcaaatgatcagagggcttgccctagtgggattagtacgactggacaatacagaccaattctcaatggagtttaaaaacgctctctcattgatagatttcaatgttaacgtcttcaagaaatctcttgaagacatgtggaagaactcgagactttaagaatagactagtgaaataaatttagagacataatactattcagccataactagtgttggttgtcggagataccttacccgcgaagagacaagtttcaactaactagaatctcttctgctagcggaaatacccatgtgaaaattaccccaacagattcaatttcgagtctacctgattcttctctcgcttatcgattaattagaggcaaatttcaagatttctagctaagatctttcccttttaccctgttcctactcctacttctcttcaagactatggtaaaagaaagcaagttttcatacaattctaaagatgagaagaaatactcgttgggaaagacttttaggggtgacatcttcaatgtcccagagacgcatgacatggtaagatctttgtttgatccaaccgttaagaagtcggtgagcgactacctaattgttctctccttgttcataaatgggattgtctattattactctccagtgacatggcgtattccggttttcatcgtcctgtattcgttctggaggttgggatataatctaggaattggcatcttgctttataagcagtccaaaagccactccatgttccattggttgaaacaaattcagatcaatggaggctgggctaaaaagtttgttgagttagagctttctagcaaactgaacgctcaacagttaaacagcgttccggatgaattcaagacctggattgtgtttaggtctttggtcaaccttattttgatgaatgacttcactacctatatgtgcctcgtctttgcctgcagtgatggtgcttttaaccagtctttatctctcatctttttacgatgggtgcttggtatcagtttcttcatcttcaacattattgttaaattgaatgcccacctcattgtaaaggattatgcttggtattggggtgattttttctttagattacacaataatgaagagttgatttttgatggtgtttttgacttggctccacatccaatgtactcaattggatatgctggttattacgggtgcgccttgatgactaaatcttacacagtactgattatgtctatctttgggcatctattacagtttttgttcctgaactacgttgagacgcctcatattgagaagatttatggagacgacaacttgtcagaaaacactatttccgtcaataagagggatgatagcgtgtttattggtactggaggaaaacccttagtgatgctaacgaaaaacttcaattggctgagaacaaatgatatattcactgtcgtattagccctttatgccagtattgtgcctatatttttgccagcttcttacaataattctatcataatcttggcaattgtcgttaagataggcacgtcgtttgtactgaacagtgttttatatttacagagcaggttcaaaagttggactttgagtttcatcaagaattatggaactatcaatatttccattctagataacaaagaactacttgagaggctgagttttcagaattggaccctgttacagaacaacacgcttgtgcttaactactctatgttgttcactatctccgtaagagaagttatgtacaatgaaaagttttggcagacagaatggttacctctccgatttatcctggcggcactgatgattttaggtcagtttttaactgtgcatcaaatgattgattctattggcttgtttggttggtactatggtgactttttcattggtgtgttgtcttctcacaaaagcgaagtcacaactctttcaagaagcggtatctaccactttctaaacaatccagagagagtcacttctaaccttacagtgtgggcattgtacttactgtttaacaacagtaacaaaatttttctagtcattgcactgttgtttactatgaacaacttgatagtattgaactttatagagaagcctcatatggttaaactctatggcgaacaaaatgttttgaaacacacttcaggaattgagaaaagtatcaatagcttgtttcttccaaaccatgttcagggaactatagttaagctaagtggatctattgataaggttattcaagactcttccaaagtcatcgacgagttcatcaggaataaacacaatcagaagccaaaagagttatcgttgaagaaacgtagaaacagtttccaacaggtcattgaacttatcagaggaagcactgatgatactcttacgatcaacctgcaggaattgaatgaccagggtcaactccagcttctgaacttactgagaaaagatgataccgatttctacaacttaggtgatccaattaaagttgagtggaatatggaagatcacaaaggtaaggacaaggcgtggattggcttatacaatatctttcaaacctctgagactcggacaaaaactctcgtttcatcaaaggggtattggattcctattcacagggaaaagtatattaacttatctgacaagattaggaatgaagaagactgcattttggaggacgaactaaatagaggagttgttcagttttccgcagaactacttccctgggttccgggaacttatgagttgagacttcatgctaatgaaaaacatgaagtcttagcgatatcgaaaccttttgacattgttgtgaaaaaaattgatgtacccaccagtgacgacataggagacgaacgattggaagattttgctaataagctttaccaaggatttgttagcaaattgtttcctgccgtcgaatcaatagaagatgagtctaattggtttctgcaaatgcacataaaggagaatgctagacaagtagaaaagctttgctccactttgagtcaaagctgtggggtccacttaactaagaaagctattgttgatgagaaatgtttgaaggatctgagtttcaagatctccaagttgagaaaaatgttagatgaattgatgttatagatgtacatagaaggccattacttgaccaattgaattagatacttgtttaggctggatcgcaggtctcttgctttcttgttgcattccattatcatgctagacaaaactttttcgtcgtcgatttcggcatctgtatcgtcggagatgtataaacctacaatcttgtcgttaggcaaatgaagattagtaaaactggtcactatggaagttggaatgtatcctgctgttattatatctttcacttcgatttgggcgtctactatcgataaggaagcacaattaacgaggtagttagttagcttgatgaaatttgtgtcataggaatccactgaaataaccttaatgaaaatgtctatcgacgattttgggtacttggaaagaatgattgtgttcacaaagcagctgtacacaaaagaagatagtctttgctctatttctgtgagactattccttccattaccgttggcaaattctttagactccgttaggaaaggaagaaacctacattcgacagaaagagttgcagtatcaatgaaagacccacgaatcggcctaggcccataaacagatacctgtataagagtattatctatttccatatagcaggatccttcacaatttgttactaatcccatgtcaacaaaaatcttatcatcgccagatgatggctgagatacatgcaactttttcagttgaaacttggagctcgcctccccttcaagagccgaaataactgattcagactcaaaggttagcggagaagcgtccaatggccccaatattcttcgtctatcggtcattttatagggaaaagggtagtttctagctagagtgactttcttctacttcaaatttttctattcgcgcaatttcttagaccaactctttgctgggcattcaaaagatggatgcttgatttatccccattcatttatgacaacgttagaatggatatgataaagtccacacagggccagatacacaatctggtaaaagatttatgcgtttggtgggaccaaattaccgaagaagaaaaactgagaatggcaggctgtgtttctctgggaattgttggtttgacatttgtagcctactcactgaataagtctattactgataaaaagaagcatgataagaaaaagaagagaactggaagcaagagcaaacctgaaatcaagttgaccccttacgagtttagtgaaaaacagctcagtgatatcatggccaaagtttcgtctgagatattacctcgccttcaggatttccttgacgaaataaagctgctaaaaaactcggcaagttacaatgaagtagataagccagctaagagagggaagaaaaaacataagccgcccaagaatgttgcaggccaagagttagaacaactggaatataagagacgctattttaatgagatactcttaaaggaactcatggacctagatggggtagatactctaggggatgtaacactcagggacagaaggagagagtgtgtcagaaaaattcaaggataccataaagaattggatggtgtgaaagctgttctcggagacctttaagacgaaatccgaacttttttctgccctgcatatcggaaatgaaactgcgcttatattacaacctcccgcttgttgcgagtattacgtggctgattctggatctttataaacgaaatcttaactaaaatgcatacgtaaatacaacgatttcttcttaggtaagcaatgttttcttttttttcgaccggtttaatatcacgcggaagaattatgatacgaaagccaatgagcgtacaacacagaggttaacaacagaagtgaaaattgcgaccactttgatggctttcaagcatcttggacttcaaactgtaattctgaagaggaagtatcaagatgacgagaattttcaaagttaaccgtcggaaatataaaatccctctgtggtgtgagttagttagcgaagcatccttttccctcaaaattccacctgcagccctggtgcgccgtgccatgcgcttttttagagcatgtcataacaagaagtgactacaagatagaccattattatggggagaatgcttcaaggttatactagtcaagcactgtctttggctagcaacgtacctgagctaagtctaactagcatctttttgataaaagaacctactcactgagtgcttttcactcaaccggtaatgcggccaaccaatgcacgctaagagaaaaacaacaattcccgcgccgcacaaaacaaatgcaccccctcatgcaagtcacatgaagtcttgcattctacctattctataaatacagcttgctccgtcccacattttctgaacacacttcaaagtatcagacatacataatacctcatgtcaagttcaaacaaagaattcgatggagactcgattggttcttcagactctctggatatagaatccggtaacagagatccaaaaactcaaaacccacaagcttatgtcccaagcgacaatgaagatcgtatgtcagaattatctcactacgcttctacacctgaccagtcactaaaaatggtgaggacagaaaccaaaaagtcattgaaagatttgggagtctcggatgaacttcccacattagacccaaacaggcctattgctgtagaaaatcctatattccccgaagaatattatttggaaacagaaactggtttagtccctgtggcaacattgcaagatctgggtaggaacccaactgcattggaaaaacttagaaaagaaaaatctagagcgtttccccaacccaacggggaggctcccattctcaaagattcgtcggatgttgaaacgtttaagtcgaaagagtacagcccagaaatagagtttgtcacgtttttgatcaacgatccagagaacccatacaactggcccacgttcactaaatgggcatacactattatcttatctatattagtcgtcgccgttgcttttggatcctcgtgtatctctggagcattattcactgtggaagataattataatgtttcattggaagttgccattttgacagtttcattgatggtcttgggtttctccttgggtccattgttgtggtctcctttatctgagcagattggaaggagatgggtttattttatatccttgggtctctacacaatttttaacattccttgcgctctatcccctaatatcggtggtctcttagtttgtcgatttttgtgtggtgtttttagttccagcgcactttgtctggttggtggttctatagctgacatgcatccttctgaaacaagaggtaaagcaatcgcctattttgcagcagctccttatggtggaccagttattggacctttagtatgtggttggatcggtgttaaaaccaacagaatggatcttatcttttgggtaaatatgggatttgcaggatttatgtggttactagttgcctgcattccagaaacctatcaaccagtaattttaaagaaccgagcaaagaaattaagaatggagttgaacaatcctaacatcatgacagagcaagaagctaatccactaactttcaaggaattagtagttacctgcctttataggcctcttatgtttgttttcactgagcctgttttggacatgatgtgtgtttacgtttgtcttatttactcattgctttatgcatttttctttgcatacccagttatatttaatgagctttatggctatgaagatgatttcatcggcctgatgttgattccaatattgataggagcctttttggccttagttacaactccaattttggaatccatgtacgtgaaaatgtgtcaacgaagaaaaccaactcctgaagacagattggtaggagccatgattgggtctcctttccctgcaattgccctatttattttgggagcaacgtcctacaagcatatcatttgggtcggtccagcatcttccggtatcgccttcggttatggaatggtactaatttactactctttgaataattacatcatcgacacctacgccaagtatgcagctagtgctctggcaacaaaggttttcctgaggagtgctggaggtgctgctttcccactatttactacacagatgtaccataaactagggctacagtgggccagttggttgttggcattcatttcattagcaatgattctcatcccattcgttttctacatttatggtgctcgtttgagggccaaaatgtgtaaagagaactacagtgagatgtgatgcattaagaacaatcattcattaatccttttcagcatatattatttctaattaattcatacttaatatcactcatcaacattatgatctttgtcgaaaagtatcaattgaaacattgccgctctggctctttccttggtgtccgtgttgtcgctttcaaaactcaatttcttgataacatcataaaatccatctttaattagcttcaacgctcttgatctaggtgctcgcatcttcttgaaatgttcatcggaagttagctcattcaagtacccaacatttatttcttcttcaatagtttccatatccatttcaacatctgaatcttccagatctgaagatgtatcgtccttccatgttaagttggtaactatccaaatacatgatatcatcagatctttatggaaagcggcccattcggaggagaccccttctatttcttgtactaaaggagtctccaataacatataaatgaagtcgagcaattcttgattacaaataatcattgatctgttatcttcattagaggccgcaaaatggaccaggatataagtgatagcaagaataacctcataagtttctgattcctttcttttactaatgtcatcctcctttaatgtggatgataaactcttcaaattttttaatagaaaattcaaaaaatctttatcatcgtgagcttttgctgtcgggtcggaacagaatgattgaatgattttgttcgaatagttaagaggaccacaggacaagtttcggataatattgaatgctttttcttgaatttgcagatttgaagaataacaaagttcaaaaattcttgataaaggaactttgtccaaaaataattttttatcaatgatatcatccccgtaaaggtaatttctaagaattgataaggcattgttctttaagaattcaaactcgttctcttccgaaacaaaataagacaataccttcaggaagtcttcattgaaaacattttttttcaaagaactatattccaccacacaattggaaatgattcccaaaactagcgccttgagtgtaatttcgtcatccaataaggacgcacaagattcattgtctcttgaaaccaaaggcagtttcaccagatccgtcaacgagtttacaatgtttaaatctactaggtaggttcgtagcaatggcgctgatcgtgacagtgagcggaccaagtacagagcagacgtcgtgattatgtttgaaagcttcaatatagtaatgacatgatccaactgagcagcgtctccgtgaaactctttgtaaatattaatatgacgagagacaagatccaccacacattctgaaacaatgtcatgcttgataatttcatctctgtattcctcgttgttggacgttatgttagccaatatttgcaggcaatcactaacagtatatagcgacttcgggtccaagtagtcagaatttgaactatctttctcaggtttgtaattcttcgagataatgttgacaagcttcattataaagttgttgtccgcaaaaaattcgttaatatcatcctcctcgctaagcaaagacagaagatataatggactcattttgcgtatgattttcaaattggaagaaacaaaaaggtcatctagttgtaaagaaatatctttattggagccatcagtcttatgaaagaggtcaatcatggttatcaaactaggtagcaactttttctggttaagtgtcttcagctcggcagtagcaggccaattcttgaaatataagatcagaatgttgattgttatcagttttaaacataaatcttcatttctcaaaaacgatgtcaggacgtaataaaacggtttaggcatttcgaatctatctttttcattccttgacgccaaatgcttcaaaatcgaagataaagcgaaaagataagagactatttcactcgacaccaggtctggagttgagaaatgagggggtaccatttgataccatgaagtggtaaaattatccaatgaattctctctcagcagaaatataaaaatcggggtgaactccacggaaaggcgattcatgagtggcgtaattaaccttgttaaggaaggtgtctgcaagtagggaatcagtttacaagtgcaactgagtaactccttcgagacatttttattagacaagtccaagatgccgtaaatcagttccatcagattctctccctgcttgttgatagacaaatttatagtacactcgggcaaatcttgggcgagtaatgacttgatggttttaaagttgacttcacagagttcttgatgcttcaaggaacttacaatcaacgcatcaacgattttgtttcctttctctttgatcaactgagtagtattgaacttgaaatatgcgaatgattccaaaattatggaacaatttttaaggacctcttgattatcgttgaaggtcagcgtagcaataagagagtctattagtggagtgaccgaggaattcagatgatattgcttggcgctatcatttccaagaatctcagctttcaataactgcagctcttgtattgatgaaattccatttagacctgctaatggcatcggaatttatgaacaataatcaactcgcacctggagtagaagaatcagatataggctggcaagtctagttatgtaaaatcgcgaggtcgtaaaacatctacgaatctaggcaaagcgaaacaataatagcagcaaagatgatcctaataacattctatacacacatgtcagctatcgaatcatatataaagagttaaactaaagattagagacatttgcttttagttttggaggagatatgatggtttccaatgaaggtgctaattggactttcaagtttggatctgataagttaggtttttttggagtcgtcggactgttcaagaagcttattggtgagagaagctggttgttatctttgctagagttctggctcgataaactgatttgctgttgtccaattttgcaagtttcattttccccacagtcttctgttttggactcatactgagaaaggtacccttccaaattagatagcctagctacctcagagtataaatgatcatagtagtagcttagcttggtattcagtaagttttcaatgtgcttcatatctctgctggtagatattagatgactgttcagcttgaaaacggaatcacttaacttgtcttcgaaaagaatatgcaggtctgctatttccattttcaggtttcgttccttgaagtcaatatcagatctcatattcttgagtgataatctgatttcgcagttctcttgttcaagaattctttttaaagcactcgtgtcatctctaagaacctttagttgtcgatagtagtcttctaaaacttcctgaaaaatatcaagtttgatattctctctttttctctgacccaaaaaaaaagtatcttgccgatgaggtacaacaaaacggaggcagcagtaaagtaaaacaagagaaactctatttcaaactctccatcggatggaaattctagctcatacatttttgctatttcaggacacaaaaatgacaggcaaagttcgtattcccgtcactagcttttatggtccattacattcttcgtgactcaatattaaacaggccagccattatgatgtatcaactatgacctatgtgcttctctttctgacacatctcataccggattcgactgttcccaatctgttgccaaaaactctctacatggtgttcgggtcattttctctacctgcttatctctttgtatatttttcatatattccttgaccagcccaaaaggttgaaagatcgtgtaaatatcttattaagtgttgaaaatgccacgagatcctttaataggtatagtgggaaaaccctctagtggaaaatccacaaccttaaacagtttgaccgatgccgatgcgaaagttggagcatttccctttaccacgattgagcctaaccgagccactggatatctccaggtagattgtgcttgctctagatttggaaaggaaagcttgtgcaaacctaactatgggtggtgtaaaaatggtcgccgatttgtcccaataatgctgttagatgtcgcagggttagttcctggtgcatcccagggattgggtttgggaaatcaatttctggatgatttaagacagtctgatgccctcatccacgtcgttgatgtcagtggaacaactgactccaacggtaaagcgaccaggggctatgatccgctacaggatattgaatggctgcaggatgagattcgcctgtggattgaagggaatctccacaaacggtggggttctatagttcggaaacatactgccactaaggcatcgatagtagatactattcagctacagtttggtgggtatggagctggtagaaagttaatagatgaagctttacgcaacattaaagaccttcctcccttagaaaagtgggataatgagtggataactagagtggtcagatcattcatgcaggttaaatttcctactgtgttggcgttgaataagattgaccaccctgacgctgataagaatgtttccaaaattatgctaagatatcctgagacgaagacggttttaacatcagctataacagaagtccttctcagaaaactagcaaaacagaaatttatacagtacgaagaaggaaccgagtttgtggatacgtatgaagatttgggggatgactgtggtttgaaaccactggatgaaaaactagcgcaaagaatagaaaccatcagagatctggttctttatagatttggatctacaggcgtggtacaagttttgcaagcagctgtgggagtattggaccttattccggtctacacggtcagaaatataacaacattcacaggaaactcgggaacgaatgttttcagagattgtgtattgttaaaaagaggcactcctgttggatcagtagccagatatataatgggcgaagttactatcgccgtcattgaaggagttgggggaaaaaggattagtgaagacgacctgattgattccggaaaaaatgacatactgtcattcaaaatagtggcacagtctaactagaaatatcaaaataaatacggtttcaagaacttggtagtacgataccctattaaaaatccaactagccattcacgtttaccaacaaaaaaggacaatagaccagggcctggacaagctcctacaactccccatccaaggccaaacgttaatgagccgataatcaaagattttgatagatgtttggagttagccagttcccatgtatcgttaagaacaggatagttcggctgtttgagtatatgcctccagataaaaatattaggaatcacagcgaacacaacaattagtgccagggaaggatcaaagctgattggatccagaactctcaaaaatctcaaaaccttgtctgaggatgccatacctgagataaataagcccgtaccgaaataaaaccctgtgatggtaccgctaacgattcttaaaacagtggaataaagagcattgtttctgacaaaagaactgatacgaggtaaaagaaaataagttagcacgaatcctgttaggactaacgagagcaaagcacctttgttttgctcaaaagcttcaaaggatgtatcatactgagaacagttgattgtttgacccagttgattatggcatccactcttgacagaggtaagactggtggaaaagatgccaccaacaaaaaataatgccgttgcgactacacttctgaaacggagtctggataaacctgctagcatgtgtccagatgtgcagccagaagctaaattggaaccaactcccactaagagaccagcaacaacgtaagaagaccttgagatgtccgagttttgagcaggcaagaaatcgggaatcaaggacttgacgaattggtaagacagatatagcccaatgataagcgagctgttgtcgatgttgaaattgaagtttccaatcagggaagaaaaaccgactgtttttcccacttgaatcaaatgcgatgtagtcgcaaattgaataagcagagcgccaatcgatgtttccagaggagagaaaccaaagttagcagggctcatcttgtacagtacttgagctacttcaaccacagaagagatattcaaagacgagttgtaggtgcaagatgtggtggatattcctaactcgcagtgatccttgggcgcgcgcttccgatgcgatgagcctccacaatatttctggtgctaaataatctatgtttgacgacgataatacatttttgttcccgattcattgatgtcgtcactcagtaaaatagaaaacaatctgatacaacgtagcccagaattcaatcgtggtgcagaataagaattaaaaatagatgccattccctggaatcgaaccaaggtttcgtcggccacaacgacgtgtactaaccactatactagaatggcttcttgttgtcagtaatttgttatttgttactataagatagtaaaaataatctcctgaatgcggttgtgttcaatcttgctcaaaagcatgcattttcgagtttaattagtccgtcagagaagaattgctttacaatgacgaaatgcgtttttgatagcacttatgttcgaatcagatcgataattgcgaagacgtctccacatatcggttggtcgttgggaagcgattgatgtcttttagagtctggccactaactgtagacacttagaatatgcattgaatgcagtaatggtcggtgcttgatagccatgagcacgcaatcattgcttttactcaaagactaaaaaaagtaaaaaagtaaaatggtccctagcaggatcgaactgctgatccccgcgttattagcacgatgccttgaccaactgggccaagggacctttttgataacgttggttagtctagagattatgagtataaaagttctacttctgaaatcaacaaactttacgacgaaacagtgctatagtggtcactatcaatctatttttcatcctaaccccaagtccggatttctcggatacaatagataagattttcaaaacatgcagacattaacttgttatcgtgttacgaaaccatctaagaaagctcaaatcgttatttttataaagcactatcatacaacctatttaaacttctccaagaccgcattctctccaaactcctcatactccttcttactaatgaaaatattatcaaaattgccactgttcatggaagatagaatcagtgcaccgttccaagttgccaaatttctttcatctaagttgacgttagagtaggtttcgatagtgtaattggatagtattttgaccaagtcgttaataagcctttgttcaagtccaggtatgaaagagttttctcctgtgattactataccctttaacaaagcctggtagacattttgagtagtctctagttttttcaacgaattcaaaactagctccgacagtccgtaagtattttcctgtgaaacactaatgttaggatggaaagcattggtataactaaatggttgcatcaaaggttccaccatttgacattgatccaggggatttatatctttgaccacgaatccattgatcaaataatccttcgcggtgagatggtagtccgatgataagccttctacaacaggaggtaggatatattgactcatggatcctatattccttcggaactgtttgaggaatcggttcactctataagctttaacggacgataaagtggtagcattacctccctgcgatgcgatttgttcttctatatcaatttcatctccagacttgcgttgcaggtatcgtaaagtatgcaaatttaaaaaatctccaccaaatttgttgtgaattgcacctttagtcataatgctaccattaacaataggtgtaacactgatgaaagcatcgttcaaatcaataattaaagatgtggccctaccggtaccataactagtacatgactggctattcagcatactgaatacagggacttcaaacttttcgaatgctaactggcaggtgttaacttgattctttttactattccagtgattctcggtaagaatgagaggcatttctttactttccaatttgtagtgcttctcgtatatgaacttccattgttcttcaagggcgtcccagttatagataagcccatcattgtacatggtgaagatctcaccatatggggaggagtcaattctctcaaaactaatgccgtcatcaagcttcttgtagtcattagaaattatcaaagatggggcctcttctgtacttaaacctgcgtatgtcttggttccattgctaccgtctagaatcaaagatgtgattccaaaatccatctttgtttgatgtgtttgatgagaggtatatgaatttagatcgttgacccgcgtttttcaagttatgagtacagctttgatagtataatcgcggaattgcctagtcgcagttgctagctttgcacctgattccccttcagtaacaccttagtatatctggtccctgatagccactcatctatgcccgagccaacaaaacaaactgagtacgaaaaactgaaaaaagagctccatcaaaaagtattaagaaagaagcagatggacgatgagctaaccgctatagaagaggatatattcaatatggagacagcttatcttaccaataatagttcctatggtaacatcattaaaggctttgaaaacttcactaaaagttcccattcaaacaacaatcctgcagcaaggaagagatatcagtttactgacaatgatagaatattttccctcagtagttcgacctacgttaggcatttgaagaaaatcaatgaagagaatggagcagacagagtcaactttgatgctgaatgcatggatgacgaggagggggatgaagaggaagacgagaaatctagcaatgggcaaaaaaagaaaaagagggatgactgattattaaatgaaaagaaccaaatattacgaatactattgtaaaaatacacaaactgtctaagaagattcagagaagctctattaaagctttctcaactaccaatgtccttttttctgattattatcgttgttccaagatccagccaaaccaacaatgttattatcatcttggatagtatcagcagctacaggtttaatctttaattgcagcattccgtcaatgagcattcttttaccccaggaagacgcagcagtgctaccagtctcatctctgcattgtttaagaaaggggaggagtgcagtcccccctgtgccccgctcctgttgggaggaggattttttagcaaggcctgaccttacagtcttagtagaggtggatccaagattccgggacttctgagcttgaagaataatgtatctagtgacaatttgaatatgcttatctctgaatgatttcaacattgccaaacaagcatcgtatgataagactagttcttcattatcagagttagaacgcacgtagtcatgaatactattaaccttggaaaggtgttccaggaatcggcggtgtttgccgggcatatactccctcatttcgttgatgaatgagttgccaggccttccaactttttcattttcacctgtggcatgatgctccacattcaatagcaaatccagtgcttgaatcaaggaactttgagcgttagatcctccagagtatgcccgaggaagtttttcatctccatatattacaccgttcggtaagcccgcatctgtcatgtttttccagccagcaagatagggacggatacggaagtagaagatatgtggatcacacatgtcctccatttgcatcataacggatcctaactcatcaatagcatcagccatttgctgcaaatgagcagtaactttttctatttctccatttctggcgcttttcaatgcttccaggccttgaacaatacagttagctcccttgtactcgaaataaactgaaaccaaataaaaccagctctcatcaataccccccgtaaatgttgtgatgcagtctatgttatctaaacttatatcttcccctttgaaaatctccttataattccataaaacgcacccgctataggttaaaactggaggaatctccaaatgagcactaaccctgaggagtggttgtgagatttgaataggaagtttgtctttaggttctcctacaccccagacataagcatgtgctaagaacgtcaaaattgaataagcacgtctatattgggcatcatttgcaagcctatccacctccagaagaggcatcttctcatccacaacatttctaatccgtttggttagtatcaaagaagacaagacgctgactagatcttcccatggtttgtagtactcctgaggcaatttctctagaggtagctcttcaggaaggaaccctgttatggggctcacatcgtaatcttccaatcttggcagatcaatcatttcgtttgggaacctagtggtaagtaaaggtagaaagtttggatttttttactcagaataagtggttcgatggtcgtgagattacgtaaccttggatccctcaacttaagaaaggatatattcagattatcctttagataatgaaaagaaaaaaatgactgcaagttgacaatgacaagaatactatgtgttttggttaattgtgtccttgaatgccatacttcttctttatttccttacttttaaaatttttctatttacatagataattttcaggggtgacattttttttgaaggttctagaacaatagactgtgcggcacttctacgtcatgaaggaagcttgcacagcgaactcacagcctcacagcaacagaagcaatatcgccttggaaggtaaactgaaaatcgatgcacaagttctatagttccgtacttcggcatggtgtttgataagtttaaggtgctcaacttagcctcatctattgataccatctgctattctgtggattcggggagagacgcctctcgcaagcagatatttcaatcgaggaactcgtttggagtgaattttgggagcctttttgttttggaaaagtatatctacggagacattttcattgaaggtgctaattgcgaactagacgctgtaaagaatcagatcagaagccagggagtcagtaaaaccaaggaaatacttgaaaagcattatcaggactatataaatgacgatgattgggtatggcttaaagataaaggagtggaagcaatcagaattcccgtcggctactggcatgtagatggtggctcttttacttcaggcactaatttcgaaaaagtttccaaggtatatgccgattcttggaagattttaaaagaacgatatattgaaaaggctaatcaacatgatattggagtgctgttggatttgcatgctttaccatctggtgccaactccagtgatcactccggcgagctcttgaaaagggctggcttttgggattccagttccagcattcttttggctactaaggttgtcgagtttattgctagggacctgtcaaagtatgagaacgttgttggtttacaaattgtcaatgaaagtgacttcgataatcatgccaaaaaccaaaaacgttattacgctgcagctataaatgcggtccgaaaagtggacccgacccttccgattgtcatctctgatggctggtggcctgatcaatgggtgcaatggatatcagaacaggaattaaaagtgaagggtcctctcggtgtggttatcgatcatcatgtttatcgttgtttttccgatgacgatcgaaataaatccccacagcaaattatcgatgacttagataaagatgttttgacaaatttatccggaaccgctgattttatcattggtgagtattcgtgcgttttggatggtcgaacttgggaaaagtctaaggacgacagaaatcaagttgtcgctcagtatggaaagacccagtcacgcatattccaagagagggcaaaatctggttcatatttttggacttacaagtttgagtacggtgatggaggagaatggggatttcgacctatgttggaacgtggttgtattgaaaagcctgtgaaactgaagggagacctaaccgatgatcaaatgaacgcttctttggaaagaaggcattcagatcatgttaactattggagtcagcaatgtcctaacgaatcgtttgaacaccagaggtttaaggatggatttataagaggatggaaagatgccctatcatttgcggaattcaatgggtctagactgggaagagttgatgcttggaaaaagactcgagtagaccaacatatcaaagaaagagggggtgggaaatacgtgtgggaattcgagcagggactacaacaaggaatatcagagtatgaagctcaggcgtctagttagtggcttagtgagtagttggtttgagtttagtagtatattcgttaacttttattgctgtattcttgaccttctgttgctgatttttcgaatcccttgtcccagtagtttttcaccagtaagcgtttgagagggtgttctccgtcctgaagaaatcctagccctatttttgggtaattttatagtatccgtgtcttgtgttgaatatggtggtgaagaagagatggtcatcttggtagtggttttcgttctgcaaagagtaacattcccattagggtttgtcagcgatctgactggacttgtatggtacgtttcaacttcatagagtgacctatttcttcttggagtcatctcattctctttcgacgtactggaaatgatttctccatcgatgtaggtctcataatcctcgtcatcagagttttgagattgggattgtttgtacttacgaggttgaccaggactctctaggggtacagcagtatgtgcacttttgaactgccccgagatcttcctgcttctcattggagtgctcgagaggctttcatcttccatagcgtccagctttcgaagtcttttgaactcttcatagtttattaaggggtacaaaccgcccaattctggatctggaacattgcttaacaccatagagtgtctccaatcacgaaactcgttctgatgcaagtataaccaatgctgctgagggcccacaaccatacccggcctgaccattcgcatatacgcaatacactcattagcagtaaatccatgggtgtagatcaaatgggcgccaataaggcaccctgtgcggccaagtccagccttacaatggactgcgatcttaccccccttggcaatcactgtctcagcagctccgacaaatttctggacgtattccaatgtagggcatgttccatcatcaaatatcatgtcaatatgttgtataccccttttggaaaactcttctgaatcgtagaggtgagagttcaaacgcacaaccagttgcacatcattcttacaaaaatagtctaaaactttcttaaacggttgattcaatggtccattctttcttgattgctttggagaggcaaatgcaatgaagtctttagaaataacattcaaatctccttggtccactcgctcatattgttcgtattcttccaagttaaaagatgtcagatctatcatcttgcgctccttggccctccaaacagcatatacgacatcctgaatgctaatttcaaagtcagcatgtgagtaaccagcgtctctgaacatcataaacggaggatctacttgacagataggatgtaacacctggtgaggtgaccaactctgtaccaaaaccatgtaacagcataacatgcaagcagcatttgtccttgctctagaatcggtggtcgagtaaaataccactgcctttcccctattgtcttcatcattcaggatgttatgaagtacgacagcaaatcgatacaagtgacccatatgcagtgggccgaaatctagatgaaaagaattataaatcaaagaatcttccaaagtaaagtataccactttatctgtgtcattgggatcatggtcataagagcccaaatagactctacctttaagaaactctatagcatcagtgttaggttttggcatagctaattgagaggtaatattaaaaggtaccagggaaagaaacaacctagatgcgatgaatgaagaattcatccatattggaacattgtttacttttgtgatatggtattactgctttaggtagcagtactgcagtgtttacaacagagttcttgttgtgacgaaagaagcgcgcctacatatctggttactgggaaatctcaactattcaccggatgttagacaactgaaaagactatctgcttcacaatgatcactgaactcgttgattatttagataccaaatttcgagtcagagaggacatatacattgtgcctacagtattaaagcgatgctttcaccatttatataactgttacaagcatagagtaaacttctggtatcagtttgaagaaacggtgggtcgatacccagataaaaatgctttaattttcccaagaaaaaacaccgctactaatggatttgatttggagatatacacatacaaagaattatatgaggtggttctcaggctaagtcatatcttagtggaggagtatggagtttgtccggacgagattgtagcgatggactacgccaataaacctatgttcattttcctttggtttgcattatggaacataggagccaaaccagcatttttaaattttaacgttacgaagaaccctctcattcattgcctgaaagtcgtcgagtcttcgcacttcttcgttgatgtcgacgttttaccaaccgtgaaggacactttagacgaacttcaagaaaagtcaccatccttgtcaatctcagtgttaaatgaggacacactgatgcaacgattattagacccagaatcactgggttttagacaggcagatcagaggagaaactacatggacaatgattacgatattggagccctgatctatacaagtggaaccacaggccttcctaagtcagctatcatgagctggaggaaagcattcatggcatcctcattttttggccatgttatgaggatcagctcagacagtgtagtttttactgccatgccgttatatcattctacagctgccatgttgggtgtactaccagcatttggtattggaggctgtgtagttcttgctcccaagttttctgtttcctcattttggactcaagcgaaagttactggcgccactcatatccagtacgttggggaagtttgtaggtatttgatgaacagtagtgttcatccagatgaaaagaatcatcatgtgaaagttgcatacggaaatggtttacggagtgatatatggagacagtttaaacaaaggtttaatattgaagctgtgggagagttttatgcagccacggaggctccatttgcaactacgtgttttcaaacaggaaactttggcattggagcttgccgaagttacggcaagttcgtcaactctgtattgcagttccagcattgcattttgaaaattgatcctgaggattcaaccagactctacagagataagacagggcgctgtcacgtagcagattttgatgagcccggggaattagtgatgaaaatattcttcccaaggaatccaaaatctacatttcagggttacctaaacaataagagagaaacagaatcaaaagtcgcacgcaatgtattccacaaaaacgatgcatggtatcgatctggtgatcttttacggatggataaagacggtttattgtacttcatagaccgtcttggagatacttttcgctggaaatcagaaaatgtatctaccactgaggttgaaaacgaagttctacaagtgaaaggagtgaaacaatgttgtgtcgttggggctcaggtgctcaaccacgaagggcgggctgggtattgtgttattgaaaaaatagaaggactaactacagagaaagttctagagtctgttgcacatcatatacagacaacgctgccatcgtacgctagaccagtatttgtcagatttgacaatatcccaatgactgacaatcacaaggtatcaaagaaagatttcaaagaccctcagctgcctagaaacaaatgtgaagaaattgtatattatttgaacgggaagaccaaagagtatcaatctcttactgatgaagtttggtctcaaattcttgacggtaacatcagactctaactgaatagcatttctcaaaagaccataataagaagttttacgacaaaatagaaaccaagtagtaataaccaagtgggggtgaaaatactgagaagttcccatttagaaaaaagtttaagctccgtttctatagactcatattgagccccaaatgatttggtactgaaaaactgatccaatagagcatccttttcacaccaaactttataaagccagttctgaaatggcaccaagtttgattcctgtatttcgtttgagctattcacaatttcaggatcaaaatttacacctccaatttggtggagatccagggcacgaatatggatatttacggaatgaggcccttttccatgtatgaatatctgtgacagtgtataaatatcttgtgcatactcatccggtgtatggccactgtatgcaatcgttagatcgtaaatatacttcgttgtagggctcaatttctccacagatacatagaggcctttggctctaggagaaaggacatgattcaaaggttcaaggccattcttctgtatgtattcatttgatatttttcttctattgtcagacatatttgttccttctggaaaaattatcagccaatgtttcttgaggtcatcaaatgctttagcagatttgttaccatagaaatatgtgatttctttcagttgcctaatcattattgatttatcatcctcccattttctactgaggaagatgaacctgtagttggtcattccatagccaagaacaggaattttactcaatgactttttcataatgatataaacattgtcagaaacatcactaatgaaagcaaaccaccacatgaagagccaatcagtgtaaatctgatgatttgccactacaattgcctgcggagatagagctgctcgtactatatcattccctgtaaaggtcctgtggtgtgtaaaggtgccattaggaattgattcatcatgagtaataatgatctttgtaggagacaccagactggtgacaaatgtgagtagaattatgaagttcctctttgtaaagttcaacaatctttgttgttggagggggttgaaacaaaacaatatcttaacaataatctgggtaatgacgatactcaaacacccagagaaaaaaaacaaaataatgaatcctaaccgaaagattttaaaaggatttaacctctgtttttctaataccatttatgaggtcgtctgtttctttattgtatagaataattactctaagatacgacaagccgaattctgggggaggatgagtgcgcgccgaaaacaaatccgtcgtgggttatcttccggggttagtattccaggccggcacacctatctgttcaagacaatacttcagtcagataataatgaagcaacctcatgaagaatagcgctcttaaatcatgtactaaacaccactcttagttcaatccacgaaccattcaaagttctgggcatttcgaaatatgctgggatggctaggaatgatacatattgatctcaggaatcattcatctttaatccaaaataacgtaagcacagaaacaccatttgtttacaataagcttctcgtcgacacatcaaaatagattagctttcttttgttatttgccgaccttcactttactactgtgcccgtcagattcggatatacaatttaacagtacgagaagagcatcatttctagattcgttacccgcatttagccacataaattgatgcatgcgaaccaaataaataatcagttaggcaagttgcagtgtattattggcagcttggcattttattgtaaacatcagtcggtatttattgatactaattactgcctttcataaaactagctgaccattcattttcgttaaatgtcatctgcttccaaacttaaacctcaaaaatcaccgaatttgccaactgatgatgagtctatcagttcatctatgaacaatgaccaaagcgagtcgaatcgccaattggatgtcgtttcattgaccaaagaagcttcttcttcttcaaataaacgtgttttggagaaatcaacatcaagttattcacagacgccagatcagaccaaacggcgatggacatatgagcctcagaaaactgtacctcgagatcgacgaagaaaccttggatgggtgactctcataccagagtataagaatcccagagagtatgatgaggccaccaaatataccattattttggtcgtagcattatcagctgttataggtccaatgggtacgtcaattcttttaccagtcattgatgaggttgcagcagatttgggaacgagtgtaacactggttaacatatctgttggtatatatttgctttcattaggagtattgccactgtggtggtccagtttcagtgaacgtttgggtaggcgaccgatatacatatcaagttttgccttgttttttgctttttccatcggctgctctctatcgaagtccattggaatgttgattggtttccgtgtgttatgtggggggtgctcggcttctgttcagagtattggggcaggaacaatagcagacctataccctcccttaatgagaggtagtaggatgggtctcttttatctgggtcctctggcaggtccactaatggctccaattattggtggtgcactaggtcaaggtcttggctggaggtctacccagtggttcctagtgattttttcagcatgtctgtttatccttcaattttttctactgccagagactatgagggctcaagattcaccagaggctattagagcacttttgaagagtagacagctacaaaacaatttagagaacaaaggtgatgaccgcaattcttcccagcataaagcatcagatgttgaaccagaactagaaactgcgattgaatatgaggagacggacgcattacttcagcggattgcaaccttggcctcgcactatgacgacgaggtaggtgaagaaagtatgggccaagttgaccgtgaaagcccagctgtctttgaccctgtaatgcctgcattgtctaagatggagacagaccacagaggtagagttgctttcttaagacggcgaagaaaccgaattcatgaacgtctagctcatgaatttcaaaaattacttcaaaataaagggaacaacacccatgttcctgaaaatctaaacgaaagcaggctgagagttgttaaacggaacttatacatttacttggtgcttcccatcaaaagtctctgttttttgcagtatccacctgttcttctctctatcatatactcagctccttgctttgctgtattatactttgtaaacatgactttgacttactgttatgcaaggagcccttacaatttttctccgattttgattggattggtttatattcctaattctgtgacgtactttattgcctctacagttggtggacggtgggcggatgtattgctcaaaaagtacaaagagaaacatggtgtgcttgccccagaagccaggtttggaatcaacattactatagcatcaattttatttccctgtgctctactaataactggctggtgccttgataagaaggttcactgggtggcaccgctagttggaaccgctatatttgggtttgctcaaatgattgtaattggagtcaacactacatatatagtggactcgttgccgggcagaggagctactggaattgcggtgaacaattttgtacgcatgatcctagcttcagttgcttcttttgtaactgaaccattgatcaatgcaattggtgttggtcctttattttccattctggcgggaattactctactgctgatcagtgtcttgatcgtacttaaaaagaaaggtcatcactggagagaaacctatgacttagagaggatatacgacaagctagatgatgttaattgaactatgaaacaattatttgagtacggtgtttagcatctttttggtaagaccttactcaaaggtagcatagattcgtgctccaactctcacaccagaactaatctttttgttaacagacatttcaaaattgttttcaaatccatttcattatggaacagttttgtaactggctataattaaccataattagcttccatgatagacgttaaccttttattttggtagtgtgatactttatttcattaattgaatgacgattgacctagcttcatcatgaaaaccgttgacagatatggacgttagatgaccattctcgtagccaaaatcgtaatttttgacttacaagtgcatacgatggaagacttgaccttctttgatcatcaatttggacatctatttaggttcagagatcaactcgataagtatacatcaaattagttacagaaaaaaatacggttataactaacccccctatgaaccgtgtacaaagaaagccaacttcctatttgtctcaaattacgaaaagaataatatattgtggcagtactctagaactcttaatttagatttacgaggtttggggttacaacaccgtttcagaaaccgttttgcaagtgtcgagcgttgtgtttatcatgagtacgaaacattgagtttaacaaatgtcacaaatgcagggggcaactagcctataaaagaaagggggtaacctagcattgcgtgagaacatgaagcaagtgttaccgaaatgctattcttaccgattttgtacctaagaaaatgtccgagggtaatcttattgcttactctctttactacgttttttttattggcttttctccttatgggagcatccaagccagcaaaaagcttctcaagcatctatttggttgagtacaaattcaaccaaacatctccgatgtttcccttgttggaacaagcttacaaaaaccaggatgccaaaggattgagcttgatgtcagtcaaggctggctacatgggaatttgtgtggatactccaaagttgcttcagggaaatagcacagatgaaatgaaagagcttggtagccagatcacttgcacttctagagactcaattggaaaattcaataaggatttcatgggcgtgtcactgtacagctcaggaactaacactacagctgcatttattgatcttgtctcaatagtggatgctttctccaataggatggtaaaaccgtacctcctaatggctattttggtactttcaatttgtttgttttgtaatctcctttactctgcgttacctttcatgccttgtaaaccaatcgccgaaaggagtgcgctagttttgtcaaccataacgtcttttctttggggagtgggtgccatgtggagccatgtagcctctcacagtattagtattgtgcagcccagctcaatgagaataattacgggcaaagtaggcctaaaagcagagattatcacctggatttcgttcagctttcttctcgcggtttgtttaggatgctggggtctatatctgagggacagaagaaatactaggaaagcggtgttgccaattgagaaaaagttgaggcagggactctagtagagaaagatcttaaaaataaatatatcagtaactaggtaaataaaacaggtggcatggctcaagaagcatcaatcaaactcaagaaacatatgaaatagtactctattcgctattgatctctgattctcttcttcttactatcaagtcaatgatctctaagctaaaattcaaaggggactcagacagccgcaagaaaaacaagaagaatgctgacagtaaagcaaaatcaaaatccaaagttagacgatctctaagcacggaattatctaggcaagagccgcaagctgcctccttaggcgcttctacttttcgcatcaacaatagtctaaggaaattcaaggatatcgacaaggatgacttggaagcaggatggagtgtggctgctacttgtgaagatataagtggacccacgatacttttagttaatggtgtagactccccaagggccttagcttgcgtcaatgaatccatgacgacagatgaccgattggatttaattgatgttgatgaaactgtcaattttaatgagagcaacaattcagaatttgcggcagaaaaggaaatgtttcgactagagccaacgcaaacttcacaggtatttgtttctacgccgttagataagcttttgttgaatgaatcagaccaaaaagatccagattacggcaagacctttctaaggatggctatgaaatccaacgaagacaaatatttaagatatgatagagatacagatcagttgattggtgattctgttaccataacacatgataccattttgactttaaggaggcttccagatcaaggctatggtgtatggtcgataacagtcggctcagacccttcactgaaactggtatacttagctgagagtgacaaggtccgggtcataaaagatgaagagaatatattggatcttgaaacaacaagtatagtaatgagggtccagacaaagaataccaaattgggtcgccagatcatggagtaccatgactttgccactcaagaaaatatcgttgatttgaacgatcttgatcttcagaagtataaggatgataggttaatttcggaaaaacttttggaattacagaggctaaaaatcaaggtagatgaggatttgatttcaagggtgcaacaagcggtgcaaaacagtgaaataaatgaatttatggttaaactgaaagaacaaagaaccagtgactccagcaggtattattgacaactgacagaatgactgactccctacaccttcttcgtacagtcttacataattcggaaaaaagatatcgcgagaaacctccatacggatgatagttagcccgttcccaccacttcggctgattgttaggttacgtggggttgaaagatggagactataaagcctgatccaaagaaggccatttaccccagaatttttatctcctaaaaatatgagtgttatagactttcctaaaatcaaatctgtcaagactttcctgttgggtaaaggtcttgggggtgactaccacaatgtagagactggtcactggattatcgactcaaaatttgctactcctatgagtaagttcgaagactggcgaggctctagaacttcctggggtatcaatgtgttaggatctttctgtgttgagctggaggctgaagatggtactaaaggatttgctactgggttcggtggacctccagcttgttggattgtcaaaaaccattttgagagattcctagtaggcgctgacccaagagataccaatcttattagtgaccaaatgttcaggtcttctatgttctatggacgtaaaggtttgactgttgctgccatttccgttgtggatttggcaatttgggatttgttaggaaaagtcagaaatgaacctgtttacaagttaattggtggagccactaaaaagagaattgatttctactgtacaggctctgacccatcagccgccaaaagaatgggattctggggtggtaaagttcctttgccatatggccctgcagaaggtcacattggcctccagaaaaatgttgaattcctggctgcccacagagaaagggttggccctgacttcccactgatggtagactgttggatgggattggatgttacttatacaattgatctggtgaaggctactcaacacttgaacttgaactggttcgaggaggtgttgcacccagatgacactgaaggatatgctctcttgaagagggcttgtcctcaacaaaagttcaccacaggtgagcacgagtacacacgttatggttttagaaagttgattgagggccgcaacgttgacattttacaaccagacgttatgtggattggtggtttgactgagctgcttaaagttacagcccaggctagtgcttatgatataccaattgttccacatgcttctggtatgtactcataccactatgttatttctcagcaaaatactcccttccaagagtaccttgccaactccccagattctcaaagtgttttacctgtctttggtggtctattcatcgacgaaccagtgccaactgagggtttcctgaaccaaaacgttcttgacaaaccagggtttggtctgacattgaatcctaaggttgaattgattgagtcaggagatattttatctcctagcccagagaaaccattaaagattaatgaggacaagaaataagagggtctatgtatttactatcaatatactctataaattgacgaatactacgctcccgcaacccgttatactataagatactggaaatcactcgttctgatctgatgaccaattcggcttaccggtgtcgcgcgttctgcaatagtatagaatttaagttagtaaattcaggagcagccgcacgacccgcccgctgtttatcagttctcactgactccgaatgcgcgcaacaccgagccctggctcgagattgaatgacctatttttttaaggcatcccatcacagctctatatatttattacgatgttccccaacttagtgaggttcaaacatttacacttctgtttggcaccatgactttcgaatatcaagctggcttgaagaaattgcctatccccgatttgcaacagacttgtacccagtacctagaagttcttaagccattgcagactgaagatgagcacaagaacaccatcgaagctgtagatcggttcatcaaaggagctggtccagtgctaaatgagcaactgaaggagtacagcaaatctcgtaactcttatatcgagcagttctggtacgatgcttaccttaactacgattctcccgtggttctgaacttgaacccatttattctactggaagacgatccaactcctctgcaaacggaccaattaacccgtgctgctgctttaacaacctcctcgttgcgttttgttcgtgctttgagaaagaatgagctcagtgtggataagttgaagaatggcaaagctttatgcatggatcagtaccctaagctttttggatcgtcgagaatcccctcgtccactggttgtgtgttgcagactgacgctagatcgcatcatattgtggttatatcccgttctcaattctattggtttgatgttttggatcaaaaaaatgatctgattatgactgaaaacgacataaagctcaatttcacaagtattgttaatgatgctgagcatgctccattggaggacattgccaaatccagttttggggtcttgacgaccgagaacagaaggatttggttcaagttgaggcagaacctagaggccgacgacaacaacaaggagatcctgaatataatagacaatgctctgttcgtagtctgtttggaccatgaggagatcaatgacctgaaggatttggctaaaaactatttgtgcggtacctcagtcttgcaaaatggtattcaagttggtacttgtactaacagatggtacgacaaattacaaattatcatcaccaaaaatgccaaagctggtattaattttgagcacacgggggtggatggccatactgtgttaagatttgcttctgacatctatacagactcgatcttacggtttgcaaaaacaatcaacaacaactctccatccctatggacttctgtttctcctgacccttctactcgggatccagcatcatttgggaacgttgttactactcctcggaagctggaatggaggctaaataatgatttatcgttgagtttgcgatttggagaaacgagactttctgatttgattgcacaaaacgagtttgctgccttggagttcaagacatacggtatggaaagaatcaagaagatgggtttctctcccgatgcatttgttcaaatgagcttccaagctgcttactatgcgttatatggtaaggtggaatgtacgtatgaacctgctatgaccaaaatgttcttccatggaagaaccgaagcaataagaacagtttcgcttgagtcgaacaagtttgttactaccttctttgattcctcgttcacagcaaaagaaaaggtccaaaatttaaaggatgcatgccagagacattcaggtagaaccagactttgctccactgggcaaggagttgatagacatctttacgcactattctgtatttggaagagatacttttcagagctcaactctactggaagtaatgaaccaagtgctgaaaccactgacaacgaagaagaggcctcagacacttctactctgaactttcagaatctttctttaggcaactccaatatttcatcgattgatgaagttaaagagattccttccatatttgcagattcaggctgggataaactgaataacaccatcctttctacttcgaactgtgggaacccttctctgaaactttttggatttggtccagtctcacctaatggatttggattaggttacatcattaaggagaactcaatttccatctgtgcttcctcgaaacatcgtcagactgatagatttttggacaccttgaatggttacctaacggaatttgaaaagatttatgccgagtctttaagacctgaggttgatcttgagactgaagatactgctgctgaaatcgaccaggttgatcatgaaattcaagcattcactcctgataaatacagaggaaggtcgttggacagaaagacagccaacgaactgtccaacttactaggcggatatgatttccaccagttagggcccaatgacgacatgcttaaatcccgtggtaactctcctgagcctccattttctagaaacactgcaggcttctcttctagggagattggtaagaaattacgtctgtccgagtactagctagtaccatatccagttgcatgtaaactttaaattctaagggattatatttctctgatagttttatagttgtagaatgacgattcagattattttctgttatcttttattttaaaaccaaactgatacgcggtatggtagatgatctccacttccattgacgaaaagtgcaaatctttctacaaacggttctccgcagaatgaatatcctttaggttcttgctcgcttagaagtctacggctttcaagcaaagagaaatcatcacagttaatggtgcaaggtgaaattttattggatgtggatgtgcggtttaagataagaccgttatcggaaaaagagcaggcctctcggagtgaaatccaagaaaagtcatttatagaactggaaccaaaggggatcttcaggtaatgtggtgatgactgctgagtgactataggtaaagaatcaagaaaccgataaatcttaatgcattcttcaataggatcagaaatggcaaagaagccatattgtaggttgctgcaaggggccaaatgaaaacagtcacctagagtgaaatcattgttgtaattcaaatactctacgactttcttcaaatggattgttcctttcttggtgtggcaagttttaaacaatcttaatctcccttgaagaccactaaccagcacataaacatctttgccatgtttttctgtgtgagtaaaagaagcaatttgtgtcacagttgaaccaaaaaatgttttcccggcacttagccagcttccgctcttaaaaacccaaaattgtatgtgcccgtctctcaacccaactataagtaatctagatgtgccaatcacagccatttctaatgccatgacgtcagaacttgtttttattcttgaaaaaggattttcgtttgacagtgcatctgctggtgacaacgtctgtatacgtactgttctaccattccctattgccaggctgccgtcgaagtcacaggtgaccttatcgtctctatgtacctcaatactctctagcacttttttgccttcagcaatgatgacaactttagtggcattgccgatttcaagcttgaacacaatattcaagtcaaaagctctataccataaaagttttgtactcacagtttgactcaagagataatcagcgtaacttgggagaggtttgcttccaaactggagagatccccagcgacctggtgcaatgttaactagaatctttgagttaccaggtattggtaggatacctataatgcggttattgcctgcgaattcgtagcaatgctttccaaatagattgatcacttgctgcaatcccaactcattgtcgaaagatgtccgcgtattacaacttttggaatagagtgctgaaaagctagtattcatccaaggagaaagttgagaaatttttgaacaaaaaaatgaagttgccaaagaaaactctgcttctttcttctttgagcccttcgagtcagacttcctcttgctgataattggaacctcaatctccagcgttcttttcagtcgttcgtttttccgaatcgaagaaatcgagtacggcgtaatatctgatataccatctgtatttttggttatcttaaagtacttctttctatgctcatcaaagtagaacccctctatatgcggaggggacattgtgtaagattagacctggctcgagttttcgcgtgtcgtttccaatgcttgattccgatgtttcagcaagccccaaccatttaaccatcttgggttcgataaacattctatgttgtccgtcacaagccaactggtacaaattacagttgttcagtcaaggagatatatgggatcaatatactatttcattgacctgcctccgcgttaaactctcaaattaaaaggtgcttagaaaaagcggaactgaagatagggagtatatccccaatcagcgaatattctagaaagaattcgatcccagccaggtcttcctactctgctcccgatttgccttcaacctctatcatttttgtttccttcatcacagaaacagtagtatcattttcttcagagcataagatggtcgtcaataatcctaacaactggcattgggtagataagaattgtattgattggagtagacagtacttcaaggaggctttagtgggtttagaatcaacaggtgaagcggctactgtagccgtcagcgacttaacttctgtcgaaggagatgtagaagtatgccagcgcaagggaaaagtaatttccttgtttgatctcaagctagtattggaatttattggttccacaaatgctgcaacctcaaaaacaattaagggctcaattaccataccagaggtagcttatgattcggaacgtgacgattaccagtttgacgtgagcgtgcacagtaatcccgacgttgataatcaaacagaagaacaaatccgagctttagccaaatccaaattaatccctcaactaagggaaaaattatttcaatttggagttgatctcatcaaagtccatggttctgacattcaattgccagctgagcaagtcaagtcacagtatactaagagcaatcaattgcaaaaagagaaagttaatacccaaatatttaaaaaatctaccccagtctctattgatggaagcaattcgtcttctcgggtccctaagtacaatactagtaccctacacctggaacccgtgttcaacactagcgctgatcaactgtatatgactcttttggataaagaaagagttgcagcttggaccagggctcctccgaatatcgaaccaaaagagggatcgtcatttgagctatttggtggaaacatcagcggaaagattgagaaactcgaatccaacaaaaagattgtgcagtcatggaggctggcaacatgggaaaaaggccattatgctcaacttgaaatcagtttccatcaaggcagcactgagactaagatggaagtcaactttactggaattcctgtgggagaagaagatgcagtacagagtaattttgaagaatattacattcgttcaatcaaggtgaccttcggatttggggcggtattgtagtctagttcaaagcgcatataacaaatctctgatttatttaatagatagtcaacaaaaagtaatattttgctcaaaataatcgcttgtacttcttatttggcgaagcgcttttcagcttccttccaattgataacattccagattgccttgaaataatcagctttgacattctggtactgtagatagtaggcatgttcccaagcatcaatagcaaccaaagggaccaaactaccggaaacagtatcctgatttggtctctgcacaacctcaaccgagccattctccttattctttacaataaaggcccaaccggaaccttgaatacctgccaacttagagttggtaaggcttatcagtgaatcgaaagaaccgtactcttcaatgactttcttagaaaaatcagaagactcagatggaagctctccacctccttgttttggaggagccaaattgtcccaaaagaggttatgattaacatatcctccaccatggaagcggagcgcctgctgtagctcgatcaccttaggtgtgttattggtctccttagcctcagacaattgctcaattgcagcattataaccgtttacataggtttggtggtgtttagtgtaatgtaactcattgattttgccactaataaatggttccagctcatggaagtcccatctcaaatctggaagagacactttagttctggtagttaccagagacgatgccaattttttggaagaaggcaaagatgtacgcaaagaagatctcaacatgttaatttaggtcaaaggtaagtagatgattccgctctctggttcaagataaaagagaagggagtgtagcttagaaagcaacaatcagcaaactgctatgtttaaagatcacgtgcaagagccgtctcggactcggaaaagattaaggcaaattctagttggttaactgtatgtggcttatagtgaccacagttctgtttatctactacaccttatggctatttctatcaccattcttagatgaaggcacttttctgatgtctctatttccaaatcgggaactggccatccaactcccggtagttttaatgattttaggagcaactttagttggttcttacgttggaattgtaatggttacagaagttaaataggacgagtaaggaggttttgaatcaattgagccattgggttatagtatttagttctttcgttgcacaggatgaggcttgccaaagtactggattagcctgctcatactatactcgttttcccgaccggggaataactgactgaaggatttgtaacgttttcctgatggtttgtttcgggattttaattcatatctacatagtctttcataatattagtctttttgtcgcttgtttactctactgcgctggctttcattcttcaggtagttaacttcactgcggatacttgaagttgtacacatcaagagtatgtcatatataaaagttgcaccaaatcgctccatatccaaatcgggaaattcttttcttttaccatattaacagatcatcatatcgcatatctcctcaaccaggttattagtctcctacttttcttcaaatccctagccccacaagcattttctatacacaacattgagtcgctttttatctctgtcgttctcttcacgttgattaaaaacatatcatcattttgcatagataagccaatctttttttagttgctgtcccttcctccttgattggttcgaccatgtctaagaagaccgccgaagatttcgaatttggtgaatgcattggtttaggatcctactcaaaagtatacaagggagtctcagttcaatctcgtaaagtttttgccatcaaggtagtttccaagaatcagattttgaaggagaataagattaaatatgttaacattgaaaagaacactctcaacaaattaggtcaccatcctggaattgtcaccttgtattatacttttcaagacatggattcattattttttgtcattgactatgccaacaacggagaactcttgtcactcatctcaagactaggttccttcagcgagatactagcaggctactatgtaacccaactcgtagatgtggttgagtttatacactccaagggtgtcgttcatagagatttgaagccagaaaatgttcttttgaataacgaatacaaactgatggtaactgatttcggagctgcaagagtgttcgacgacaagggtgagaataactctgatccatccagttatcaaaacgacagcccccctccaaatgaatcatttcctggtagtagacaagggtcgtttgttggaactgcagagtacgtttctccggaattgctcaaatacaaccacgtaggatttgaatgcgacctgtgggcactaggttgcattctttaccaattaattgttggaagacccccatttaaggggaaaagtgattaccttacatttgaaaaaattatagcgttggattactcctttcctaattacttcattcctcagagtataaaagatttaatctcgaaacttttagtactggacccaaaagatcgatttacgatagaagacgtcaaatcccatgagtggtttcaaaatgtccagtgggataataagaatagcatttggaaaaaacccactccaaaacttgaaccctataacccacgaatctattcaattaggtccactacatctcaaatgagattaaagcagcaacaggaacagaagcttcagcagaccgaatctatgattcggtcagcctccacttctttgtttccccactctactcagattgcccaaagaacatctcagaaaactttgaacaaggttctttctcaaaagattgccgaaaagaacaatgaactaagcttgaaacaccagacaacgctaaatgcattatacaacagtccaatgagaactcctcccaaaacggcaccaagagctgagtcaaaagctctccgaaaagtggcatcgaactcaggttcggcgatggaatggaactttcagaactctcctcctatcgcacatcataacggagattcaggcataccatacctggcatcctcatcttcttcttctccaatccaacctcattgtcctaaagatggttttggcggttactcctccaattggaacaaaggtcccaatatctccacagctagggagcgacggaacagtttgcaaatggttgataattccaaacaaatgcagactcccccactatccaaaggccgaagtagaactagcccatcagctactcagaaaaaagcagaagttgtgcgagctcctgctcaattgcgttcgtcgcttgttaatccgatactgctagacaacaatattccaaaggatatcaaggcaaaactaggcttaaatgagtcaattcttaaacttgataacatattcaaaactgagttagtgtacaagcggttcgaagatgttcagttggatgacaaaactttgaatgatattattgagaagaatagaacgaaactgtacaacgatgcgaagaactgcgtgatggtcatcaccagtcttgcgcggattcttttgtttgaaataaactgtgattttcagctgagtactccgcaatcatcatctatgatgcaagctttcccattttataaagcgttccaagaaatcaaactcacaaacaagaatgtttcgatttatgactatgattttgatgaacagcaacggacaggttatttggtgtctgagctgagtaacattaataagctcatattaatacggacgtttgaaccagagctgttccctggaaatgcgggagtgagagttggtttcagtactcataaggaaaagtcgtggatagaaagccttttaaaggcaaaagacttgattcgtagcggaaataaaaagaagcaagaatcaaagaaaacttcaaatggtactaaagttgtaggaaagaaagcggcctctaatattattcagggttcgaaaactagcaccacacaaaaaaagccatctcccaacaacaatgttgccgaaagcatgaaaaatctgaacatcaagtctaagcaagtaccgaatagttcaacatcatctcaattaaacgtgatcattaaacaacagaataaccagaacaaatttgcagcagctgctgctgccgcaagtacaaagaaatctgccgtgaactaagtacttacggtacctcatttgagaaaagcttatatacaaagatagtttagaaagaaacgcagctatgcctctatcctttgccttcactcacagctattcatacgcttgaccaatggactatcagagtctagttgacaagtatcctgtagcatcccaatgctcctactccgaacaatctgctctattgttttctcattgttaacccagttcaaaagttgatctactcgcaaatatttttcttccagttcctgctgcaaatcccttaatgcatatggatcgattcttgtatcaactaattcatttcttctgttaatttgactctcttctgactttatttcttgcctaaacttcacagcttccttgtgacagaactcaatagcatttgatcttgcttcccaagcgggcagtattgaggattcaaaaaagtcgttacaaattgaagatttttcctttttacgatttgaataggttgattcatgatgatttaatttattgttcagttgctgtttcaaaacatcatcagtggatagccgagaaagcttgagaaaagatctcacccctttaggagtaagacaggcatctcttgaaagagaatggattcccactgtctgaggttcgatgataggttctgcattcttggaccacattaacgatgcttgaacaaaactccgaaagatggagttttaattactatgctagacaattctcgaatattcaaaaaatagatacctatattattccaactaacgtcaagaacttttctcaaccactccgttgctgattattgccgcagattgccatcctcccgcagcgattgccaaaacctgaccttcaactgatattggggttggactaattattgtataaccgccctcatcttgcgtccctagtcctctttctacaatctgcttgccgtctccgagcccaaggcacccacaatactgggattccctaccccatgaaagcatagttctgtctcgcagcagggcaagaaagtgatagtctccaactgatatcgagatacagtctttgtgttgtaatgactcaataaccttcacaaaattaaggttattcagatcgcctatgagaacttgcccatcatccgtaaaggctgcaaatgttttgaatgatccgcttagtttaataaatttaacatcgtcagagctgtagctattgtcacttttgtacctgttaaagctgtctaacggaacgggctctgtagtcggaacagtttcaatatcatcaaccttcactaaaaaacacttccctgacttcgtaatgtaaatgatagccgagtttagggcaaccaggtctattacctggtcttcgttattgtttccagtattcgggactactttaaaatgagcctgaactgcgctcgtggaacgagtaaatgcatctcttgatttccaaacaacaattcccacattcaaaacatatatactgcttaggttccagcctgcggatatttgtgtgatgatgttcgaagaattgttgagtggttcatggtttggcttattgaaactcagttttattccctttactttctgctgaggacaatcccaagaccaaatagctccagaatcgtcgagcgcaatgaagtgagatctccctgaacttaccgctaaaatcttgcgttcagggtcaattttcaccttggtaagaattccggttgcttcacgaacttcattatcttgtgctaaagctgaagttagcggagaattgagatgctctggtaacagttctgtaattcttggagtttgagtttcgattgggggcattgtagttatccttggtaaggggatcaatggatgtcggggcattggtagaactcctggtccatggtgagttcttgatgagttctcagatattctatcccgatccacaggtccagggcccttgaggccgccgtgccaactgcttccagtaaaatacaacgtaccatcctcggttaaaatttgaaaggaaaaccctccaccagacacatcagccaagaccgaaccggccaaccgttctactaatgttggcaagatgatattaacactaaatcttcgtctatccaaatgtgaacgtggtacctctttcaatgaatatcctagcctgcatccaccggatttaccccaagtatacagcttacctgtggatcgcaatttatataattctggccactttgtagacgtgaaactgagtgggacaggattatgtccaaaagttttagcgtataaatgacggtaaactgtcgaatcttgggttaaagtctcaaacgcatggcaagtacgacttaaggaattgatgtccgctctgtccagctcgggaataatggagtttactatgacatcttgaggtaaatcaagtatgttaatttttgacatgggaagatttgccagtgaaaaactttggttcactggtaaacttatgattttggggaaatcagagagtgcttaataggtttaagagatcatttggtaaggctacgtgcgaggttctacaatattcgcgctaaagcattctctctcaccttgtttgaagacgaaagaatgtcttcgaatattgacaccgtccagctccatgaactaaggagccgtatatatatatatcctatatgcatctaccacccaagcttcgatcgaaggcctgcctttaatataccagtttgtgcttcgccgattgttgaatttaatccttctttgaaattactggcataatcattgccagcttcatctaaagattcgataccactctgtatggacctgtatgcttgtttcaaaggattgacggtagcaacgtggtgcttgcgaatcggtttattgtagttaaattcttcatcttgagaaccaccttcctcgccaaatttcgatggagacttcaatagtggactgttaaccatagagttcaaaactccttggttattggggttgtagggtgatatttgaaaggccaattcggaatctggagttggatttcgtaaagagacgttccctccgtacattaactggataagatcttgataagatatcagtttggttcctcttttaagatactgtacagtattaacagttggtctgtatgggataatcaaagaatcattgaatagttggtcaatattccttgttggagacagttctgcagttgaatgtccaacaatatccacaagcccagcttcgctctcattgatccgtaccaagatttcaccattcgcaatcacggaactatatgccaaataatctgtgctgacgggatatggcagtattaaagtcgttatctccctcagggatggtaaagaataaaccttgatatcatttgacttagatagaacgttaaatactggagaacttccctgatttgagttaggtataaccgagactccgcacgtagcaactccgcttttgatcgttttgtgtgttactctgtgcagcttattatctaagattctgatatctgagttacttgaagcaataatcaggcttcggatgaccacaccattagacaatttcttgaaatgacctaaagttgcaatcgtgaatgctcctgtctccctatcaatacaagtcaattgacataatggtccattcgtagcaccaataaaaatgtcataaaactttacctggaaacttccatttgaacttggaataatttgaaatcgtaacaggtctcctctgtttgttcctaataacaaaactaaggacgaaaatgtatcttcattcaatgccattactcccacctctaagcaagtaccatatataggagtaccttcacaaagctcgctgagaaatatcgaaaaaagtatagaggggcctcgtctatcaatgatcattaactcccctgattcgtaacaaataccaacaaaacctacgttgctgtttatcaatgaggttacttttcctgaattctttcgaatataagatacaggtaaaaagccttccttcaagtctaaaggtgtgcgatcgcttatatcgttgagaatctgagcactaagactgttagggtctttattatcatgcttcaagttcatacttttaaatcgctgatttaaatccgacactttagaattgtagttatagttctttgcaaacttgaagagtaaaacgtgtccgttcaaagtggaaactgcgagctcggcagtgtcagcggcaaacgaaacatttgtcacagtaacatcgttagagtcatcctgtaagatcttagtaaggtcaatttcaagcaaggaataaacgtcaagttctccagaagatgcgtcccacattctgatgaatccattctcatgccctgttatcaatgctgatgccagtgaatacgcactatctgattttttttgtgagcttccacctttaagcagaggccgaactttgcttgcagttgaaacgctcagcatacccaaccactggcttcttggaaccggacaggcacgtgaacaagatatctttgggttcatccatgttagtgttggaggcaggattccggcctcgtagttgatggtccccagtggaaagcttacaagcttcaaatcaccactatccgataagaccaatatataccttgggtcgtggttaccgccaaaatacggacttgcttcgcccaaaggaagaaagtcaattatggccgtgctattgtgaataggcattactcgctgagatttggggaaagcgtagtactttcccatattttcataagaggtaaccgagtactttggagtttgcccaaagtctaacagtgttaaattctgggcacctaacttctccggtgtatcacctccacatataacaagctgagtatgttctgggtccttagcacatatccaggagatcttgattattggtgacaacccttgcgtatctggtatggaagtagactgattgatgtatgtgtcgtaaagagttctcgcctgcagaatagtaccatcattagaatcccaaaatacaaatgaattgtcatcgtacaaagtgactatgtttaggccattaggatgccacaaggctgttaccagttgaacgttttggccgtttggtggcttatatataaattcttgcttgatttcatctgtgacaaatgaatatatgacggagacatgtgtataggcgattagtacggtccctatatctctcggatgccacttgacagatagaactggactcacatacttaattgaaggtaatacttttctctgcagattaccaattctgtatggagttactttgccaatgctgatatcgtaaaagatacaagaaccgttttgaaggcctattatcaaaaactcaagtgaatagtctgtttcaacggaggtgatgatacctggtgcagaataagtgtacaatagcttcttggaatgtagtgaaaacacaaaaatggtgcttttggcatcaattgctactaaataaatacccttaacgaatttgagggtaatgagctgcaaactggattctaacacaaacgcaacttcgactttcttttgtccaaaaacgtgcacctcccccttacctgttgatattgctaagagactctggataggatcaaatgccatacacaaaataccaccagtgacaccataccttgataaatcagtcaattgaaacgatttatttgatacacctgaagacagacccttgtccaaaactttgttcatgtcaagtaatttgccagtggagctcggcatgggctgagctcctgaatctgttgacttttgttctcttttgaacatgtttcgaatagatttgaatgataacccccagaaagtatgtgtgatgtgtagttagtggttaaggtgcagaattaaaggagatgctcgaatgagactacttactgatagactttcttcatttttccaagaaggtctagcgatgacatatggatcgactaaggacaattatcaagcaagcgtcttcaatccgtccaacaaacccaggtgttctctagcattcagtactatgtgtctagtttttcttgccaactgtaatgaagaggttggataatatttcactggtgattactctagcttgtcaactggatagcatacaagaaaactactgtgcagacatccagttgcctgagctgcttataatttgcagcgccttagatcctgcaataatttgccaaagtgattcattttgagatcttcgttttctcggctgtaaacctttgaatgtcaatcacatgtcaaagtgacattagccatgagattttttcttcttgccctagctcgattataaaaggtcttggtaccgctttctctgcttggtaccgctttctctgtgattacgttgttgcttgctcttcgaattttaaaaatattagatactgaactgtgttcactgttgtcttctatttgggcaattcatctttttcattgatgctggaatatactcaagttgaagaaattggttctctcgtagataaagctcgacaagtttttgatagtaatgtattactaactgtccaaaatcgtttgaatcaattacggaatctgtactatgttttgttggaccatcagacacagtttgaggatgccctcagcaaggacttcaacaggtcccgatttgagacgtctagattggagctagcacaagtatttggagaaattctttatgtgatgcagcatctggagtcatggagcaaaccccaaaaagtcgactacctccctttatctttcggtactacttatagcacagtggaaaagattcctcttggtgtaatacttatcattgcaccgttcaactacccgatcgttctttctttgtctcctatcattggagccattgctgccggaaacactgttgttttcaagccgtctgaacttactcccaactgtagtacactcctaactgaggtgttacagagttgttttgattacccaattgtatccgtagttaatgggggaatcaccgagacccagaaattgttggaaccgaagtttgacaagataatgttcaccggaagtggacatgtaggaaaaattatttctaaagcagctgctgagcaccttactcctgttatcttagaattgggcggaaagtctccttgctttctgacttccaattgtaagactaccaaaattaaagctctcctgagtcgaatcatttggtcttcatttgtcaatagtggacaaacctgcgtggcggtagactatctattagttcacgaaagtatttacagtaccgtggtacaagaatctactaagatactaaaggaattctattgcaatatcacagagaaaagtgattttactcatcttattgatcgaaagtcattcaaacgaactatgaccacattgcaaagaaccaagggcaaaaagatcagtttcggtgtttctcatgaagacactaactttatacctcctacattgatttgtgacgtatcctgggacgatgagaccatgcaatctgaaaattttgcgcccattcttcccatcatcaaatactccagtttagaagatgttgtgagcgaggtgaaaactgagcatgacaccccgctagcatgttacatcttttctgaagaccctcaagaacaaaggtacattctaaacaatttacgatcgggaggagtttgtataaatgaaacaatgatgcacgttggactttacactgcacctttcgggggaataggtgactcaggctatggaaattaccatgggaagtggtcatttgattcttttagtcactcaagaaccgttctaaaacaaccgttgtgggcagagttcctaattaaagctcgttatcctccttacacaagaaaaaatagagcgactctggagctcttagataaaggtgtggtttggtttgaccgttccggtaacgtcccttcaagaagatcgtatttaacgaaagttattggatactgcggattgatggttacaattgctgctgcattaattggtaaacttgttttttaaacttttattgtttcgtctgtatcatctgttaagagatctgcatctttgataaactgtttgagcttatcattggcaagattggttgcctttttgttgatatttatgggaataatggtaatatctgaatggtcataattggtcccagattgctcttttttttgaagagaatctcgatggtataccccgcttatctggttgtctagtaacttgatttcctttctcaaatgtatcgtagcatttgataagttcccataaaagtcgtgagtgtaatttttgaattcggacttgatctctgctaatttcggcaggtcttcatttctagaggccaactcttcaccttctcggagttttttggtggcattggccaaattttttagaatttcagctatctttgaatctatgtcatgtaaggaatcaagacgttgcttgatgtaagatagatgatcttctgacatgaacgcaagttagtaaaacactgattaccgaaaagtggtaattgttagctggatcttgtcttttcggtaggtgatacaatgacgtttacgttgatatgaacagtctcctctactatctgttgaaacacgtctaccccacggctcataagtaattcgctaaccttgttaaggggcatcgcgcacttctgagttcgaggttcgaaaacaaagtcacataactgcctatttagtcgaactatgtcatagctcttctttcttaacatccacacaccagccactcgttctgctcgatcgttgaaaaaaaatagatagtacatacggatattttattctcttagtgcaatagaatagttcataaaatggctgacaacagagaagttcttgttttgagaggtaccttggaaggtaggttattttaatggagtcgacaaatacactttctgctgcaattttcggcgtgaaccacaacgtatactaactttttttcaggacacagtggatgggtcacttccttggcaacttgccctactaacccagatatcttactgtctggatccagagataagaccctgattgtctggcaattgaacggagatgaccaagcttatggtgtgccaaaaaaggctttaaagggacactctcacattgtttctgactgtaaactttcattggacagtgaatttgccctatcttcctcctgggacaagactgttcgtttgtggaacctaaagaccggagagatcatcaaatacgccggtcacacttccgatgttttgtctgtggacctgtctcaaaaccttagagttattgcctctgcttctagagataagactattaaactttggaacattgttggtgaagaggttgccactttggagggtcacaccgactgggttacttctgtcagatttgttcctggatcagcttctgacattatttctgcttcatctgacaagttggttaaggtatgtttttttcttttgcatggttttttcaagcttttcaatttttcaatcccgtcttcatttatcgccaattccttctgttcacatgatgttaaaacaatattgctacttcagacagtgatctacactggatgagactttttacaccaagatctctgatataaacaaaggaaatggatggcaattcaaaatcgggtttgaacttgaaatattgattatttagatatgctcttactaactcactatcttagtcctgggatttgaacgaaatgaaattgaccgcagactttgttggtcacactggttacgttacggcaattaccgtttctcccgatggatccctctgtgcttctgctggaaaggatggttccatcatactttgggatttctctgttaagaaagtcttgtacactttggatgcaaaagaagaagttcatgctgttgctttctcacctaacagattttggttgtgcgctgctacttccaagtctattaaaattttccacttggagaagcgtaagccaatggatgagctgaaacctgaatttgtttccacttccactaaggctagagacccacactgtatttccttagcttggtctgctgatggtcagaacttgttttccggttataccgacaacgttatccgtgtctggcaagttatgacttcaagttcgtaagttaacacacgttcatattaatatactctgtggtttttatatctattcttctgattcttgtagctgttcgattgctctaagggcttcttcagcatcttcaacaaaaccaagatcagcctctaaaccccgagagcttgtcaatgcttcgttaatcaatcttcgagccgtttgagcccgaccaaatcgtagattgactagccccaatccatacttactgatcgtagctgcctgtttgagattatagtcactttgtctttgtttctcaaggattttctcctcggcagcctgcggcccatctttgcttataactagcatgttgtttgatgatcgaaatctggaggagttattgttaactattgcagaaaatatcgtttgggcagcattcaaagaacttttagcagccgcttcacaaacttgcaactcttctttcaatttggagctttcctcagaggtgagctgaaaatcatcgccttgtcccaacttttttttgatgttttcactattaaactcagcaatagcggattgaagataaagaagagaaccaatagaactctgagccaaataaatatccccaataggttcccccatcgccattaagtactgaacaacatcttgctttactttaattgctcctccaaaatctcccatacgcagcaaaagggaagaaaatacttccattgcgtctaacatgttatctacaaacatgctagcagcttttcgatttctccaaatacgtgaaatcatttccacactttcaagttccgtagggttttggccctgtgaagctatcaactggttcatattctcttgaagagctcccccctggctttgaatggtcatggcggcggcttctaagctaagattaaacaatgttttgaggtcctctaattcactcggactggcatcctgcgacaactccgtagccttcaccaaagacatcaaacagtgttttattgctttaggtttgtccattagttcttttttattagttgggttaaccacgttgtataaagttgtcgaaatcaaatcaaggtggtacaatcttgcctcgttgataagacccaacttttctagcatatcacaaactttgaggagaatggatgtatgagtattaaagtctgtcccttgatgcaaagcttcaagataaaattttagggccaacttatagttaaagtggcctttatcactctccgcttctaatccttttcttaccagatcaaacacttctgggtctaattcaaatcgataaaaatcttggaacaacatataacttgcgctcaggcccgttagtaaagcaaaaattctaaacggcgtaaaaaagggttttgaagtaggtgttggaactggcggaaccggaggttggtcatgtccataatcacggcctttagtatatgtggaaggatgaggtacgggcttgccatttggatcactgaagtagtgcaacgagtcttgtaaagatcttgcagatgacctaaacagtcggacactcttaccaaaacttacccgtttaagcattgacacaagatttgagactacaagattgagtgatgagatttgtaggtggtatggcccggtacgaaattagcgaaacttaggcactaagtaattcaatactatgtagacatcaaacatcaaacatcaaactacgacgagacccagcaaaaccgctcaaattaagaaccaaagttctctactagtagttacttactaactgataaaagttttggtccatgctttctttctcggtcaagctttcccaactcccttttagtttcttgaatcaactcggtgtaattagttctagaagctctccttaatgtctccttcagtagatcttcagcttctttatacatccctcggtgcaatttaatcacacctagtgcatatgtcgataatgctatggaatcatctgtagtctggtcaacttggtaccacaaaaccttggatttaatagagttgttttcattaatgccactcgtgcgaattgcgttggttgagcctttcttttgcttttcatccaaagaagttgccaactctctcactgtctcaaagcattcggtcgccgccgatagataatcattctttgttgtcattgtccgttgcagttcttcttgttgtcgaggtaaatcgtttctatatttgagttctaatgactcaagttgttccgccttcatgtataacaaagagcccagattgtattgcgatagtagaatatcaccccctggaacctgagctagtaccatgaggagtagaatcctttgtcgttctttgatggcctcatctagttttccagaagctgtacataaggacacatagtagtcagatgcgttaaaaaactcaaatgtaaaaggggaccaattttctctgttgcgttcaactttgatctccttattgccattgactagtactctgttattttcaataactaatttgacacctttaagatcttgaccctgctcttttgccgatttagcaatggcgtagttggagcacaacagcatagcatgtttaaggactttcaaggcattctctgtttgatttgaaagctccagtacacgcgcaatcttcacagatactctcaaatttttcaatagaatgtaaggttttgagagctcaggataagtattatcttcagcctggtcactcttcaggaatgcgaggtacgctgaattaatctgtttatacattaacagggcactcccataatcatgcaaatactccatcatttgagctatcttgagttgaattccagtgtattcattagaccattcaggtatattttcttccttggcctgtctcaaaccaatcctgtaggattctaatgcgctattgtagtcgaaatcacccttatcagactccgctctgagacccttccttaaagttttagcaactggtgcagaaaaagtatgatgaggccaaaaataataccatgaaactgagccagcaaccagggacgctattgtggccatgaacaatctgctttgccaaacattctccttgcgataatggtagctgtaaagccttttgaaagaagccagcctccgggaatgtctccacaataccatttacaaaatcctgtactttactaggacctaaaagttgataatactatagatttagcgtaaaaacgagtcaacttttttgataagagaatgattcccataatacttgcgccttcgctagatcattcgagaagacataatcggcttatggcggagacaagtattgactaatcttaatctacattgcttttcccttttagaaaactatgtgtgggagatactgcatgtctttagatcaccaagatctggtacattggatggagatgcacgaattaccggttgataaggttgttaatgaagttcaaaggagctctcgctataatattggccctactaccacgaatccggtttactttcaaattgtagaaagcagctgtcataagggaatgttagagtatatgaaatggggattcttgaaaggatattccactttcaatgctaagtgggaaactctgagcactagccaactttggaaatctagtattaaccaattgcgatgtgttgtcccaattcagggttactatgaatggaaggacaagattccctattatgtatcccacaaaacagaaaatgttttttttcttgctggtatatacagtaagaatcgatgctacgctatagtgacgaaagatgccgactctaaggaactagccaatttacacaagcgaatgcctttaatgttggagaaggaagatattagttcatggttagatccgaagataccttttactcatctagaaattaagccgttcgattctaaccatttgaatatttacagggtttcaaccagagttggaaatgtcaagaatgagggcagtgatctgataaataaagtgagagatattacttattttactaaaaaaattgcgatgtcagccaacggatcacagtcatcaagtttcaaacggtcggctcctgagagtataactgaagaggaaccggataagaagatgaaaaaatagattgttaacttgttaacttgttaatatataatcaattcctttctaggagttaactaggctgttatggcgcatccgggggaggtagttacttgaccttgattcctaatagcttacaactgaggtgtctcgttcgatcctggcggtccgcaatattttccatacgagtaatctgtgggggaaggcgagcaataagacgtgccaccgcccaaggggagcaatccagcagggaacacgtcccgcaaggaggcgggtgagatagcatctcgttggtaatgggctgttggtgaacaaagtttgactatgtgaaccggctatttacatttttgctttttaaggcctacttaatgtatgtgtttgtaaaatggattagttacttgaactcaataaaatgcttcctatttacttattttggttatttaccaggcttgccaaattctggaacaacgcattcacatcaggctgagttgaagctgaagggtgctgctgagattgactcaaaggtatagatggttgcatctgtggtggaggtgaggcaaaactgttcaaagagttcatgttcgtattgggagtagcatttgagcttgggctattgaatagttgtcctaagggattagactggataagattaggcgcgaactgaggaactgcagaagctgaaggagttacattgtcttgcatctctcctggtcggttagagcgaggtccatttcgggcactatttgtaggcattttccttgaaatagctttagacgaaactccatgaccgacctcaatatctggctcctcaaacacttgtcctcctgtcaaaggctcaccaccagttcctccccagcctgcttcaactgcccaccgtctgtcagcatcggtcaacctatcaataggaatgatcgagacgcccctttgataatcgcagcaatctcttggtccatatcctacaccccatctggttcgaagactagtgtttgtctgactgacaaagttattgataacattctcagcttcttgtctggagtacaccttgacaaaagcaattttcttacccggattcaatattacactttgtacctcagcaaatggcctcaatatcgtggaaagttttatttcatccataccagggttgacgccgccaacaaatacagttctgctcagaactttaacagatccttgaggtagggtgttatcgtaataaagaggcttctgtctaaagtgagggtttgaagggtcattcctttcacctggaaaaagagttggtgagtcagtagagttggtagcttcctttcttctaggagatcttgatcttgatctctgatcatttcgtctagaatgatcttcctcattcctgtctcgatagtcttgatacgattgggtctgggactgagattggaatcggccttgagctggctgaaattgctgatattgtgggtgagactgttgaagaggttgttgcagctgctgtgcttggtgtggttgttgatactgagccatttgtccaccatgcatctgctgcagcatttggaaaatggcattagggtcgttggggttagatagcacaggagcatttgcggcaggcggagatacaaatgaagaagtggagccgggattaggtgcacttttgcttacggaacctgcttgcgacgccaactgctgcaaaatagctgtaggatcacttcttgtctcggttgaattgccagactgcaataggtaagatcggctactgggaggagagcccggaggagtagtagatctaaagtacttgtacttgatatctttcaaaatgctagactcaaatgtgttgaatcgtgaccaaatgtctacaagtttactgagtttctccttctgctcttcgttgatgccacttgcaaatgactcttctataacttgcttgattatattttggatcttgtagactcctgcctcaaaggaaccatttttagaatcggaattaactggattaccagttatgagatcaaagtatcgccttgctactgcatcgattacataaacgtagcccaacttatgagtaggaggagcaaacttgaagttgtcatacatcacatcaacaagctgcgactcttgcgatacgttatccacggcaaacgttactagtttcttaattctagagcctgaaacccctggggccttcagtgtcttaagttcttttagcgtagcatcaaattctgcgatcgacatggtgataagatacaattactttacgtttctacgacacaaaagttattgaactgagctatgatattgttaatcggttagaggaaaaactatggtaagtcggagactctaagtgaggggcgaaagaaatgacttatacttgacataaattgatagacacacgacacactagatttttctgcttgcgatggatcaacagaagattgagtaacttgcggaagagttgttacagttctctccgtgctcgtcaacactgatgattggcagcaatattcccatcgagctttctatctatttttactctttcatcaatatttgtagggtttacaataataatgcttctcattggttactcgcttatttcaaaaaattgctaatgtctcacgtgatgaaagttctgaaaaaatcgatgtactcttatgtaaaaattgatactcttcatctagatagtccatattcgtcaatgcttctccctaggataagcagaatctcttctgatgccattcacagaatgtcacgttctaggataagagcattcagcccttattccaaggctttacgttcattttccactggaatttcatatttcaaagaggtgccattttcaagaatgacagaagaagagcagcagcttttgacagaacaaagagttgttgatcatgcagacgtatgtgttgttggaggaggtgttgctggattggctacagccattcgcttaaaacaattggataataaagaagggtacggtactcttagagttgttgtgttggagaaagcaccagacatgggatcccacatagtcagtggagctgttttggaaccccgcggattgagagagctcttttacaccgacgatgggatacctcttccagatgatatggtgacactagtggaagaggaacacatgagattccttgttcctaatgattcatttcctgttccagaacctccacagatgactaatgtgggcaagaactatattgtatcactaagtgaagtcaccaaatatttaagtgagagggcggagaagcttggagtggaattatatagtggaatatcagtggatgaacttgtcatagatgatgcttcaaacagcgtaataggagtagctaccaaggatatgggaattggcaaggacggagtgccgaacgatgattttgaaagaggtatgcaatttaatagtaagttgaccgttctggccgaaggatgccatggatcgttaagcaagaaagctatcaagaagtataatttaagggatggaagaaacccgcaaacttatggcctcggtctaaaagaagtttgggaagtaaaaccagagaatttcaagaaaggctacgttgggcacaccatggggtatcccttaagtgaagatgtttatggcggtggttttcaatatcattttggagatggtttggtaaccgttggattagtcgtagggctagattacaagaacccttggatttcgccataccaagaatttcagaaattaaaacatcaccccttttattcaagtgtactaaaaggtggtaaatgtatatcttatgcagctagaactttgaacgaaggaggacttcaatctgtgccgcagttattttttcctggtggggtcttagtgggagcttctgctggattcatgaacgttcctaagataaaaggatcacatactgcaataaaatcgggaattctggcggccgaatctgctttcaaggctttgcagaaacagaatttattgaagacggtcgaggaagttgaaaaggaaactattttaaaggaggaagctgaggaaagaggagatgagtataccccacttgacggtgctacagcattagagttgaggtcatacgaagaagcatttaaggattcgtggctgttccaagagttgtatgaagtacggaatgttaggccatctttctcaggtccgtttaagctgctcggaggtttagctttttcaggattggtaactttgttcacaaagggaagagagccattcactctgaatcaccacaatacggatgcctacataacagaaaatgctgcattacaccccaagatcgtatatcccaaacctgacggcgagatttcatttgacatactcacgtcagtatcccgcacaggcacttatcataaggaggatgaacggtgtcatcttcgaatcccgtcacaggactatgggttgcatacggaaaggctatacaaggcgtatcgtggaatagaaaatagattctgtccggcaggagtttacgagtatattcctgatgagtcgaaaaaagatggggttaagtttcaaatcaatgctcagaattgcattcactgtaagacttgtgatatcaagataccaacacagacgataaactgggaagtccctgaagggggggatgggcccaaataccaaatgacttgaactgattactattttcaatagggaaacacgaactaggttattattgatacaattttttatacatacaccatatacgcaaatcccggtatagaaatcaattctagacttggtcttcgcatctataatacaattggcttattcaaacgaacatggagtctaattcggatatagacatatcctcaggagactcaatatcttccgtaaggaaccccgatctcaatgtcctgatccaggcaacagataaagcagttccgcttttggatctctttttagcaggtatttgagactccgcagggattgaactctcactaaaagaggcagcacgcagcgcagcagcggcggccattgacgatggattattaaccaagtctttgcgagagaatctgggagcagcagctgctgcggtgacgtgttttgggcgcttcgaattcaaaaatgagaaagatttagatcttttggttaagcgacgggcttccgtttcaaaatcttcatcatcatcaatttctgattctgaaggtctccttttggacgcaggggacgattcagcgctggctctatccacgggaactcgactcaatgcagctgtcaccggtgcaacattgtagggcacagaaattgccggagatttgagttcatcaacgaaggaagcagacttattcgtaggcaagtcaaatacagtggcccttctttgtttggtgactgtagggaaaacaggagagtccgaggaagactcgaatgcggaagaagatccaaccgttttcttcgctctatcgtcaccgacagaaatatccaaagatctctgtgtctccaatattgactcaacgtgtacatagtattcaggggcaagaattcctctataaacatagaccattcttttgggcgaggcgtccgcccaatctcttgaaagagcgtatatcaaacctctttcacccttttcaaccctcttcacgtacgcgttaagtttagcagatactaaattggaagttttagtacttaactttgccatctctggatgcttttcactcaggatatcacacaactgtttgacagtcattccttcagttttgggatccttttcgaataatatttcaaaaatagcataaagaacatcatcatctaaagtggaatgctgaccaggtttgggcctttcaccggttactggaacacttgttgaaataccagtagttgcagcaagtttcggccttttcttcaaaactttcgtccccgatccattggccatgggggtaggcagtgaagcagtgactgccactggcttcttgaccacggatcttttcgtctcttcagagattgacgacacagaagtggcggcggtactttcagaaagggtcgaagaggtagacgatggagtgccgcctctctcagagggactgactgcagttccaatttcgtgtgacaatggagactgcgaacctgacaatccgaagtcgggggaacgtaatctagtcccttctgacttgatcactggggtttctggcagaacagacattataataatataaacaacgggaatacgcaaagacaaacacttggtgaaaatctaaaaaaatagtaccacaaatgtactatatttcctcctcaatcttcacctaagagacaataacaggtaaaaggggtggatagggatatttaacctaataaataccacctgtaaactgttgaaggaacaaaacgggatcgggcaggtaaatacaagataggattagaaaaaacaaaacgagaacggcgcctattgtgttaataattagagtctgaaggaaaaccggtgtccagagagattccttactgttttcttaatgcttgtgcgcagaatccttttacgaggtaaaagaaatctcttttgttggctaaaattccagagggagcagatagaaaggtagaagaagaagaaagagttatttcaaaaatagtgtaccaagaaataacaacgaaaaatattcaacacactacctttatggagtgcgtcactttttgattggaatatactgaaataaagaataaagaatacaataaagcatatccatttgttgtacgaataatacggtataaacaacattagcggtgtggtatattccaactgttcttacctgtgtgaatgtatctcaattcaaatttgcctgataatggaaaagaaacaatctgggtgttattctgcggttgttcaaagatctattgctcaccgctctcggaattacacgtaactctggaacagagttcatcgaaggcagtaacttcacaaaattcaaagcatcttagttgacctgggtacagatatgttctcgtaatctaccgcagtcttctaagaattttgtacaaatcgaatgggtatgtcctgctccaaattaggaacacagtcacaggagacgcgatttttttttaccagtcaggaacttggggtgaagtcaactcggtattgagagaaactctaactgcgtcttttcgagcggccaattgaatgactttcgttccaaacatttttgcatcccgctttcattactaaaaattagcattgtattcagatgcctgtccaaaatagggcgactgagctgcaaaactttacacttttctattctctattctcattttctgattacatcaactaagctcttctatttttgattgcatgcattgtttgtcgggcttcaactttatcccgaagcattgggaccccccgaccaaaggttgctgagattcagcgtcagcaatagattcgtcgtcacttctggccaagcttagtaactgtgtattttgaaagagactagccacgtagccatgcaagaatatgatgagactcgcgcaatcgaacagcaggaaaagttgacgtccggatagcatactataggtgctactggtaacaggggtttataagaattactaccagatcaggaaatttatgaaaactcagatcgagcgagctaattgagtagatagggggagatttcactccagtaagaatcctcatagggcctatcagacgtggacccattaggcggttcaaaccagtaatttattgcttcatgaacgtatggaaattccggggattcctccccatatgatttcacttcgtgaaaccaccctgcgggaagatacaacatttgtcccggttccagatccactataaggctgtgacacttagaaagcagcggatagccattctgggataattcatgaagacgtgctctatcctctactgattcaacttcctgtatgtgcagcaaagctggaggtatcctgctgaaggatggcggttcaacttttggaacagaggagaatgaagctaacagtttatcctcttccttgatttgttcaagcagcagcttttgttgagtttcagaaagagagtcagattgctgttccagtttccaacgacatacttcacctattatcgccccatcgtcacgaatatgtcgccaattcggagcattcttgttcgttatgtagtccacaactccattctcatatattgtagcaatgtcgccttgagtgtacagatttggagcatcttggggggagaacaaggtgaagcgtttccgtccatgtataggtatgtacaagttgtccgcatggtcatgatgaagaccagaagaagtaccattcggaacacaatttccaactcctagatcagttttcagtggatccagtgccaaaggagtaggcctggcggctccaagccagagattaacttgctgaatagcaagtttatcaaggaaactaggagaagatggaaggatcgaggaagaaagattacaaagagggggctgtataaatagtctgggtttttccaaatcgtccaaatcgtccaaatcttcgaaatcgtcatggaaactagtactcaaactgactagggaacatgtttcggtatcagagttatcatcgaatccttctgtccctgaattctcaatgtttccctcttcttcttcttcttcctcttcttttctctcatcattctcgtcctctcccccatattgtgtggtcaaatacaaatctcccttaccggtcctcaaattttccattaactcttcaaatcgcatttgcagtctctgcacattagatccaaaccccccattaatcttttgctcaacttcaagcgcttcgccgtagtctaaaagctcgttaagcaaatgaggttgaaaaatgttgagattcagacctggcatcactccatcaatcaagcaaggttttcgttgactgacaaaacgagagaacatcaaattccagtccaattcatcaacgtctatgatttctatagagcttgaagcagatacggtgtatccttcataagatacatgaatctgcttagctagctttttagggcctttaacctttctggcctttcttttggtcatagtcttgaagcaaaaatatcaagtccaaaaaaaaaaaattcatataaaaaacattatctgggtgtgacttttttcaactagattcggctcggagaggaaacttgtatttgaacgatagtcagacggatctcggaagggatataaaagtggaaacgaatagtagcctttgccgtctattcttctctattcataacaagatactactcacgtggtgttattttcgtattttaggtcccctgcttgcaatttcatgagtacatattaaggctccatggaaacagttaggtgatcgttgctgtggctgcgagagattacacagtgattcgagggtaagatcgctacttttggtataaactagaaaggtagtagagagattttaagattaaaatccaattaacagaggtactggtggtatatgcatggcattaaatctcctttctctcgcagtactgggaaaagatgagttgaatcttatgaatctttgagacaacatcgtgccttgccaaaaaatcaatcacaacatagtgatgccacaaggcaatactttctcgtcttaacctccctcaatccttatggaagggagtagagtagctgacctaaagtcttggaaactgacaaatactaattaggagatggcgactttatcacggatcgcatttttttttccatggtactagttgtgcaccacgaaatgattgattagcaatttggaactgccagccctaataatgttattatcttcccccccccccccccctccgtcgcatctgaattctataactccatggtgaagtaaatgcagcaccacacttttgggaaatgcacggcacttgcgatctgcgatctttcataagctaatatctacgatatctaaactaggcgactggtcagataagtccaagagccatatggagtgatagccataggagaagtagaaaagacttttggtaggttgtcaacctcgtctgtatagttcagtcggaatcttgttgaaaataaaatatgtgatcgaatgcaccaaggtgcatctggtctctaaagctactcactatcccctataatcaagattcaaggagagattgaaaattagtggcactactccaatcaactcgatccataccataccagctttggactagttatatatacttaaagacagcccacttcgtagtgagcggaatcgagtgtattttgaccactaccagataaagaaggtttcactgccgctcttttgcatcattcccagtgattccaattttaaaagtttctcccaccagaactggtatagctccattttgtccatcctttcacattcattagcctttagagttgaaacactttttcaaacttggacatttagacaaaagaccaatcagtagcatcattcaatttttattcgcatcccttttctgactctcattgatatttactcaccatcaccactgtttgctcctcatatactaaaactacatgtcgctttcacctgatgcttaccatggcttacgccaacgtcaagcgtctttgcgagcgcaatgtcctcaactcaaaatgatggaacttcgggcacatactaatactgttgctgactaccaccacactattttactacaccacttgaaactggagcagactacaagacctcagccacagtctatcgctatgcaacctgaaatcaggttacggatgagaccaatgcttttggatcatcttgtcgacatattcttacaattcaagctcagttatgtcacatttttcttgacagttaacttacttgatcgctacacatccctgcgagtggtcagaaagcaacactaccagctattgggactgacgtgcctgtggatagcagcaaagtactcagagaagaagacacgcgtacctacggttcatgatcttaccaggttgtgtttgaatacatactccaaaaccttgttcttggagatggaatctcatattttgaaaagcttagattggaacattgggttcagcactcataacgtttttcttgatcttgtacttcaagaacaacctgatatagtctccaatacaccccacaatttgcacgatctcaaaatgggtgctatctatttatgtgagttagctcaattccatccgagaatctgttttcattactctgcgagtgccattgctgttgctgctcttgctttagtggtagatgctattggtatagcgccactggttggtggtcctctggtagcacgattagatgctgatcttccccatcatttgctggctcttgtcgcatgcccgccaccaagtttgcgagtgaagtatgcttccccgggttatgctatcaatgctcttcattgccatcaccaggttcagacattagttccttcacctcgatcttctcctgtttctgttagatccagttttaccccgtatgcgtctccggtttcatctgttgcctcctctgcaggcaccatttcaccgtaccactatgacatagcacttgaggaaaagaagaggcagtctgcggattcggaatattttcggtctgaacagaaaaaaatgcgacaattctagttcagtaacttgaacacagacgaagtgggttgctgacgcacagtagacacaagcattgcatttattatatatatatacggaaatgaattgtcatctataaactttcaccgctttccgcacttggcagcgttgaaatgtaaaatatcaccatcttcaatcaagtatgtttttccaactcggtgtagcaagcccttcgaacggagtgatttttcattcaagggtgggctgagagacttcaaaacatcatacttgatcactgtagcgttgataaaagttcggctaagatcagtgtgaatcactccagcagcatctggagcaggggtattttcacggacagtccattgacgagattcaatatctccacaggtatagaagctaatcaagtgtaagcattttcgcatttcatcaactataggtggaatacatgattccgttgtataactcgaagagtctagggccaatgagttctcgtactgagccgaaactaataccacactacttccaggtgagtgttcatcaacccagtattcaacatccttgctaaaatcattatatctttttttatagtctgtttctgaaacgttcaacaaatacacacttggcttagctgttagcaagttgtgcttgttcaatatattcatctgtgaagtattccaattagcgtcgattctactaagaagtttgccttcgagtaaccaggcacttgctttgttcaatgtgtctgactcttcttcgaggagttggatctctgccaaacctctctggtgtcgatgacggagttgctttttggtgcgctccaaagcagactctacaaactccatatcttttagtaagagctcatcttctacaaccataaggtctcgcacaggatccacgtttccctcgacatgagttacgtccgagtctctaaaccctctgaccacctgaaatagaccatcaacttgacgaatatcacctaggaattggtttccaagaccctctcctcgtgatgctcctcggacgagtccagcgatgtcaacaacctttaaataagcaggaatttttttcaagctgccgtaaaggtgttgaaggtgatccaactttggtgatgttacctccaccctcgcttcctctggagaaattgttgcgaagggataattagctgggttcccaagtttcgactttgtgatggcttgaaaaaaggtagattttcccacgttagccagaccgacgattccaccgctgagattgtttgaggcccttcccagaagaggttgttttcccctttttatagaatattgccttcgtaaaatcattaataactatttactctaaaaaatggttttagcagggttttcaggattctagttttcttccctctacatttgaaagaaaaaaatgaaaataaaaaaaaaatactggcaggataattgcaagtctcaaagaaaaacgactcaagaagatgattttccatcgtctaccgcttctttttcctcttgctcaactatacaagactcccttatctctgatctatctcttaaagagttgtaatgctcacctaggccatatgcatgacggtaataaaccaacttcaactcctctttagaaccgtcggcattgacaagatgaataggtcttccactaatcattacactgattggacaatcaaactctttgctcaatgccaaaatttccatatcacctccccataaagccgtggtttccagctcgtttgcatagtcatcaatgtccctgattttcatagtattctcatcaaaaaggaaaggagtataagtctcgggatcatttttaatatgactcgcagccagagaccgaagatcttgtatacttatattttcaattttgtgccgaacctccaactgatcttttatagatgcaaacaagcaatgcccatcaggtcggatatcatatggttccaggtgagcaacttggcacagttggcttatgttgttcaattctatctctttgaaatttgtttggaggttagcctcttttgctgctgctgcttgcatctctttaatggcaacttcccttctagctaatctgtccttctgcctattgcgttttctctttggaacagttgcgtttccttgattctcacttggagttccttgctgttttaaagtcatcattgataataacttttcaggggaaaaaagttctccaccatttgatttttcgtcagtaggctcactacttctctcgacggaattttcagtcttgcactcacctaactccttcttatgtcttgcctgtagctcttcttccaagagagagcattgtttcatgatttcctttttggttgacttagtgctctgcttcttcatccttgtaataagtgcaatttggtcccttttctccttcctatgcctggcgatgatatcttcggttgacattgtcattttacttgaagacaagaagtgctacacgaattttgaggttcatttaaatagttcttagcgaaaactctcaagtccgttaaagcgcttatagataggcagttttcaacctgaagaagaaaccataattgatatgtctgaccaaaatgatttcaagaaatataaatacgaggaaatgtcgaataaggtgactcatgtggatcgaagattcctgaatgaaactggatcgcataacaacgaaataagttctgtccctgaaaccatcaaaggaagaatctcgtatcgagatattggttcgaaagtttcaagagaaagtatttctgagaaggaaaggacccaaattcaaagaggagacttagagttgagtgaatcttcttcgtttttcctttcttcggatgttaacgaagggcgacgtttggtacaaactacggactttgagtctttatcttactatccaagaacagaacagactagagagtcttatatgaaaatcttaacatggacgtcgaagtactttgacagtgacatttcagaagacatactgagatcgggggttgacttgatgcttgaaattttgcatactgatctagatggcaagaagaatagatgcgaagaaatcttggatcgacccatatctaaagacgatttttatgaattgtcaaaactaagtgagcagttgactgactactccaaagaaacagaggaaaatgaaatcaataacaatggcggtgttgctattgaactggacgataatgatggtaactttaaagaaaattataataacgagcttaaaattgccactgatgagaacggtcagcaatacgacaatttgagtgatagtgatgctacacagttgaaagagtctagttcttacttcacagatggttttgttgaagcccaaattatcaaacccgaaagaaatctagcaaacaacgatcttttgatcccagagtttcataaaattgaccagttttggttaaggaatcaagtcgccaaattatatccatctgcacagtcacacgagcatacgacgatgacccaatcattgattggattgatgaagcgtttcatgcaggaaaatatatcatcaaggagttttgtatcagaattacttcagctcttggggcaaagtaacttaaagtttgttcacgagatggttcagaattctccatacatatactatagcatgcagctgaataatgcatcagaggaggatgtgccaaagatattgaatgaggtaagtaacagaaaacttgaatttttggttgcccagtataatgaatatactcaaaagttttacagtcctgcttctaaaaagagaagacttgaatctttacccgaaaaactaacaactgattttactcaaagagagcctaggctgatagatcttcagacactggtatttgatcagggttcgcacttaatgacaacaaataaagtcaaccttcctaatgggtcattcaaaagagtgaaaaaatcttacgaagagtttcatattcctgctcctgaacctcccacaatgggctcagatgaaagacttgtttctatttctgagctacctaattgggctcagcaggcatttccaaactctgagaccttaactttgaatagaattcaatcaaaagtttacccaattgcttttaaagaagatgagaacatattactgtgtgctcctactggttcgggaaaaactaatgttgctttattgacaattttacgaaccatatcaaagtttagaaatcaagacactggaacgcttgcattgaacaagtttaaaattgtttatattgcaccattaaaagctctagtccaagaacaagttagggaatttcagagaagatttgattcgtttggaatcaaagttggcgagttaactggagactccaatttaacaaaacatcaaattaagtctactcaaattctggttacaacgcctgaaaagtgggatatcattacaagaaagatgtcagatatttcgtatgtacgtttagtgcggctactaattattgatgaaatccacttgctgcatgatgaaagaggtcctgtaatcgaaagcatagtttcaagatcaattcgtaatgacgagatatcaggaaatgaaccagtaagattggttggtctttccgccactttgcccaactttaatgatgtcgccacttttttgagagttgatgaaagcaaaggtttattctactttgatgggtcttaccgcccctgccccctggctcagcaatttgtgggtattctagaaaaaaaggcgttgaagcgatatcaagcgatgaaccaggcttgccttgataaggtgatagataatcttcaaggggatcaccaaattattgtttttgtgcactcaagggtagacacagctaaaacggcaagatatctaatggaaaatttaagtgcgtgcaataagttagaccttctccaaaaaacagatctcggctcaaaagaaattctcagggaagaatcaaagtcttttagcagtgaagatctgagaaatctagttgtctcaggaatcggcattcatcatgccggattgaacaagcaagatcgttctttggtagaagatttatttgcagatggatatgttcaggttttagtttccacggcgacgttagcttggggtgtgaatcttcctgctcatactgttataattaaggggacatctgtttattcccctgagaagggagtttggtctcagcttgctcctcaagacattcttcaaatgcttggaagagccggcaggcctcgttacgataagactggtgaaggaataataataacagtccaggaagaagttcaatactacttggcaattttaaaccaacagctaccgattgaatcccaactcatgagtaagatacatgattgcttaaattctgagatcgtcttaggaacagtaacctcacgacaggaagcggtttcgtggttttcttactcttacctatttgttcgtatgcttcgatctcctgcgttgtatcatgtgggccctgaatacagtcaagacaaaactctgctggaaatgagattggacatatgtcattcggctctcacccagctgcaaaagaatggattgatatcatttgaccctttatccggaaaagtctggcccaattacttagggagaatctcatcctacttctatattgaccacagtaccatatctcttttcaacaagtttctaaaaccatattctactgatattgatctactaagaatattcagtcaatcttctgaatttagatttattcctgtgagattagatgaaaaactggagctgaaaaggattttacaaagcatccccattcctgtgaaggatacagcagagaatccactcactaaggtcaatattttattacagtgttatatatctcatttgaaactggaaggttttgcaatagttcaggatatgatctatatcacccagtctgcttccagaattcttagagctattcacgaaatagctctaaagaagaggtgggctacagtttcaaagtattctttggagttgtataaaatggtcaacaaacgaatgtggctttcaagctctcccttccgccagtttcctaatgttcatccagagataattagaaaaagcgaaagctctgttcttccttggagctattacctgggattgactgaatcttctgaaatggcacaggctattcgaagcgaaaagcttgggcttgcaactttaaagctggtcaaacagtttccaaagttgactatgaatgccaattttcaaccaattacccattcattgatgcgaattgaagtggtcatctatcccgaatgggaatggaatgtctccttacatgggtttgcagaatcgtttttgctacttgttgaggattgcaatggcgaaaggattcttttttgtgacacaatagtgataaagaaacaatacatcaaagaggagcatatcgttgaatttactgttccaatcctggagccctcagaacccaattattttattactctagtttctgaaaattggcttcaatgtgaatataagattcccttaatgttgacacacttgaaacgtccaaagaaatatcgaccccccacgccactagaagaagtgcctttgattcctgttcacaacttaaatttacctgagtgcaggactgtctttgatttcgaatttttcaataagtttcaaactcgagtattcaattcagtttttgagaccgacgcaagtgcccttatttgtgccaataaggggtgcggaaaaactgtaattgctgagctagcccttcttcgactttggtgctctggtaacggaagagccatatatgtttcaccctgtgacgcaacaattgctaagatttataaaatctggaggaggaagttcaagtctgttgccggcggaaaggtcatcaaagtgcttactggtgaattaaactccgatctaaaattgttgtccatttcggatgtaatattggcaacaccggcgcatttagaccaactttgccgacgatggaagaatagaagtgttgttcaatcaattgaactagtagttgccgatgattgccatactgttgggaatggctataatggattcatttacgaagttgccttatccaggattcgaataatggcaatccagttatccaaacctattcgaattgtaggtctgagcaacccccttgctagggctgacgactttggaagttggttaggagtagagatagatcacaactacaattttgactcgaaggaaaggattgcacctttggagatagagataaaatcctcagatattaaagagaaccattcgatgattcttgcaatgctgaagattggatttcaggccatttcggacaagtttggtagctctgttgtctttctacccgatacagaactttgtttcgaagtcggtcaagagcttttgacattatttagaaagcgaaattacaatggaagctctcagaagtttcaacccccagttgactcaaaacacttggctggcatccgagatgtaaggctaaagcacttaatctctcaaggcattgggattttatatcaagggatagctggcaatgatcagaatacgatagagaacttgtatgaattaggctgtttgaaagttatcatatgctctcgagacgttgtctcattggcgccaccttgtgactttgcatgcgttatgggtactcaattttatgaagggagagaacacagatacatcgactattcaatatcagatatactcgaaatggtcggtgtctcgtctttgcaagccctgattgttactaattctggaaaattggattactatacaaaatttctcagtgaacccctaccagtggagagccacctttccctcttcctaactgatgcgtttgtcaatgaaataagctgtcaggtggttagaaacagacaagattgtattgattggcttacctatacgttcttttacagacgattacagttaaatccgtcgtactatggtgtgaccgatgtttctagtgtaggcttatctgagtatttatcagaactggtggaaactacggtgaatgaattaactgaatctcagatgattgagtttcaagaagtagatgatgatgaaattaaggatgttgttgagattgtaccactaacggcaacaatgattgcctcctactacaatgtctgtttctctactatgcaaacattcatcctatcactttcaccgaaaacgaaattgaaagggatgttggagattgtggcatctgccgcagagtttgattcaataccagttagaaaacatgaagagggtatcctgaaccggctttacgatcaagtcccaatcaagtgtagtactggtgcaagcattgagtcccctcgagtaaaagccctaattttaatacaagcgcacttttcaaggactaaattgactcctgagctgcattatgatcaacaatttgtgctcagaaaaatgttaaacttggtatatacttgtgtggacattttatcgggggaaggacacttgaatgccataacagctatggacctctctcagatggtagtccaggggatttggaagaatgaaagtcccctgaagcagataccatttttcgataacgccgctttattgcgccgttgccaagaggcgagagtggaaactatatttgatatcatgtccatggaagacgatgagcgagacaatttgttgaagctatccaatgcgcagctccagaaagtagctgaattcgtgaacaaattccccaatgttgatattgattacgagttggatatcactgaaggtactataatagttgacgaggagagagaaataatagttacacttaccagagatgaacaacctgaggatctcactgttatttcttcggtatatccctatacaaaaacagagaactggtggctcgttattggttgctcccattcaaaagagctttatggtatcaaacgtacaagaatttctaaacagcaagagcaagttaaagttactttctcggttccttccccaggatcccacgagataacactctggtgcatgtgtgattcttatatggatgcagataaggaagtaagcttcgagcttagagtggaagataatcaaatccgtatatgaataaggattgccaatacttttatttttcgctctatttatttaattcatgaaaattcgtaaattgaacccagctatttcagtagatatatatgaataatttgccggcaaagttttgcgttcgctgcgtgagttcaacttgagaatcttggaactagctgcaaactaaaaatcctggttcagaaaaaaataatgcgtatgcccggagtcgaaccgggggcccgacgatggcaacgtcgaattttaccgctaaactacatacgctttttgtatacaaaagttcgttcagtatatatcatatattcataacatattagccaatttccctgaaacaggaaaatgagtgaaaaggcaatactgcggtttattcggtatttgtgccgctgctaaagcttttgagtgtctcatcccgacccgaaggcgataacataccaagaaagataattcaaacacgcgaacgtgctccttatttgacaaggtgcaacttgttattcttctgatgatgatctcccttacgaaaaggtttaccaagttggcaatctttggaagtttatctttcatacttactacagcaggattatggctgtactgggatgccatccagtatatgatgacatctggcaaaattccaactttagactttcaattcgaagactttatgaatagacatgatgatattgttgatgatatgatgaagaaatatgacaaaatcatgaaagcggaggtcaaagaacctaatgttggcaatttggtttatgcaccagaaagtctggttgattatggacgtgagaatgccacattgctaatgttggttagaaacaaagaactcaggactgctctacaggcaattgaaacggtggaaagccaatttaatcacaaatttcagtatccatacgtttttttgaatgataaagaatttactgacaagttcaaaagcaccataactgaaaaagtttcagggcaagtattctttgaaacgattgacaaagtaacctgggacagacctgactggatagattctgccaaggagtcagagagaattaaggtcatgagaaaatacaatgttggctacgctgataagttgtcctaccataacatgtgtcgatactatagtcggggtttttataaccatcctaggttgcaacaattcaaatactactggagatttgaacctggcacacattatcatacttccatcgattatgatgtattcaaatttatgtcagcaaatgataagacgtatgggtttgttattagtttgtacgatacagaacgatcgatcgagacattatggcctgagacattgaagtttattgaacagaatcctcaatttgtcaacaaaaacgctgcttgggactggttaacagaaaagaaacaaaatcctcaaaaaactagaattgcgaatggctactctacctgtcatttctggtccaacttcgaaataggcgatatggacttttttcgaagtgaagcgtacaccaaatgggtgaaccacctcgatgcaacaggaggattctattacgaaagatggggagatgcaccagtgcattcaataggggcgactctatttcaagacaaatccaaagttcactggttccgagatatcggttattaccatgctccctattatcaatgtcccaatagccctcagtcggatggaaaatgcgaggttggcaaattcagtttcccaaacctcagtgatcaaaattgtctgatcaattggattgaaatggtagcggacaatgaactaagcatgtattaagacgaacacggaggtgctttctcaatcatttagtattgttcagcttgatatttacagaagttactaataccacgtgacaatacgagaaattgccaggcaattcttggttttcttctcaccttttagttcaagtaaactactattctccttatgtcccctgcaatcaacatcgccattatcggagcaggtattgtcggttctgcgttcattaatcagttgaggagcgtatcgtctttgttcgactttaacgttatttatttggctaaaagcaaaagtgccttgatctcttatgatttcaaaccgttgaatctagccaattggaaagcagacttggacaatagctcattaaatcccttgacggtggaagaacttttgaaattcttgaaaaattcacctttaccagcaattttagttgataacacttctagtgctgacgttgcgtttgcgtacccccaatttgtctctaacggtatttcagttgcaactcctaacaagaaagcattttccggggacctaaatttatggagtgaaatattcaaagcttctggagaacccaatggtgggctagtatatcacgaggctactgtcggagccggtttgccggttattagtactatcaatgatctggtcaacactggagataagattgaaaagattgaaggaattttttccggatctctatcctatatcttcaatcgcttctctactacaaagccaaatgatattaagttttctgaaattgtgtccaaagccaaggagctgggttacactgagccagaccctagagacgacctctccgggttggatgttgctagaaaagtcaccattttagccaggttatctggctttaatgtgaaatctcctgattcattccctgttgactctttagttccccaggagcttgaaactttggagacgagcgatgaatttctttcaagattgcatgagtttgactcccaagtggggcacctaaaggaacaagctgcttccgagggcaaggtattgcgttttgttggaactgtagacttccccaacaacaaggtctcagttggttttggaaagtatgacgcttcgcacccctttgcttctcttcaagggtcggataacgtcatctctatcaaaacagagagataccagaaccctttgattattcagggtgcaggtgcaggtgccgaagtaactgctgctggtgtgttagccgatgttattaagattgggcaacggatttctaagttgtaagtttatacctacacaattatttttctatcaaatagttcctaaaatgttaccttgtgtctcgatgtcttcattcaaattaacgaattgccgttgtacattcttttccttataatagtcaactagtgggatcatatcaatatacttctctaatctctcttcgagccacgaaatcaccttagaagaaggttcaataaggggtttcagataacccttagcaagtgcgaaaccagaaagtagccctaagaggtgtccaatgaagcttgatcctgggaagatcagagctgacgccaccagtaatataaacggtgttgcgatggtaggaatctcataatcttgtactttgaaagtgggataactgagactctgcaaataagaataataaccaaagaatgaaaagcaccaagcagatgctcctactacactaactttggggaaaaataccattcctaaaacacagtaaggcaatgcagtaacaactgccaaaacgttgaggaccactcctgtatgaactgtaccattcgatctttcatataacgacagtggagagatcaaagcaaaaatgttgaagaaaaggtggaggaaggatgagtgaaccaaagggtatagtgatatcttgttaagattcaaatgatagagagcccaaggatcaagtgccaaacttgatctcaaagaagtgaaaactccaacgatataaaaagatatcaaaaatataacgaggccggaaacaagggctggtgggtatttacctcccaagtgaaacagctcagaaaacttggagaggagaacgggatatgaaagagacatcgagtggttacttgaaatgggagcttttgttgttaatattttctttgaccaacatagcgatgtggttatgtaatcattggtcatgtagatacttcaagtgtactttaaagtttatacttaagtatcaaacatacgccctaagattacgcactaaattcaaaaatttaccttgaagtctgaaggacttcagtttgcctttcataataaagcctttgagtggcgacaaacatctatcgcttattcttcaaaaagatgattctgcccaggttcgaactggagaccccctgcgtgtgaagcaggtatcataccactagaccacagaaccatgttgttactgttgaagcaagatttatttaagttacaagatggacaagttatattcctgaactaattttgtagcttgcggcatttattgttggatagcgctcatgtaacaaagtagatagaaattaaatagaaaaaagtgttcatgagattgctaacaaaaattgccatactttcagtatgttccttatgtaagaatgcctataacgaggttcttccacttaacatatcactgatttctcgtacgttactccaaaaaatattttttctcatacgccttggtacatcagactcaaaatcgtataattgtcgaattggagtgaatctcagttgggacttgtgaataccaaggacaacagccgtggaagtgatctcatctgtttgtcggaaactaatcgaatttttgaaagcttgacatttatcagagtgcttctcaataaaagagacagcacgaattgcaaatctagaggccctcacacgatccatcggagaaggaataccaccctgctgaacatgccccggaatagctgtttttgagtcaaatctgccactagcttcatcatctatgatagtggagattacttccgtagtgagtaccttcgatgcattctccgacttcaaaatcagtctgcctgattttgtctttccttggtcattggcaaaggactctttcaaagaattgatatccatttcaagctgagccagcgaaataccttcctcagggacgtaagaaatctgagcaccacaagcgagttgcgcatgggttgcaatgtatcctgaatttccaccctggacctcaacaacaaacactctgtttctagttgcagctgcagattgcttgattacatcacagtattccataaaagagttaagacacgtatctgaacccaaggaatattcggttccaggcacattgttagaaatggtagcaggaataagaaccaagggtattcttagagacggataattgattcgggccctttccaattgatgaagtgagataaaagcttcaaatccaccaacaagaatcaggccatcaaaaccatacttttcaaagaagtaggcaatcatcccaatatcggcatcatttggaagagttctgttggttcctatctctgagccacctagagaaccccaaccttcaatgtccaaccagtttatagatctaacagattcatgacgagccaaaccactgaacccgttgtggatagcatatggaacatgccctctggacatgcaataggtggccatactgtaaaccgcactgttcattcctcccgctggagctccaacgtttatgattgcaactttctttcgcttttctagaggtaaagaaggaggaacatgatccgcggagttagttgagataaagttcttcatgtgttcgacaaactcagaatctcgcaatgaaatagccctcttaaagttacgagattcgatggactttgcaacttgctgtgtaagctccacagcgtcaacaagaggaactctcgtaatttgatcttccttaatagcaatcatgggtgacggcgtgtccgcattgcattccaaaacagcattaacggcttcgaccccttgcaaagtagcgtatattctgtcaaaagcaaccgcagtaccgcccctttgtacgtgaccaagagtggtaactctggtatcaagccctaatctattgaccagaacgtccttgacttgatcgcaggaaattggactcaaatcattgctgatagcaccttcagcaacaataacaatggtctttcgtttccccttgccctatgtttgctgactatgtcacacatttgatcttgccactctcttgaagatgcaggtttctctgggatcaagatgtagtctgcacttgtcgctagaccagccaaaagacctaaccaaccacaatggcggcccatgacttcaacgatgaaggctcgagaatgagaattggcggtagcatcaatgtagtcaatagcccggcagattctatccaaagaggagaaggctccgatcgtggcatctgttgatgacatatcattgtcgatagagccgacggctccgcatatattcaaattttgataagtttcaaactgttgctgggagattcgttcagtttgcaataactcttcaatcaaacttggccattctgaacgaaatcggtccgcacctgttagcgaaccatcacccccacaaacgattagcgcatcaatacccatatcaatcatattcttgcaagctttaagtcggccagagcgttctctgaattctttgcacctagcagttcctatattggttccgccttctacaagccatccacgaacgtcgtgccattgcgtctccttgatgtatttttcacccccacgtacaagtccctcatatccttcgtgaatacaaaatactttgcaacccttgtagattcctgcccgaaccaccgctctaacgaaagggttcatccctggagagtcacctccggatgtcataactccgatggttttacggatgggagtgaaaagcttttctgagtcatcttcagtacggtaagctttctcttcggaaacctttggaagcaaagaacgttcgttgacagcaaatggattcttgaatccgctgaaacctatcaatgagcctaggggatctaacgtgtaaacttcaaaaggtgaaatctcattaggactttgctgtacaggatggcctccatccttcagcaacttgacgagcttacttagtgaagagctcttgaacgcaatattagactgaattgatctccagtctttccggtataacgatctggtcaaattgcgaatattctgatcaatctgagacacggaagcagcatgttctggatctagaagcaattgaattgaaacattatttgaatcttcttcaagctgtaaccaaactaacttctgatttgaggtctccttaatagcaaaccccaagcgatctgtgtagaaatcaatggaggcctggaataaggagatgttgggcgcaaataacgttataaacgaagttccgttaaagagtgaagcgtctggcatctttaacaaaagcttgagatgttatttacctttgtaaatcttgaaatggaatataactaggaaaggttgataagttggagggagccgtaattaaaagctgtcagatattcgcagcagggtaaaaaattgattacataagcacacttatggttcgattatggattatggaggtccgatatccgatacggacatcggaatttgtgcataatggacacatattcaccgccaaagaaagacagactgttttttcacttattgatagcatggaagaataatcaaaaaagaaaatatcaagtattaccacatctagaatcaagcccagatctcacataagctactttgagggccattctatttttcttttgttctcggagtcgccttgttataagaagcctaggtcaatgtgaaaaccactgaaagtcttataagtttatactttactaatccgatattcatattgagcaacgatccatctcccagaacatttgtttcattgcgagacttatacacatcttcaagaaccagactgagagaggagagttgcaggcgcgcaaattcgtagtattagtcgcgctgcaggaacatattaaccatagattggtgaggctgacaatcacattcaatagccataaactcaaattttccccagggtgcccttatctcataaaagccaataagccggccacctaacagttcaggatgtaattttgcctgtaagaaaagatctaaattgatctctcgaatacctttcagcatgtaatggtctttgatgaagtacagtgtatcggagatccgtaaatcacatcttttgaattgttggagatactgattgatatacatttcatctgaactttgaaacattcgaatagaatggaacactttaggggcatacgatacgctttggatgaattgtgaatttcgaatcacttttctttcaaagaaatcctttagcattagatgttgatcataataatcgtttgtaacttgagtggtgctagaatcattttgagtatccatccttatggcatgaagtagtatgtccaaaagcttctgctctttcaagtactgagagtagttttgaaagttagtgatgtagatcattgttcattgaaaagaacaaactaggtacgagtttgtgtcactataacaatcttggaaactgtgcatgcttatacatgagtgcttattaacaatcaactatccgcgtagaatggccactctctcaataaatcaacaaaatgtggaccgaaacgatctatcccataataacactgtggataaagcttagtaacataaggtttcttgttattaaatatgtcttctttagttgagcatcatgcacggctagcgtcgagacacatgataataatgcagaacttaaaaaagtgttcatacaaatctaaggtcatctagaattacaggcaaatcaactaaaaaaggtcgtccaaatagatcactttcgcccacttgtaaataaggtctccaggttcatctcttgattgggagtaagttttacatttggtgcatatcgtgcttcactgtggaggagctgcaggggagcaacgctcgaaatcaccaaaacaatttttcttctgaaacaagtttataccacaagatacactcttgatttggaggcccatactaggaagagcaccaaccggaatgacaaatgagcgaaggtcagaatctttatttgataccaagtttgtaagcgacaagccaagatgtagcgagagtgaagacactaacgagcaatcagtagcccatctggtggatcacctgatggaacctggattggttcgtgaaggtggatcagcactggtggagaacggacagtcatcattggagtcacttgtgatcggatcgcagatggtggatcgcattgtggagtccgctgatccatccaccaacgatgtgcatgagttgttgccccttcaaaaggatgttagcaacactctcataacccaccgattcttggtatctaaacgggaggctggaacgatcattggtaaagaaggtagctgcattacgagtatcagaatgggttgtgatgtcaaggcaggtgtgtcagagttagtgagaggttgtgtagacaggatattgactataagcgggtcagtcgagaatgttggccgagcagttggaaggcttgctcaagtacttgtcgatacggcagctttttcacaattggattttgctccttctggaggaacctcagtaatgggagtaacaagaatacgccttctgattccgaatacacagatgggcgcgctaataggaaaacggggaattcgtatccgagccttacaacagtatcactcggttaaaatggttgcatcaaaagatcctttggccaactccacagaaagggtggttgaagtgcaaggtactccgcttgctatcgaaagcgctgcagtgacaatttccaaatgtctcctggaggattttatgttgcccgctgcagatacgatctactatgtgagtgctccccctgcaggatacggtggtgcggctcgtgcaactactggtgacagctttctgaacagtgattctctgggcccaacctcaacggagacggtctactttcccggggaactagttggtgctattataggtaaacggggagtccgtatacaagagatccgtaagttatcagggtgtgctatttccattgattccgcaaatactactggaggggagcgacgatttgtattgacaggccctgtacggaacgtcgatagggctctagcgatgctcacgggtcttgtagagagggagaaaagtcgcaccaaagagcattagactgaattacaatttaaaggccatccacctacatcatagatcctaaaaaggaaaaaaaagttctaatagagtaatttatgtaagaacaatagaagccggataaaacagctaggagagttcgtagagcggaggaaatttccatttcagaggtgaattatcccaataattaatatcctgaactaactctgcaatcagtcttaggtgttcatcaagctgaaagagattagtatcttgatcatttgaagaaacactcggaattaggtccaacaaagtagctagttccgacctttttcgttgccaatggctctcgatccttataatatctttctctcgttgagtgtcaaactctcgctggtccttaatagtattgaacttgtactttcgttgaatatactcccccttcggttttgaaagcatcctggcacgctgcaggagcttggcataattgtcggcagcatctacggattgattaagggacgcagtcagttgttcatcatcttctgtggcatcatcatcgtaatcagagatatccccttcctcatttccacttaccttcaacgaagatctcgaaaaagcattgtgtagttgacccttctcctttctaggaattacggaacatacatatcgtgaaaaaaaaagtttgctgtagttgtggaagtcgatagaatctaggcaatcgtacttaactttactcctctttgcactcgctataagtttttccccaagctcacgaatacgatcttcattttcttcggaaacaagaatcgggttaacgttcatattaagaaacgaattagtacttgcaaccatgctagaattgctcattaaggatggagctaacgatggcgattcttcggactcctcaaatgaaacaagtgactccgcgaccgacatacgacgcactttgggtgggagtggaggtaatgcaggtagagaaagccacttgttgatggacttgtaacaatttttcaacaatatatggatgactttgtcaggttcaatggacgagtgatcgtcttgatagcaaaacaaccatttatcgcttggcaacggaagggtcgaatttggtgaatattgtgtcttgattggatgcttatttgggtacgctacaacatcaatatagcaaagcgtgaagcccgactttaagtacaaccctgtttcctcgagaattatatccacctcaacgagtttattatcattcaaatcgtaactcaacccatgtgacataagactttccttagatttgggggctatagcaaaattccctaggtccaacagagttaacttcctttggggaatcatctcgctaatgttgttaggaggatagtagaccaataactcctttccagtattatgatctaatacctggaatttaattgttcctaaacctaaagcattattgacaatcaacgcacatgttatattgtagatatcaggagaaagtcttatcgtcttcttgtagtacagtaaataggttttattgatttggagcacatgtcggtacatgtaattcatgggctcatcaacctggtaatcggagtattccacaaacaatcgtctgttcttgaacaacgagtagacgaattgccaactgtcgcgtagatgttgataatttagcaaagccaacacattagaatggttcatcttttcgttgattacggatggttcggcgtcatttaaatcattttcccaattcaagacaggtaattcatatgcgttacttattatagacctcaaatgtcctctccaataatctaaggacttcatgtagttgattatatgtcgtttgctattgaccaatgtgaccagcacaaaaggtcccatttcatccaacattttgtcaaagtatagatcgttgtgaagtataaagaatagacgacatgttggcctcaattcttggggacactccttcatgagcatcgccagtatgtccatggggaggtccgttagtaacatgccaatatgttgaaagagaactcttgacagttccgggttcactatatttatttgaacatttccacgactgtacccatgatagagtgtttcctagattcttccttccagaactttcttccacagtcaaaaggaaagggcttacgttccttcgcgaacatgtgatatgtatttaagacaatccttcgccaccctaaaagataacaatatttcgaatatacaatgtcaattcctccagagggtaagtctaataacataaattcggatcaagttggagcagacggagttgcattgatggactgcttaaaataagaacttggcagaagttttccggaaggcggcttgtttgtggaaaatataattaggaacaaccatctaacataagtttagttctgtgggcacaacgctctaacaaagatgacacttcaaagaatgttgtttatctcactattcgcatagcggatccagagaacataaaagttgatctacagccaggaagcttagaatttgatgctgactctagaggttcgaaataccacctgtctcttgagttttttgacgaggtggatgtggaaaagtcaaagtaccatacagctggttcacatttgttttttgtccttcaaaagaagaacgcatctgaagagttttggccaaggctgaccaaggaaaaggttaagttacattatctacacacagattttgaccgatgggtcgatgaggacgagcaagatggcgaagaagctgacccaaccgtacctgacccttcccaaggaatggacttcagctctttgatgaacaatgaggcactgtctcaatctctatcaagtgatgccggacaacccgatatggctgctttaatgcagcaactgcaaaactccggtgctggaggacttgggggagaaggagatcaagctcttgaccgcgctttagaggaagactcttctgatgaggaagaagaggataagcaggagtaatttgtacaaatatcatgtcaagtcagcttactgaataactacactataaacatttttatatagcttgaaggttgatatcatcacctttgtgtagaatttgtgacgctgtccatgactgaccgggcttcagtatctttagttgttcgacatagcctggctccacgcataccattctacgatacccttctttaggttcaaaatctgctacttcctttacaatttcgctccatgggttccagacaaccacgtctggcaagtttacacgcttgatattgtgcttaaccttccctaactcaattatttgaagaagtttatcggtagaaacatcgctgtagacacggtcaacctcttggtcaaatgagataattgggtgtttttcagtgtaaatttcgtggacaacacggtcattacatttctcacctggtaagttgttaatcaaagtatcttcgatatcatctaccaggaagtaggtatgaaacagccaattgaatttccattctttctgatctgtgttttgaatctctacagaggtcacaagctgctcatcctccaaagcaatggtataaatgacactgaattcattatccccgttatcccagttattgtatacttttcgattgacattatcaggagacaggccaaactgtaccgttggaggatttgcatgtgtttgtcccaaaaattcccaggtggagtttcttgcgaatccatgctgtggtaatttttcaaaaccaggagcactgcttttcccaaaaactgggaatactaaagggattcctcccctgattggttttgaaccatcaaacaaggcggcatcacttgtccacaattgttccttgcccgcaattgtccatgaataaactgtagccccaaaaagattaatgcggacttgagtctgagtggttgaggaggatgttattacaacatcattgccctttatttcgattggcattggagcaacaaggtttctaattaaatcgccaactaataattgacgaaactcatgcagaaacgactctcttaaatagaccgcgtttaggcgagaatgctcgatctggataaaaattaattaatttcctatttcaattttggccagtcaattcctgaagtaagtcagcaccataatgtgatttagaaaagcgatcttttctaagagcagttgaaagactttccagaacctcggtctcgctagttaaccccacaacatcctccataccatattcgtaaatggagtagaggccatacagtgcagcccccacgcacataataaaagcgacatagcccttcagtgtaaaccctggaggaagtgggggaggttggaggagttcaccagagagatcgagccattcacttggggtaccaaatcgcccagctgcattgcctctgaaaggaacttctccagacttgcaacaatcgatatgattggacggcaatttttctttttgtgtctgcaataaagttagaggggcttctaccaagaccaatgcaagcccctgttccaggtgccagtctaaatggcaatggaaaaaccaaacacctggattgttagctttgaaacgaaggacaacatgaccattcgtgtttactatgacagtgtctctgctcatcggaaaatcaggaaatgcatcatatgacggtgagccttcgttgtatggcgttggattttcataagcttctgagcgtcgcaccacctgaaactggtgtccatgcaggtgaaacggatgtttgttatcatcaaaattgtttaccactagttcaatgatttcattctcttgtaaaataaaagtattagtgttcgagccgtatatttgagcgttggtaacaatgtctggatcagcagagaaaacagtcatcaaagttggcactttcggagccacgtaggttacgttattgaaggtagcataattgataccatctccaaggtttgtcatttccatagtgacctgaatttggtaatcatagtcctccaacaaaggagttctatctaatgtggtcaactcaaaatcatcaaaaggttcaagatcagttaaaaactcttcagttatcaagggtgctgcatcattatagaccaagtgattgattccaaaaagagcaagatcgtctggaactacatccagcattgtctcatccaaacgttgcatcaatctgtagttccttgctgagccatctatatcttcaataccacgaaccaatacggaaatacgctgcccaaccgcaatatacaacacctgcgcctcatacggttcgacaaaaactccatcaacttccacaactgtcatgttatgtccctctagccagacgtactgactgacctccaatcccatgttgatgaatcgtaagtgatgtgaggcatttctatgcatggaaattgtaatattacgggaatcattcatcagtatgttttgtggaatgggttcagcaccggtgggattatacttatttaaaaacttatgatgcaagatatccgacttttcatgataccagtcacttaaggttatgacctcttcgaaatcgtactccagatcaggcctagaaactacgatagctccacgaagtccatctccatattgagcacctgaatgactatgataccaatacgtccctacctgatccacagtaaaattgtagagaaacgagttgcctggggatatgggacattgagttaccatttctggtccgtccataaaactagatcctctttggaacaggccgtggaaatgcaaagatgtattcgcattgccaagaccattcgtcaacaacagttcgatcctgtctccttgattcacccttagaactggtagaggccactgtccgttaagtccaatgacatctctctcaaaaacaccatctggatttgctttcacccaagaagctgtcaaattgaacttgtgagtctttgctaccgtcaatctaattagcaatgctattattggaatgattctccataaaatcatcataaattcttttttctgttcgaaacggattgtaacaaaggtagaggagagattagaatattccacttctgatagaaatatgatatcgagtaacacactactaactttttactacacaagcaaaatttaaaagccttaacattgtgtcaggcaacgttctgttggcgcatatgctatataaactcgtgaaatgatgaaaaatcggtgccaccagatattctagcaaagtttgtgtttttgagatggattcatgaaaggagtcatagatgttatgttatctccattaaattgaactacacctttatgcacgtgacttttgggacgttttttttttacagcgtttcgagctgcatctagaacatatcaggtgaacgaacacttctgactgtccaccctgaataaaatggatcaaaagaaattcgtctacgtgaattatctacctcgtgtatggcgagtgattaattcactgaaatagcttcactttcaaatttctctcaagaggtatttatacgggtctgtgtttcaataacatccacagttcaaatttgtgacaattccaaaagtagaaaacagaaagcttaaattatgcatctttaatgcctgccagccaataatatccgtcactcattctttattgttctgtgaaacccatccactttctacttgccatccgattagcttagctctgggcatacttgtacgtgatttttccatttggtacgaaagcccacgaaccacacgactgtacttgacttttggggtcgttaatgtgcacagcccagagatgatctgataattaatatcatttcgcaccactgtttaaaaaattcgataatttgttactaaaatgctatttttgatgcaatgcgtgcatgttcatgcaccagtagataataatcttaaatttacaatatagaagctagtttcttaaagttttattggcttatgtgttttagggagaaaagtttcagagctatataaactcgatccttccttccacaaatctcgccttcaagtcatttctcgaacttccttccaatagcagtgccactcaacgttcagtggtcgttgtagttcttttcaaaatggtgaatgtttttaatgtcgaaatcttctttgttgtttttagagaaaccttagaggcagtaattgtcgtgtctgtgcttcttgcatttattaagcaaggtctctccgaagatgagacagtttataaacgacttcgaaaacagatttggattggtgctatttcaggtttcctgatttgtttaatcttgggttgtgccttcattggagctttctattctttaggaaaggatgtttgggctaaatcagaggatctttgggaaggcatattttgcgtaattgcaactgtaatgatttcacttatgggtattccaatgctgagaattaacaaaatgcagactaaatggaggttgaagcttgctcgtgctctggtggtttccaaaaacgaaaagaaaggtcgttttgcttttggtcattggacaaagaaatacgctatgttccttttgccttttgtaacaacattaagagaggggttagaagctgttgtgttcataggtggtgttggcctgggatctccagctacatcttttcccatccctgtgattgttggtcttattgctggtatttctgtcggtgtgcttttgtactattcaggatcaactctttctttgcaagttttcttatgtatatcgacggctattttgtacttgattgctgctgggttgttttctagggctatctggttctttgaaacctacaaatacaaccaaaagactggaggagatgcttctgaaaatggttcgggacccggtacttatgacattaagacttctgtttggcatgtgaactgctgtaaccctgaaactgataatggttgggatatttttaacgcgttgttgggatggcaaaactctgccacttatggctcagtcataggctacaacatatactggctggcggtaatgatcactttgtatttactctggttcgaagaaaagaataaccacttgccatttatgaaaaatctgaagttgagacaactgaacccattatactggatgaagggtaaaaacaagaaggaggtctccaaggaagatcaggaaaaattatttgagcaattgaagagtaaggagtttgccaataaacttgcggaggaataattagattgacctagctgaatcttgttagcaactgtatgcacacacacacacacacacacacacacacatacaaggactaacagaggatgatacgtttttcagtcacaaacacatacacatgcacatgtaccctaacaagaacaagacattttgcttgaattagaactcaggactgcaaaaggtttaccgcatactacgtacgcacatacaccatctaatacacacgttttgtataagcaaatgcgtagggaaagtttctagactagtcaattaattataaattgtagtatgctgttagtgatgttcgttgctttcttcaatagtgttgtggttcgattggcggacgaaaacgatctccaagatcacaagctaaacttggtcaggactattcacatatacgttaaaataaataagataataactaaaaacattcagggtaacaagctaagctaaacatcaataggtatacgtgcttcaactctgggtggaatatttctctcaaatttagaccctccaggcctacaaggggggattataggatctggatgtgcataatcttccagcaaagcttcagtttctttgaatataactttcagttcattggggtcattaatatgcttattggcgtcaaatcgtgacctgatttcagaagccttaactctgtaaaattctgtcttattaatccaatcgtgggcagttcttagtgatttgcgatatagtgacgaaacgtactttttattggcttcactaaaaggaacaacagccttcctagcaatggacgacataactttagggaggctaaaacaaatacaaccgaagtgctacctctggatgcaaaaaaagtacctaccattcgccaatatctctcgaaaaggtcgtgcacgacaacggttgttaatgaggttagttacttccgtcctatgaggatgcaactggtctaacaaaatctatcctcacagttcgtgtcctttctttcattaagtgatcaatacatcatgtcctttaggttagccagaacattttttttttctctctttggatacgaactgaaggttttttagtcttcaatagcactggctgacttcgaaacaccccatttttccactacaaaggagctttttatttcgtttatagtctctggtagaatccttttggatatagcatgttttagattttcttgatttagtttcttgtgaatcgacttttgcttaacagaaagcaaatcttcgactgagtaattcacaaaacttttaatgcatattcgaccgttcaataaatccagtatgaaggctatatcttgatttttgattgctattaaattcttcctaaaggttgttctatagttttttagatctcgattgtgctttgagtataattctcgttcgtatgctgttgcgattccagtaatgtcgtagcttaccccaccaagcgaaccttcattttcttttttcaatattagcctcttctgagcatccgtaattctagtccgcaaggcctcttctatcttgtggctacaggcacttctcacccttgccacttcaatttccaattctgcatcagtcttaacggatgaattatttgagtttcttttcgccaattttcgcttgcgaattacccccttcaagcctttcccagtcgtgggacttttcgccataattgaaatgatcaagctgactagtgtacactcaaacttgaagtttatggcttgaccaatacatcaacccaaaaatgttctgtgtggtcactacaccattatgttacatgttcgcgcgtctgctatcataaccagaatcgtagtttctgcactttggaaacctacgcgtttcataaatcagtcctttcattaaattcaaagcgagatcaccgaagataatgctcttcggactaattaggcactcacgtagacagttgttgtttttgggtgcgctggtaaccgtgatagtcttaatttttaccttgcccaacacatcaccaatagaagcaaatggagtaaaatcagaagaagggtccattacacctattattccagttttggaaagtccagcaaactcattggaaaaaattgttgatactgcctcagaggaacgaattggaggtgcaactttggaagaaggacatgaaaacaataaggaagaacaagctttggaaaatgctgaacgagctaaagagaaagaaaaaactgaggcgattgcggcagaagaggaaaaactgaaagcagctgagttattgagacagcaagaaactacgagggagaaggaagcggcgaaagaggacgatagcaagaaaccaaaccaggaacttgtggaacaagacacttaccttgacgatattccagatgacgtagaagataatattataatctcagaacaagatcgcaagaaaattatattaccgtcctacactcctaaaacagaccctgcctattccaagcgggccactgctttaaaaattttttataatgattttttcataaaggtggctgattcaggacctaatacagcgcccataaccaagaagacaagaaagaaaggaaaaagtaagttaaagggtgacgtttcctcaggtgataaatatgaaggtcctgtattgacggaagattttctacgtttcatggagatctattctgacgagttcatcgatgctgtatcagaatcccactcaaaaattgtcaatttgatgcccgaatctttccccaaaggaatgtatcaaggcgacggtattgtcattattggaggaggggtgtacagttggtatggactgttagcaatacgcaacttaagagatggtgggaatactctgccagtggagttaatgttgccaagcgacaatgaatatgagcctcaattatgtgagcagattttaccgtctttgaatgccaaatgtattatgctctctgatattgttgatcaagatgtgttaaagaagcttgatttcaagggatatcagtttaaggcattatctttgttggcctcaagctttgagaatgttctttcattagactctgataatatcccagttgcaaatgttagccatttatttgatcatgaaccattcagcgaaactgggcttgtatcatggcctgatttttggagaagaactacaaaccctcggtattatgaagcggcaggaatcaagataggagaataccaagtcagaaattgccttgatggctttgttcctgagtctgattttgttcatattggactgaaagatattcctcttcatgatcggaatgggacaatacctgatgcgtcaactgagtctggacaattattggtaaacaagaataagcatgcaaaaacacttatgctaatgttctactataatttttacggcccaggttactattatccattattaagtcagggaatggctggtgaaggagacaaagaaacttttttggctgcggcaaatttttttgggcttcccttctaccaagtcaaggcaggtccagggattttgggccatcatgactcaacgggtgcgtttacaggcgtcgcaattgtgcaatacgatccaatcgctgattacgagcttacaaaagaaaattttgtgggtgaaaagagaaagggaattgaggcaccaaaggcattttatggtaacaataacaaatctccattgttccatcattgtaatttcccaaaattggaccctgtaaaactaatcaaagagaagaagttgatcgacaacaaaactcacaaattcaacagaatgtatggcccaaacaccaaattgaagtacgattttgaagaaagacaatggaagtataccaaagagtacttgtgtgaaaaaaagtacaacctactatattttactgaacaatacaaaaattacggacagggatactcccaggagcgtatttgtaagttttctgaccgatttttgaaatttttgagtgacaatccaattaggatcgagggctaatttctatcgtgcttcaaaacgatttccactggtatgccagtatgatcgcgacaattttgatgacttcaaacagggaacacaatttcaccattctgtcatactgtgggcttaggtatatagttaacttaggagcaacgaatgcaggaagtagatagttcactaccacaagtgatcacgtatccgtgtgaatacgttactcaacaaattcagggtaattacttctctttaatttttctgatatgcgcttaaataatggccaacaccaatagtatacccccgtcctatgttagcaatcgtactcgtttctgttctaatttgttattagtttagagaaattgttattttttagggagcgagtcacaaaaaaaaaaattaattttctcattaagagttcgttacacgatcctcttactaccaaatctcgtcttttttttagatcgttttggttctccaaaacatcttttccaatccatgggtagtcacagctctacaactggaccgtaagttttttgtgaacattacaaatcgccgtaaagtcccatcctattaacactattttcacatagtcaactcaatttgcatgacttttatgatggaaatgaactgtcctaccaacataaatacactaagctgacatcagttatgtccctagatgactggtcatctaacacatcaagatggtctcgatctagtgtctactattatagcaatttagtgttagataaatttgggaggaaccaagtgggcctttacaattctaaaggaaaatacggacctaaaaaccggaacgtcaagcaccttattcacccctttcagtatgaaggtacctggaatgtggcgattctgctgcgaaaaactgcagtcaggggagggatagatgtagacaactcgcatgcattctccgagctgggaaaagagactaaagtatcagttggggaactggtactgatcaattgcacccctaatgaccccaggtcggaattcccagttgatgtttgtttcaatattgatcagttcattcttgaaactggacagaagctaagaaaccgttcgctcaagaatttttccagggttgagaacttatttcctatttattccagaattgatgcactgaatgtgttgggagtcgtttttacgatgtgctgttcatcattttttcctccctatttagccagcaagagtctcagccagtacaaaaaattcaacatctcccgattttatgatttatacttcaatgatttagaaccagagactattttcaaggcagagttaaagttcatccattttgacaaatttccccgaatcaaagagcatattgaaacttcaaagctaaaaaacttagacctggtcagaaccaagaactttgcattggacaaccggacaccaattgatgaggtattaactaatgctgttgaaaaggctgtacaaccaagtaagtcttcctccttttcactaagaaagaagcaaccaaatggttcaaacccacacaatcagagcaccaaccacaaaagacagaaattagaatcagtcttacaagtttgttccactcatgcttcaaacttttcgattcctgatacaaatttattcaataaaaacatttgtggagattttttagctactgtcacacccaacattgaagcgtttccaagccagtctgaagtgttctatcttgacgatttaatggaaatgattgaaaattggtaccacccctctcaagttctgtcagaaagaccactattagttcgagagagtactattgtatgtctttcccgtcgtaatagcattatatatgacggagaagaatttgacgagcttcaaaagacggaccatagcaaccaagtgctgccgttcttttacgagagaaagtctatttatctggtgaactttcaaactagcgacaattatcataccactgttaactgcattgaaataaccagaaagaataattcaagggatgtctcgtctagtttacttcttcgaaaaatggttgaaaactatgtcttcaaatactctaggaaagtcattgaaataaacaccacaaaatattacattcctaccgatattttttcttgctacttagccaccactaccatgatttattttctccaccgattcctagtaaaatcggcatttgatatagatttgagtccaccgttcaataagatacaggaatacacagaaaaattggagtctttattgtatggagtgtatgatggggatgttatttccagaaataattcgtacctggaaatgatgacgtttttgaatctttagcatatctgtgttagtaaggttagtaacacaagggctaaatactcgttaactcaacaagaggtaaacttttgtaaattagatacttcaaaatattggcccattttttaatagaaaatttaagcaaaaataatggttcaatatatggcagttgagagcagagcaagaaaggaacatctatgactgaccagcaaacatgatgattgaacttccaaaatcaaatcggataatgggactgggcaggaaagctaaactatagcgcgaagacagttgtttaacaaagataaaagaacggaattgtagaaaatgtaaacttttacatcttgagctttcttttctgaaatccgcctcttcctttgattacttgttctgtagatcctttgctctgagttttcaaaattgcgagcttttgtttgttgaatggagtgatagaggtagagctacttgcagagttaagtgttggcggtttacgagagtagacgcccaccgtaccattcgttgggtctccgataacactggggccaggggaggctggtttaccaacagaaatagatgaacgtggaatattaatgggttgagtggttgtcagctgactcaactttatgtccttctccttaatagtgttgtgcaattcccttatcagtatttgaagctcctgattcttgaactcgtaattgtacactatatcgttaatttttaacttgttctttaccgattcctcattttgtatgccaatcattgtatcttcaaatttggaagcttccgcaacagcctggttctttgattcttcaagttctgcttttaatatttgattttccgcgttcagtctcatacttgctgttttcaattctaagaatcttgagcttgattctgattttttctgtttcaggttagttgcgtcgcctgcctggtgcaaatgtgctagagatgtcttgcttgaagattttgatttatcttgcgaaaaaaggatcgatgctacacgcaacttcttcttgagcagttccacttctaattctttgggttgtataaggttgcacagtttttccaacctataatttaaatctcctatctctgcatcatttgattgatgaatctcgactagtttcgactccctttcttttaattcgttagattgtttaagcatatgagtaaccagagagttgaaatcattttgagaacgctctttttctttgagcaattccgtaatttgctcactcgccttagattgctgtattcgtaaaccttcgtttatgtcagctaaaaacctgttttgatctcgtagggtatccatttcgttcaatttttttttcaaaagctcacactcggctccaagtacctgattgatatgtagcgtgaagtccaattcattttttgccaaaaggatctctcttaaataaaacgaaacatgcctgcaagtggtttctttcgtcgagtcttcgtcgtattgtgaaactgacttactatcagatgaactttcgagtgagataatagaattttcacattttttagccctctctttctgcgcatccttcatatctttcaaatatagatatcgatgaccttccaaaaggtcatctaccctcatatcaaaggcattctccttcgatgtcccacggaattccaattgataacaaaatgctgctatctcgttcggggagtgcattttgtcccaccttgaagtatcaaaaatttcttcctcctgggaagaatatataaaataatttggatgaacaataaaacactttagcaagtcctgacactttgacttcactttagtttcaagcaactgaagcttgagatcgtctataatcttgttagagtcgatatatgtagatggactgcgaataaatgatgttaaactaagagggaacaggccgtataatacagtgaacagttgtttatagctaacaaatgctggaccaataatttcaggatcctgatcattcaatactttccaatttgatggtaatggtgactcatcatcaatttcaacaccccccagacctttacttaaaatcgccataatggtcggtagataatccgctattacatcacagacgtggggcaaaaccatactgagaaccttgattcctgactcaaccacactgttacttttatctatcaatatagacaaaagtatattatgccacaaagttgtttgcattatctggtacaacaaggctgatgacgacattaatgaggacaaaagtacgaagcactcgaagcggtagtgaggatccgtaaattctttgctgatagcctctagtacttgattatttaaatcaagaccttgtagtaaatccctgcagtttttctttatgaatctaaccctctcttcatactcctggggactactagaagtggaatcaacaactaaatcagtttttagcaaatacacttgcacaagtaattgaatgcctgcagcagaattctttaacaaattgtattcggtgtttgtagcttttgagggcaataataaattcattataattctccttgactcgttcaccacacaatgtggtacccctgcactattaattgctaacttcaaaaaagaagtaatccaggttaaaaatattttctcattttctaaagttggagctagctcttcaaaaagatgtagaaagaaaaggacatgtgattgggattgtagaccgattttttgccttaaattgtctaatgctagccaaaacgtttttctttctgttgatttatcttcatgggttgatttatttaactgagtaattaatagcttaagggcaggggatatttcggtttcatttgtcaaaagagatgtctcaacttctctgagtagttgtttcataggttgcccaaaaatgatgacaattattttctacgcaaaaactataacaccctaacaccataaaggaattaccttatttttatagcatgtttgagatagataaccattgaataaaatcaaccaatgccatatattgatctagtcagatctgttgattctgttcctcataaagatgagccatcttttcatgaatttgaagtatctgtgtataaattcttatcgcatgatgggatcttactagggtatataattcccaaggtggcaaaacaatttgagttcgaaacacaggctgtgatagtaaataatgaaaaacacgaagtcaagataattcctagtctggataccgaaaataaaagaacgcagatgtttgcaaagatagctcagcgttggagagatcagcgtctctttgaaacccttagcggttggagaaatgagctttttgcagtttactgcgataaccataagatgtacatgttggtggaaagggctttttctaatattttgggagttgttacttatggagttcatatcaatggatatttgcaaaattctgccgatcctaacagtattcaactttggatacctaggagaagcagacacaaaccaacatttcccggtatgttagataatactgtggcaggaggcttggaatatcctaatggcactttgcaaacttgcctgaaagaatgttacgaggaggcagggttgaatgaggactatgtttcgcaatatatcagtccagtgggagccatctcatatatgttcagaaacaaaccacccgaagattttattcaaccagaagtggaatacatatacgacctgccgatgaaacaaggtctaattcctaatccgatagaccacgaaagtgaagatttcaggctaatgaacatcactgaagtaatctcttcgttgctgcaagaaaaattcaagcctaattgtgcactggcaatcatcgattttttgataagatttgggataatctcttcttccaattgtgatagttatttagaaattgtcaccagattgcacagaaagttagaatttcctttgcgttgaactacacattgtatactcttacttggcgaattggagcttcatatctaaccattgtcgctgctgaacctcctccgccgaaagcgcagtattaccatatgttagaggagcaaaaaagaagaaagtccaaacaatgatgcttagtagcaaagcgacaaaggacgagaaacttaaccacagaatcaattgctctttcggctttgaagaattagagttaggttcacatgaagttttctgatccttgaattcttcagttctgttgtcagtaaaaataaattccaagaaaccagcagtgaacatggctgctattaaatgtgcaggtaagtaatggtgcaaaaatttttgacggctcattaggaaaaagggtaggtaatgacaacaccagcctacaaagaagaaccccaaattattgtataaccgagacctggcgctattggtcaaaacaagactgtttcttcttctcgtgaactgatctgcaaacacgagtcctagaaaggatcccaatgctgcaacctccatccaccatccaggaatatttccgacaaaatagatctgtttgcgtgactcgttgtttgtccaaaatgaaaccccactaagtgaaaaaggccaagatatagggtcagacgcaaatggatgatctgagctcaacttgttattctgaataaacataagtctttgtaattccaaccacttggtcaaaaatggcaaatttttcacttcctttggaacgtagtgtttccttggatcgtcctctgcaatatcgacgatattgtctacaacccataagtttgattcatcagcaagcttcttattaccattgacttcttgttggttgaaaccccaatcaggaagaagctggtcattatgagtccacatggccacaaccgtaggaacatgaatgagtttgaaaaatgaagctttcgacttcaaaggacgggttttcttcttgtcatagggatcaattctaaaaagtgtttcgttccagcgttgagtagctttctcctgtcccactacagtaaactcctcgttagttggatagaaaggagacgcaacatcatgcgtcagtagatagccatctgtcccaacgtgtctcagtctaacgacatcgccctgagttacaacgccagtaagtccttcgggagaaataatctgccaattattgtttgggtcctctccagagtatgctgtaacttgttgaccttgagatgataccctcccgtcctcgtaacggagggggtagtttgccaagtgtgagtgcaacatggcatcagtctctttatgctttattgtgattatgtcgttaaagtgaacttcctttgcgaaagctgcaagaggagaatctccgagagtctcctggaattcagagctcataaaactgtctcctgggccagacttgcttagaatagcgaaatgaacataaaaccaattgagatatatcaagaaagggaccagtattagaaggaaaaatcgtgcagcaaagtgtttaccaacatatgccaaggaatgtccctttttataatccagtaaactccataagtcaaacaggacaccacagcctattgtaagataggtgaacacccccacatacttggtacttatgacgcaagataaagacacccctgtaaagaacagccacttccaccacttttggccgaatggttctgatctttgttttgtgaatttgatatagctatagatggacaatgaaacgaaaaaaatcaacgtggcatccagcaagattagtctagtctcagcaacgtgggccccatcaaacaatatgatacatgcaccaaaaacacaagtcaaaactgtatatccgcattctttgagacacaaataaacaattggcaccgttaaagatccttgcacagcgctcaatgatctgtaaactacgtagggaacctcgtttttgatataagattcaccaatagttgtaaacttgaactcaccattgtacccagctaaaaagccgacaaacgcaatcaggagcttggcaaacggagggtgcagatcaaaaaaataagtacgctctagatagtagctagcaaattttccgaaatgaacttcgtcaaaaacaacctcatctggatagttgatagcatagaatcgagtacagaaagctgtgattgtcaccaagagaagacccacagtgtaccatctttcatctccaagagaaatatggctatttttcagctccttttcagtgttcaaagaaacttttctcgatctctttcttgattttatcatcagttggcttgaacgagaattgatattgaaagaaattgtatcgtatacgtggatcttaaatttacatggtgttaagatgttaaggtcgttggaatactattgaagtacacaatcaagctgcactagatcgagtgagctttttttaaggcggtagactagaatactccatgattacctattaaatattgatgcgacaagcacttattgatgtttgattacatcattgctctctaaatgcagaccataattttatataaaaactagttttcatagaatgaatgtcttcaccttcttgatgtttttgtcagttcatcttctatccctagtctgtttttggccgcatgcgcgactgacttctaagtgtttagccaacacgtaattacttacaagaaacgatattccaaagaagcagctcttatgctaagacgatatcgggttgtatttggccctaccaagagttattttcataactctttaaaaaggttctatgtggtcgactctacaatgctagaagcatttgcaccttcttcatccgactctgtgcagaaaattcacgagagccaaaacgctactattgagactccaaaaagtggccaagctaagaacgagagcagtttatcaattttgtttggaacttcacagttaaacgacaccccaatctctaatacaagtggcgatggaatcaattggtcggattcgttccatggactaggtatttgctccttcagtaatgaaagtagtaacatattatgtcaaccaattagcaacgaagatgtcgaaatcacaccagatggactactttatcttccagagattaagtatcgtcgtatcctcaataaagcgtttggccctggtggctggggactggccccaaggtcagaaactttgatcaacaagagcaagttcggaggaggtactttaaccagggagtatgctttaattgtacagggccgactagtttctattgcacgcggagagcaagattttttttcagagaagggaattcctactgctactgaaggctgtaagagcaatgctttaatgagatgctgcaaagacttaggagttgctagtgaactatgggacccccgctttatccgctcatttaaaaaatctacttgtgaagaggtattcgtggagcatgttactaccaaaaagaaaaaaaagatatggaagcgtagggatgggcttattgagtatccattcaaaaaataaatgctggctattttttgcgaatgtagagcaaatagcccattaatccttgtgtgtcttgtgcatctttgcaatacatacataagtttcgcgtatttacctttcacaatttacatacatgatcaaaataaaacaggcaattaggtttatatcacctcacctaagtttactaaatcttctgtttctattttttttgaaagattcttgaattttctaatggacaaagacataaaaatggatcttggtgatacgaaccacaatgtaccatttcagctacccccacttccgagaaagctgagaaatcggcaccaggagtcagaatttcatccttcccttcctgcattacctctaaagtcgccaagcaaaaaaaagacgaacaaaatagattttttaacaggtattagtgacaaccttttagtcgaatgtcggaagctgaactctgataatcaaaaactcaaatctctattgaagcaaaaagttaaagaaaatgaggatctcgctgaaaagatcactcaccaggcaattttttccaaaaagttggaacaagagcagcaaaggctacttgattctaactggtctttagaaaccaagctacaagatacttttgatgaagcttcccttgctaaaagttcaagtatcaaattttcagaagaactcaagttgaaaactgaccaggttgaaacgctcaatagagagatggaaagtttgaagaatgagaaattgagtcttaaggataaaatctgcactttggaaggccgcagtacgtttgagctggaggaacttaaaaatatgaatacttctttgaatgaggaaaatgagcttttgcatcaccaagtgaattccttgaaagcccaacttgagcagaagttctccatacacgacaagaaacccttccctgtagctcagtcagagtacctggagcaggagtctctggataccgtttcattaaacaatttgtctgccactgacaccgtaaataaattgagaatatctcttatgaagatagaaaacgaaaagaaagcacttgaagatctactgaaaacacacaattcgcccacagaaattagtgcaaaggtagatggtagcaaaatttcatacccaatgtcaatgaaggattcaaggagcatagcttcttgtcaatgggacaaagagatccaaaacccattgaaagaggactatattcatcgatcatcatctattgcttcaggaaagaagaaggagctggtaaacggagatttggagaaagaagtggctgaattcaatgataatttgtgcaacatggaagcaactcagtttgaggctgtctcgtcaactgatggcacaatctgtcaactttctgatcaaaaaacgttcgaaaagtcatgcaatcaggtttcctcccgtagatatgaacccctggaatcggagattttggaagttaggaaagaaaataagcaattaagaatagaactgtctgccatgaataacgaagcaaagtttctaacttccgaaaaagtaagcgcctgtgagcttgctcagaagctagaaataaaattattcgattcagagaaacaaattctagtgcttgagccatccatagcacagttgagaaaagaacttaagagtgcccaggcaagccactcgaaatcactagaagttaaggataccattataaataatttaagaatgcaagtatcagagttggagctctccttcgatgaactaactgttaatcgaaaaaacatttcatcaaaggtcaaaacattggaagcatataatgataaactacaggacaatattactgccttaaagtcaaagtatcaacaaaccatagacgaattgaccgttaccaaaagcattgcaacagagtcacagcaaaagttatcagagcagatgcaagcaaacttaactctgagtgccgatgtctcatcgctaaaaacacaagaggaagaattaaactgcaagatttctttactagaacttgagaaggaaactctgaataagaagttaaattcgttagcagtcttacttgatgagtcgcaaaaggtagaaaattcctgtagagaatctgttgtgaagtccaacaagagattgaaagagtctaacagagagcactcaagcaaagatgactctgttttaagtttaaccaaacagttagagatttctgagaaaaatactattttttcacagattgattttgatcgactaaaagagctagctgacttatcaaacagcaaaattatcgacctggaaagtcagctcaacgcttgtaagacacaaattgattcgaaagactgccattttcttaaactcagccaagagaaagaaaagctagcactcaagtttgatgaatctacaagaaaattgaatgaaatgattaattttagagatgaacagtcaaagcacatattagagttggagatagagcaaaaaaatacaatttacaagtatgaatcattgcaaactgaaatgatgagtctcaaacagtctctgattgaaaataacaattcatttgaagaagagaaactgaatcttatttcacagatttctgacgccaaagaaaaaagtaccaatttgcagaatgaagtgagcaacttgactgaacagctaacaacctcagaaagcaaactctcaagcttgattatggacggggaaaatttagtgcctaagacagaaagacaactcccattatctcaagtgttggagcgagatcaattcatcgaccctgaagatgagggtgctaaaattgatgctcaaggacgtaaaatttttaacttgaatgaaactggtgttgttctcaccggtcaaaatcttcctttggagagaaatgcctcgtttttgaattcggaatttgaatctctgaaaaaagaagttttagatttggaaatagccaagtctaatcttcacaaagatatctctaacatgacgaatcaaaaactttcccttgaaaatcaaaaatctagccttgagatctctaatgccgaactagaggttcaactcaattcagttcaattaaagaaagctggaattgaaactttgctgctcaattctgaagataaaaaactggaaaacaacctcaaatgtatgagtgtgaatcaaggaaagagtaaactgaaaaatacatcagttgctttagattccaatcctgctaacactgaaagctgtgaagtcatcaaaaatattggatgcaagctagaatctgctattggagattcacaaagcttgaagaaagatcaccaacaggatactgatctcttatccaagaaaacaggtctattacttttgcagcaagctcccaaggatgaactgaagcaggtatcagttgaacccaaaaaaataaatggaatcgcaaatgcagcagatgagaagtttagaaaagaattgaaaaactcagctacaatgcagaaggaaagtggcaatgaactcaaaaatatccctgttgcttgtgagagaatatccaccaaagaaaagatatcacccgaatgtctcaacataggcgagattaccagtcaaattgaacagaagaccgctattgtaggttgcctaatagataaattcagtacacaagaggacaagatgattgaagaattcaatttgtccacttcacagaacggcttagatgtagagtcacaggagctactgcgatcttataagatcttaagtgagaagataaatcagctactaatgctctggggatccagtaagagcatggaggaaaatattggttgcgtccttactacccagtctgaactttgcagctcgacaaaacacgacaacgaattaccaattgacaacttaaaggcagctcaaccaaaaggtgccataccaaacgacaaccagaaaatgacactgtcgtctgacgatagtgaaaattgtgctttaatcggtattccacagataaagtacaacagatcgacttatgcactagaccatcaagaaaaagaacaaaaagacaccgaaaagaaatatctggataaaattattgacaataaatgttgtgttgttgaactagatgagttacagaagttaaaagagtgtcaaaatgtgaatactgcggcttttagagaattactagatgataacaaccttctcgccatttcgaagaaagcttacgttgcaacaactattttcaaacatcctgatcccgatcatgtggtggttcttccaattacttattataacaagttaacacgcagtcacgaggttgttaagaagaccaaagatagggaagcccttgactccagcctagatgcttttagttctaccctaccatgttaccacgttaaagaacagagcaatgtggttcacgatcctgggagcacgatcgcaagaacattgtcacccgcagtaacctgccatactgaaggtacagtgagcaccaatatttctttaactaacagaaatatgatgcctttgattacacaaacagttattggcgaatacttgtacaaatatcaccgtaaactggggatatttagttctatttcagagagcagacatgaaaggtacttttgggtacacccttactctatgacattatattggtctgatattaaccctgtgttatctaacccatccgataatagggttaaggctttggccattacaggtgttagctcagtagatgacaacaaccctttacctcctggcctatatcacaaaagtattattattcagtcaattgagcgtagtatcaaaatcacttgtgctagtcgacaaaggcataacatatggctcaatagtataaaatatcttttggctaggagcactgaggaattggagtttgatgaggatcctgaactatcttcaatggctattcgagtcacagctcaggattctgctatcacaagatcaggttcttttcgacacaatctaccaaggtcgcggtccgttgctgatagacgcctgactaagcaatcaagcatttgcaattgatttcagttattgaaagaattgtcaaagtcaatttactcagtaaagaatttatccacacaattagctctactcttttatccatgctcaaaacaaaattttcattcggtagtatttttgaaagtatcaacaaatgagtctagtaaatttctaatgtgctgaaaaatgttcaaatgtaaagttctagtactaaactgggccgcagcttacccctcaaacacaatatcaattatccggtcacttaaaaaagttcgaaagaagatctttgtccgtcaagtttcaccttgttgagattgtttttatcttcgtatttgaaactcaagccatttttctggagccagtaggcatatgtgatgtgtgtttgtacatcatcttaagaatacatcatatgcaccctcctgctggctcgtcttttccagtgaaaagaagtcaagagaatattatagccgctactagacttttgtgaatgctggctgtggtcgacaaaaaatatacttgacatccgttttaactatcttcgcttgtctgaatattgaatcaagagtctgaataggttgaagatacaatcaaaaaaaaaaaaaaaaaaaaacgaaagatcgcgtactaccagcttgatgtatgaacatattacttctggaattttttttttccaaatgatagagaaatgagcttgaggcgggcaacaagagaaaccaaccatgatcattcttacgtcacctcaagtttgtaaaaaattcgtttatagttggaccaagcagtgtaaaacaaaactgattcagtacatcttgaaaaagctcaaaatcttacacttattcaatcttccaatcaaggttcatgctttcacaagtttcatagcaagtcagaaattggaagctcttataaaaactacatgcgaaatggaataaagttacatctgaaatttccttatatagtcataccacaataaaaccacgcaaagagaccttcacaacaaactctcaaatagtaataagtattactatctttcactgataaagaaaacgtgaaacgtttaccttaatggcccagagctgaagagcttgagggggctaaaggatctgccgtctcaaacagagcttcctcggtacctttgtattctttaatttcagagatggatgcactttctttgatactttcattgatagatgttcctgctattttttctctataccactttggatacgccaactttgttagtggagtggttaagaaggtggtgaccaaagtcattacaataaagatagaaaataccttaggagtaaggagaccagcatttaaacctgttgtgagaacgacaatttccatgatccctttgcacgacatgagaattccaacagtaaggcaatccctattgggaagaccaaacagtttagttccaacaaagccccctagaagttttcctgcaaacgccaagcagattattccaatcgtataggcccaatcaattcccgtgttcaacagaccaaaatcacacttaagtcccgctaatgtgaagtaaagaggaactagaatcccactaacgatgccctccagctgctcatttatcagagaagaaaattcggcttctctaggtacaatcagtccaatcagaaaagcaccaaatatggaatgaactccaataatgtcagtatagaaggatgacacgaacgtcaataatactatcaccgtcagtgataaagttgaaggcttcgatcgttcaccagacttaattctagcaatatcagacttcaataaccaacacagcacgtatcgtatggggaaaagtaccaaaatgaaccaggcaacagccaacagcaaaatgtagacagtgtttaccggattggaagcattaaccagagttatacttaaggcaagtaaaatccaacccagtaaatcattgaggacaccagcagacagtgtgataataccaacccgatctttcgttaactctaatgacatcaatattcttaccaatactggaaaggcagtgacacacatggcaacagcaatgaaaaccatgtaagttgtaaatgataaatcggactcctcaggacctaaatactcattgtatagacctttagcaataccgcagcctaaagcaaaaggaatagccatgtttatcaccccaacagtaacagctatcttgaaattctttttaataaacggaacgtctacttccaatcccaccagaaagagaaacaaaataatcgcaatgttagctactaatgtgaatgaaggcatgctctcctcaggaaaaacagtatccgtaaagttgggcactcgacccatcactgagggtcccaaaaggatgccaacaatgacctcagcgatgaccttgggctgtttaatcttcgataaagggtaatacaagagttcagaaagtacaacaataaccaaaacctgaaaaagaaacaaagtatagggagacttaggatcatactccagtggatttcttccggctactatacctgccacgctggccgtatcaacagccatagttatgataataaaacttggtaaaggaataccctatttttgaatagttaaatggtgcgcctggttcgtggctgagataatcaaaacaagataagcaccatattctcaaacgaggaaaagcaatgaatgaaccttgcaccagccagaccttcactggacacgaactaggagcagatttgactgataatttgccaagtttgattgtgcatctttttttttcttgttatggattatgatcttgtttgaagatcctaaacccttttcctctaggagaaggctgatatatttttaaatttttcctaagcttaattaagtacatgcatattctgtccgagctgatgtcctagaacagagaaaagtctggtttagcttgaatgagcagagcaataagcttctgtgttaggcacatttttgtagcaaatattgccactatcgtttatgttatcattccacagcctagtactctatctctatgatacaatacagcaatttgtccaggcgatatcgcccgatacttttgcttcagacgaaatgtcattctttggttattaattgattgactaaaaaatttccagtttaggagccctatagggtcttgtagagatctatattgaacaatcagttcatttattgatatgttcttcaggttgtctgcgttaaatggccctaaccaaagccagttactggtttcaacagtgtctttgtacagcgcaggattattagagcctttaacaataactatttcattcgtttttggccgtttttcacttacaaaccaagcacctttatagtttcggtctccctgtggcatagatactcctgatctttgccctatagttgcatgccagagaccttgatgacttccccatttatgtttaaaaccattttcgtctatcgtaataatatcacctggctctggaggaagaaattcgtccaaaaactttttaaaatgtccctccttctgagatacaaaacagagcccttgtgagtcaggtttacttgatgtcggtaacttccattttttggctagattgcgaatctctggtttagaaaaatgacctattggtaagaacatcctttctaaagaagagtcttttactctggataggtagtagctttgatcttttggcaagtaatcggatcgaaggagatgtttttctctcgaagttatgtcttctaatacccttgcgtaatgacctgtaaccagccaccatggttgttgttcgcccaatgtatttgtaagatgttctatcattttaccaaacttgacgtatctattgcatcccacatctgggttaggagtttttcctatacgatactgctcaagcatgggctcaaatacttcagtccagtactctttttcaaagtcaactctacgacatgggatcccaatgtgagaacatgtcttcttaacatcgttccaatctgaatcggtacaattggagtcagaagtccaattagccatgaaaatcccttcgacctcagaccgtggaaaaatctttctacagagagcagcggtaactgaggagtcgactccggaagacatcgcaactactatgcgatccttttcacccggaaaaggttgaatataccctttggggagtttcaaaatccttttaaagtagttcatcatgtgtgccctactggaaagagttacgatagatatgaaaattatcgagatttcaaacctatggttcgttacttccaaaatttggtaggaaggggtcccgctgcggtctgataaccgaccattccaaactcgggacaaggtttttcagaagtatcattatttcctcatgtctaccagtaccaaagccaaagacaagttacctaacagcactcttagaagctactttcttggtcggttgggtactttttgtttactgacacagatctcgcgcttgttcatttgaagagtaaagtagcccttttaactactatgaattttccatttcagtcatttgaagatgactctttatattgcatacagatacgctaagtatgccaaacctcgttccaaaccgtatccgaaatttcacttggatactagcaaggcctttatggatataaaacaatgggaccattcaactctgaaaggggaaatcgtggatgtgataaccttcagagacataaatgaagggttcagtttgggtaaacttaataaagctcttctcaaggatgttttcaacaaaggtggtgcaatgtatttttatcactctgtgccatttgattcaatgccacccgagcacttaggttcacatgacgctttgagggaattggctaattcgaatacagtcggcagcatcactagaaaaaccgataatgcgatcggtttaatgttaaattgcgtaactaaaccatccgctcctctatgcttagacgatcatacgaatgcttttttgtttttaaagaataatttacgaccagggtggtctatgagaaggaccacacggcaagcttacaaggatttgaaaaatggtgacaaattttattcggacctagtttatgacaacttgaaaaagtataaaatcccctttcagactgataggggccctttaaatgttactgtgcctttaatcgagcttatagacatggtacaggccatagcggttcatcctggccatccttcagcatcagatttgctgtgtagaagtttcgtcaaccccatcactggcgaaaaacttcccataattatagatgatggaaaagcagacaagttaagtgtccttggattagttcctggtcattttatccgggattcgaagctggttagtcgtcatccagagatctcacacattaagactgcaccactagatcaattcatgtttaagagactccagtttgctagaaaactgggcgtagttcttaataagtttgaaaacaagggcaccaaaaatgcacggtcaatgatatacccctttctcagccaccgaacaatcctcaccaacgggattaaatcattccccatcacaaaagacttagacatcgatcaaaattgtcatatgatgcttccgtctcctattttagaaacaatattatctgtgcagagacatccagatatacttttagtacctaatattactggagttaaagttacactggaagcattgagctttgacaaaacagtaatatatttaccaaagattgttgactccaaggggaactcagcagtaaactttaggagagatcttcatgtcctcaaatcgtctaaatccttcgaccaactgctatcagccaacaagccgagtcaccaaatacatgaaaatagtgccgaccaaatacgcggaatgttgcttgatgtcgacgaacataatacagttatttttgacgattgtcataggtacaaacatttcgttaatctgaacttgctaagttatctgctcactaactaccagagtcatttcaagccagaaacatacgattccaacattagttttcagtttgattttaacaaagtgttgaacatgaaagactttcgaagacatgataaaggtgaagaagaaagtactggaattaaattagaaacaaaactattgactccttggaatactttcataattcggagtatctttgaccgaacaataagttttgaaaaggcattgaaagaaggtaatataatcatgatgaatcgactatttaacgaaactttaacagatatatgccacaaatatatcgatttgctaatggctgagattgtaattaactgtgagagaaacgaaggtggatcaatgtggagactggcaaaggagaaaatgtttcttaaagatttgctgggtagttgcatccttagtgtagctcatatggctaaatacttttatccacaattggcaaactacatagggaaaaaactaccttgccaaaaagacaaattcagatgtaacctggacatttatcgcaagattagaaatggggaaattaagcccaatttgcgatatcagaaattattggatgaaaaattcctcgaggttgggaaacttatgttggacctcaatgggcttttgaagcaaatttttgcaatgcgctgtcctagccatgctgaaacaattcacattgttatccatgtgaaaaacaacttaagaatgtttttatttctgggcgaaaattggcccttgcttagactagtgttcaacaagtttaaaaagaactggaaaagtgatatcaaatttaggctcttcagtgagcatgaaagtttttcaatggttattcatgaaacttttgaattaaatgaggacgtcagagttcatgttgcctatgcttccaagccaaacagtggtaaactcatgccagctattgtcaaattaaagattgatgcagcagcaaattctaaactggtaaaaataaacaaacaccccgcttttaaggatattttgaatcaaagtgaacgcccactgaacgaatcacgcccaccagagcaagaattagaagctatgattgaaaagatggcaaaactgtcctgcgactttaaagaaaagaatagaatttgacttattactcatgatggtttgcaagaatatttcaacctggtttcaatcctttccatcctattccagaatgacctccacatgtaaaattcattctgcagatgctcattgagacgcaagctttgagaaatttgtgcttttaataatctcagtgatctttcaatcatctttttatagtttaggtgtatttctttaaattccttatattttgtctctcgatccgaatcaatcaactgttggaattggtattgatttaaataaaaattgtcaagggaaatttgcaattgccaaattatctcccatctcaaaatgaattcctccaagcgttcgatctcaatccccagaagcttttctaaactcctatcatgtggcagtttcagtctgtgaggtaccgcagtttcttgtaattttaataaactagaattgaagaaaaatgtagtgatctctttatgtgaagttaccaaaaaatcaaactgttgcaaagttataaccaactccaaaccaattcgacatttgcttaatcctattcggtatttcagatcgttaatccttcttttcaaatcattggtcggcatctattgtttgactgtaaaagctactttaacaaccttcctgcatcgtgtgtttcccaaaacattcttgtcgaggttcagcaaattgagcgaatgaaaccattttaacagttcataatacaaacggaagaccagcaaatttttaaagaatggtatgtgggtttaggcttttgaaaaattgtatccttactgacaagtagtgtagtccagatccgggtgagtaactcagcgtaacaatactaagtgtccacaactactaacacattagtgtcgcagtttcagacgagtctttgacagccttcaacgaccttaagttgggtaagaagcataaatatgtgatttacaagatcaatgattccaagacagagattatcgtcgataaaatctcttctgacgagagctacgacgcttttttggaggcgctccctgaggacgactctaggtacgctgtgtatgactttcaatacgagatttcgtccaccgagggaaaaagatccaaaatcatcttttttacatggtcaccagagacagcctctgtcagaagcaagatgatatacgcttcctcgaaagacgctttaagaagagctttgaatggagtgtcaactgacatccagggtactgacttcagcgacgttgcctttgagtctgtgcttgaaagagttagcaggggtgccggatctcattagtatgttatttggttgaattactcgacaaattagcgagttgttaattgcagtactttttagttattctgttgttgtttctggttttttttatctccgtatggttgtttctttacatttgtttgtaccttgaatcctcctcgcgaataaaccgttatctgagcattttctagattcccacaacctttctttttcatacagtttatctctcccttcgatgagtgaaccttctagtaagcttccaagggctaacctggaggaaaaaataatgataataaatcattttcatagtagcaaacgtccacagagcgagactgtagaatattttaaggaaaagtttgctatttctacctcttcactgagtgagtggctaaaaaaggaaacagaacttagagaaagatacgatcagagtcagaaagtgaattccttgaatggggtgcatctgcgtcatgcaaagcgcaaggtcaagtttaagtatgaaaagatcaatgcggctatggatcagttagttgaaacaagactgtccactaaccaacctataaacgagacagtgctgaggaaatactggattcaatatgcaaaagcattcggtgtggacaacccaaagcgattgaatggatttagtcatgggtggctgtgtcatttcaaaaagagacacggattagatcgtaaatcgctgcaatatttgaaacacagagaatctcctggatcaggggattccgtaaatgcctcaggtaccaatgaatcaaactctatggtatctcaaggccatataggaaactcatctgttagaactggtgctgtgggtgggagtgcagggctagatcaagaaaggctattcatacatggagtttcacatggagaagacagattctctttaccacagttcctgacttcttcaagtacagcagctggtgtcactggttcatcaagttttccttatttaccactggataacaatactacttcatcaagcaatgccggtactgcagcaacagtatctggggctacagtttcgtctgggccagtcaataacaatacttccttacctaactctaactcatcgttatacggaactgtgcatactcccgggctaaactttatgacctcgcagcctccttcccaacaatcacaacaaactcaacaaccatctcagaatacttcccaaggacaccagcagccacaacttcaacaacaacatagttcacaacaacatcaacaaccataccaatcttctgacccgagttatatgaatatttcggtgtctgatatggagcggtttattttcatgtatgcagataaatttttcattgaaaactgtggtacctttccaaagacaaaggaattctttgaacagttcaagaccaaatttttggaggagcgtatcatgctgtctcagaggaatttaaattcttctgttgacgagtttttcttaacgaacgggtccaaacagtctagctatatgttcaatagggttaaccgttaagaccaggaccagtggggagatgttaaatagggacgcctttacaccatattatactttttagaatcgagaagagagtatgcgatatgcaatggaaattgcctgaccactatctactctaatgctgacacaattattaagccgtcacataaagcgacgtaatctttctaacagagccaatatcatatatcgtcattactcaataggctctacaactgatggacgaattatttctcaagaaataaaggatttgcccttgggaaaatatcatcatgcagccgattctacactggaaaacatgacagaggatctggaaagattctttgaaaataattcattggatacttgtgatgtggaatatacttcagggattttgagtttgcagatccccaagttgggagactacgtgatcaataaacaacctcctaataagcaaatctggcttagctctcctttatctggaccaaagcgttttgactactatcgtggactttggattgattctaggactattgattcagctgggcaaattactaatgttttagaaaatactctacatgatttattagcaaaggaggtttctaaaggcaccggattgccatttcagtttaataagtgaatagctcgacagtatataacgccactagatgagcagaagtaatataatcctagtacgaccttgggatataaggactattattgaatacaacagactacgtggtggtttaattgtcaaccgagcctggtctttttttggcgcgggcccctgcaccagccaccacctgttgtttgtagttgttcaaaaatatccaagtctatattctatacttgactcgaggatcactaacgtcaatcgttgtaccccaacattcgtctcctgactataacacaattgatgacatctatacagaatcgcactttggagtttcagcagtgtgtgaaaaccttcaacaaacaactaaatataaaaacaagcaacgcaccaacatctcctccttcaaaaagtgacttctctaaaaaagcaagcgttatagccaaagatattgctcgagtcactcaactgctgagaaagttgacgatactgataaaggatacgccacggtttaacgatcgacctatcgaaatcaatgagttgacctatgtgattaagcaggacatcttcaaggtggaaaagagtttgaaacaactacagcagcagtttcgtggaggcaccggacaggttgacagttttaacaagaacgtagtgaatcttctgaacacaaaaacacagggagtcagtcaaagttttaaagagatattggaaataaggcaacacaatgaaatatctcaaagatcccgacaggaacaatatgccgccgatgatacaaatgacttcaactacttgactcttcgaagtcaaaaaaatgccagctcaatatcagagaatccgttttcctcttcaacaaacgaaactatccccgctgatactttgatgctgcctgaatcgaatcagctgttactgttggaagaacaatctaatgtctatcttcaggacaggaatagagcggttgaaacaattgaatctacgatcagtgagattgggaatctgttccaacaactatcaaacatggtctccgaacaaggtgaggtgatccagcgaatagattctaatgtggaagatatttcattcaatattcatggtgcacagcgggaacttataaagtatttccacaatgtatccaccaatcgttggctcatgttaaagatatttggaatattggttattttttttgttctgtgggccttggtgagttgattaaaatctcgtggttggtcgccaaatgtcggctaatacacaatgaaaacgtaatttcgacaagtttattattacagtcaaactaaaagatatttatcagcactgatttggtagaccatttaaatttactccaaacaccaagagtcaagaagatcagaaacagattcgccattagacacacaagatatgcatactagaacaactgtatgctggtaaatactgatatttaattcaagtccaaaaaatttggttaagtactgaaatcataccattcccatttcttcctgcagtgctcgtagagcagcttcatcttcatcttcaatttcaccttcgccttgtaggacctggttttctgactttgaccatacttgtggtaatcgactaacatcgggcatcttatgtgtaataggatctttgatcggttcgctaccagttcccaaaagtttactattaagttcttcctgttgaagctcttctaattcgtcctctagctcatcttcatcgacttcttgagtgccaagagggcgagaaatagcatcgcttatttcttcgcctagttctacttgttctcttatttcatccatggttgaatctaccttatcaacatcaaaatcaccatgtatttgtttcatggctttagcaccttgcttcatagccttcatggtttccagattgagattagcattttctatagaagtaagctgtgtctccaaagaatcaatttgagccaagatcttgactagctgtacctcgtatgtttttttcttcttcagagcggttttggctgctgttttgttctttgtgatgctggcacgagcaagtttatcctgctcttccatttggttttgcaagtgctgctgcttcttatttaaaagagctatatgctccctaaggccaactatcgcctttttgggggcttcttttttcagctggttgtttcctccaaacaaataattgaacattgactgttggttagttaaaaaaagaaggatgtgcaggaattcagataagaactattcgcggataggaatgaatctggaagttagcgtatgggtcaagtctgccaacaagtaactttgcaaattggcgattgtaatccaagaaccaaatgattctgatttggaagactcaaccaaaacagggcaacactttctttgaaaaatagattgtcactaatgttagagctggtggtgtccttccagcttgggcaaacaatttctcgaatatccttgcaattttttcgcacacctctatataaatcttcctgtagaatcaagacccacaatagacaatataaaacgccctacttttcttagctctcatgttgcgttcatactgtaggtctatggtatgttatgctactagaaagagttacggaactgcatttgttggcacacaatctttgtgtcgaccaatgggccctactctgcctcaagaccaatactcgcatatttttgattctttaaagaagtctatgaagaaaccactcgtccatagtggaaacgatgaagctttggattacttcagctctcccaatgataaagtttttaggaatacaaatgcgaaggagctgaaccatttgtggactctactggaagcttgtgcaatttccaatgatttccttagaggcaagaaaataatggaaaatttgtttcacactagcaacaaggctgagtttcagattgcatatgctaagtatttgttaagctggtctaaaagtcctgtaagtttaatggagctagaagaatatgtgttaaaagagtcacctattttatttccgacactggaattcgattcgaagattgcaagtattctggtgagaaaatgtttgacctcaggttcatttgacaacagataccagacaataatcactaagtacatcaaatcaagttccggtaacagaattgaggatttgttcaagcatctggatatacttggatttgacaatgctattattatattgaaggcttaccatctaggccgtgagtctattccttcaaggtatagagatattttcgatttaaaagacgaagcctttgcgattccctcattgcactctacaaccaaggaaagtaacaattctcataaatgcattgaagaaaaaattgcggcacctacctattttgaagatgagacccagcttccaccatctttagacaaggacgctcaacatcttattggggtggatacctttggcctcaaagtaatacgtcactctttattaggcttacaggccaaacctacaaattccaatggggagctttttagtaaacttgaatcgtttgatgaaagctatgctccaatcgaattcggtgacgaacaattgtcggataggaccataaatttctttgaaatcaaaaaacttttaaaaacaccacagcaacaagaagattttgagaaatttctggacgcctacaatgctgagcggcagagactgctggagtttcaatcattggacggagccaaacggaaatgggaacaaaccttggaagatttcaaagaaagcaatgtagtcaatgttccttccaagagtatcaaaaattatttgtggaagtggcatagcaagctactcccgctgatcaaagaagaagtcttaaaatgccaaaagacactatctattattggagcaggtaatcttaactcttacaagacgaaactttctacgatggaacgcaaggcgtttaatgaaagattggagtatgctaattacttaatattagtctccccggacaagatgagcacattaacgattttggagcttttaaagataatctttaccggaaaaaatactactggaatccgtaccgctcgagctgtcataagtgttggcaaagcggtggaacttgaatatcgctcagaaagacttctttcaaaggagatagatgtattcaaaaacttccgaaatatgaagaacagcaaggaattcaaaagactcgtcactacaggctccaagaacacctttacaaaactactacaacaaagtaggtctgctagcattgacaccgagcttgaggagacattatttaattggccaaacgagataaaagcaaaaattgggtctgttttaatatcactactattgcaatctgctaagatcgatgttcaagggaaggatccaattaccaacgaagaagttcatggacaagttcctgccatatttcaccaataccaatacgctaatgggaacaaaataggcattctaaaattccatcatgatttcactagtaagttgagtaaagacaacctcagcggcgcagttcaaccgcaataccttcccatgttagtcaggcctaaaccttggctatcgcataacttaggagggtattactacaccgaaacttctcttattagaaccaaagattcccctgaacagctggcttatgtcaaagccgcttctgaaaataatacaattgataaagtttaccaagggttgaccgttttgggaaatacaccctggaccattaattccgaaatatttaatgtcataagcgaagtatggaattctggaaatcagtttctagacatacctgctattcaggacagccccatatatcctccacagcccccttcagatgctgatccttctgtaataagggactggaagtatcaagtgcgaaaagtctccaataagttttcttctgatagatccatgcgctgtgatgctaattacaaattggaaacagcgcgtgggtttataggcgaaagaatatattttcctcacaacttagattttagaggacgggcttatcccatctcacctcatttaaatcatctgggcaacgatatgagtcgagggctgcttttattttgggaaggaaaagagcttggagaaaggggattgaggtggctaaaaattcaccttgctaacctttacggactggacaaggagactttggataagagagagcaattcacagacctcaataaagcaaatattatagactccgccacaaaacctttagctggtaaaggatggtggaagtcttcagaaaagccttggcaaacactgtctgtttgcattgaattagcagaggcgtggaaactgaaaaatcctaacatgtttgtttctcatattcctgtacaccaagatggaacttgtaatgggctacaacactatgctgctttaggaggagatgtagagggagcgactcaagtgaatctaatgcctgataataaaccaaatgatgtgtattcgtatgttgcaaaacttgtgcagaagcgggtcgatatcgacgctaccaatggacaccagcttgctctgaaattacagaggcacataaaacgcaaagttgtcaaacaaactgtgatgacaagtgtttatggagtgacttatatcggagcttctgatcagatagaccgtcggttgaaagaaatttttggcgacgatgatcctgatacacatgttgctggccgatatttggctcttcaagtattcagttccattcgtgagttgtttactggagcacaccaaattcaagactggcttgctgaagcctccaagaagattaccaaatcaattcggatggatatcgatacatctatgacaaaaaaatcatcgaaatctgctaagatttcacatttagcatccgtgatttggacatcacctttgggattacctattgtacagccatatcgcagtattgggaaaaagcaggtagcaacaaatcttcagacagttttcatttcagatcctcacgcagtgagtccagtagactcaagaaaacaaactaacgcttttccccctaattatatacattcgttagatgcatcccatatgcttctttcttccattgaatgcggtcaaaggaggttatcattcgctgcagtacatgactcttattggacccatgcagcagatgtcgatatcatgaatgaaattttgagagatgcttttgtaaaactacatgagacagatttggttcaagatctaaaagatgaattcgatcgtcggtaccatgggtttctagtagttgaatctgtcagtaaaaagtcatttattggtaaacaaatccaagagcttcgacaagaattttctaaacggcttggacgaaagatcaccacagcagatgaaatatatctagaaaaacaacgacaggagtatttgatgtcgtcagacccaacaacaaggaaacttggtgagaagatggtaaccacagttagcattcttgaaaatgtcgatattgactctttgaagcccataaatagcatggacaaattcagcattctagccccgttcaaacttccagaaatcccagccaagggtacgtttgatgtaagattggtgaaagatagtacctatttttttagctaacatatatcaattgctgtaaataaaattgtaaatagataagataatttagacttaagtgataacaattgttctgctatttccttttaaggtcatcatacaattccatgactttcttgtttttcagtcatctcttgtaatagctaaatcttagcagaagagatttaagtagtgattcattaattattttaggttaaacaatgctaggatcacgaagtctgttgtttctcaactaccagaattttgccttgagcttcaagattttcaatcaagagttgcaaaggttccaactctctggaatcgatcaacgaaaactccctcacaaaagaaatgaaatgcgcaaaaaaagaattccagtgcgcttctaatgatagatgaacaataatctcaaaatgatggtggtaaatgtgcgcaaaaatgcgaaacatttgtctagaaatattcttgatatctttcatgaaatttggagggaaggaaatattggatttagttggaaaaactgtttgatcactaaacttactatttatccaagcaagagcatagtcgatgtattgatttgccgaaagactgataggctgtcctgtttgatctatccacaaatattcggtgctatcatcggcattcataataggacatttttcttgtgaactgtattctacaattattccatagaattgatttagatgcgtgtacgtttcgaatgaattcagagcaagccattcaccatagtcaacatattttggcaattgaacaatcgtcttaaaggaacctttcacaagcgccgttttaacaaacggctcacacaaaaatagtggtctagctgaatttgaaccataactgttggaaactcgatttatgttactttgtacgcgctgggatttcattgactgtttactaggagattgagtacgtcgtagagaaagggcagatccattatttccagaatatagtgtattcgcatttgtattcaatgacaattgtgacggattaccgtgtaactggtcataatcaaaatttgtacctcctgtcatattgttattattgttgccattcttctgcttcttagatcctcttgcaaatcccctaataacgttagtacacttgttgtcgttcagaactaaagtttagaactccaccgtctacgcttctcaaatacacatacttaatggtatttaggaatgacatttctaatgtcgtcaaacgaaatctaaaagaaaacaaatgcaagcaagcaaagaacttaccctccactatgcgcgatagtttctaattcacaaggacaaatttaggttgggaaaggcatttttgaacagctattaaactagtaaagattcgtatttgcaaacatctttggagccttactaattctttgaattcggtttgtatagcaattttcctcggaaccatttttagtttcgttcgacgtgtggtaatatcagtagatggtatatacttgttcgattcaaccgcgctttcaatttacatccttcataggcaacacgaaacacatagtagatgtcaattcaattagcatgcttgaatctcagagctgacgtcaaatcggagcttaattcccagcagaactacttgtgtacgtatgcacaggatggagaatcactttggatacgaaatcgtgacgtagtatggatgaaggggaatgtagtctatcgaagacttagctttgagtctgatgagagcattatatcgactttattttgttgcttcaatggggaaagcaagagtctggtagtagtttctagggaacaggcgagtatattttatgaagatggcagaatgaacgttgtttccttttcattcaatgtgagaaatgctttttgtttcgaacatggaattattctagaaaaggtgcaagatcttgttaccgacattgaagattccagcagaaatgtaagatttctgacaatgacagatgcacttgctgattacggtgccgttgtttcttcgagtacttctacaattggcgtcgaagaggaattatgctcttttagtgagtctcaatccagctcaaacttgtgttgcacattcgacaaattaaatgattctattcacatatatcacctaaaatacttgatcaggaaggaaaactccagatccagttctgcttctggacatactcatgccaaaaggcgaacaaaacagaagccatttgctatttcttcaactcctaattcttcgaagctagtggatgagaaggatgtttctactaaaaaaagaataaactcgctatcgcaagccttgtcaattgataggatggcttccggtcctgatactggcacagattttcattcacatactcacaatgccagcgtaatgccgtcgaatggacaagcactaaggaaagatgtaattttgacaaaagtatacactttttctttcaatgacacaagagacaacctaaacattttttccataaaatgcgatcgtcaggaagctgttgttatacacaacaggagaacttttgagctttgtgttgtcattttcaactatgctcatgattctttatctctcccatcatttagttccatttatcgactaagtgcgctcgactcaaagtgtatttccactcgcaagaatgaattcaatacttcacatgatggttatattattattctgaaagatgaatccacgttgtttctagctaatccgttctttgaccttctttctccccctatcaacctgaaaaacaaggtgcctcctatatcaatgattaccagcaccttcgaagaatgtattgcaatgctggctgaaaataataaaatatacgaaatcaacttggttctccatccacaaaatcagttagtagataagctactttcaatgatgaaatactgtggaggtgattacacttttgaatacgtttggctgaaatggtgctgtgtattggaattagatccttcacacaatgagtggacctgtcttttgaccacactgctttccgtcattcttccgaacgatctaaagttcaaatgtttcaacgacattaacgagctaaccagttgtttgcctttgcttgaaaagtttcgactactagtagacgattcaaaatatcagttatctgatttaagccccattttgattttatcaattcatttattacgtgaagacttgaagttgaacatcatgtgctcgcaacaagtggatactttaggagttatattggcacagttaacacagtgggcttcttggacggatacttggatatgctattatcaacagagtcacgacattgtggataaatctttaaagcttatgattccgcaattattccccaagcctccaaatattgttgagtccctatcaagtatatttactgatgcaattgttccttatatcacattttcacaactagttgaagaacctgattacatagacgagctaatgactcccagaacttttcatgtactgaaattgttcgaagcgatcatatctaacgattttagcgagggagatgtaattagcatgatgttggactatcaaataagttctacggatctggagacatatccaatgggggtatattttcctttgaaaagcataatgacaaagtgcaaggaacattcttcggatttgtcgacacaggaattggctttagttggaagaaaagatttgcaacttctctttgcagacatgccttttcagcaacttttacatttccatcaacgccctgcttccttgcaaggttctagagatgttcatcaaattctgcaggcgttgaatgagcatgaggtcttaacagcttgggatggtcagttggaagctgacaggatgcataccactagaaaaatattctctgaggatagaagatttcacgaaattactagattactgcagtctagcaaagttcagcctgctttgttgaactctcatgcaaaaatgaatgagcacgattttcatattctccagaagcatctggcattgacggttgcattacgaacgctaactattcccttgggtagaagtgctattttcatcagcagcagaaggccgctgattacggaaagatttccaattcctaaattaaacttccagtgtgtcttgttgcctcaggaaataacgataacacttgagaagtcggctattgatagtgagactatcgaatggggttattttcataatggagtatctgctggcttgactgtttcccgcgatgctacagaaatatctggaagttggatcgtcttcaatcgacctccaaagctgaacgcacagcatgcggggtttttatatggactgggtttgaatggacacatgaaaaagttagaagaatggcatatatacaactatttgggacccaaacatcttcataccagtgttggcctactcttaggtatgtctgccagtctaaagggcactaagaatttgaaactaactaaggtcttatccgttcatatcgtagccctattgcctgcaggttcaacagacctcaacgtgagcttaggtgttcaagcttctggtctgataggtattgggctactatacttgcaaactcaacacagaaggatgagtgagatgctgctctctcaaataaaggggtcattagtggttgatgaaagagaattggtaagtgagacttatcgattgagtgctggtatagcgttcggacttatcaatcttggtaaaggtgaccatctaggggggttaaatgatacacattacttggatacattgttttcactggcatgtggttcgagagatacccagactaaacaacaacttgacaagtccagtgccggtgctattatggcaatcatttttatttttttgagaacaaattcaggagacattgctaatcgtttggacatcccagatgctgaacagctcttagattacattagaccggagttcttgctccttagagttttagggaagcagatcattttatgggacagcatagaatgtagtctgcgatgggtgtcagatcaggtaccaagaagcattaacctgaaagcgattgagttaattggagatttgaatagtgattgtttgaaatacctttatattgttactggtctctgtatgagtatttctttgaggtttgcatctacatgtgataaaggtgcccgagatacgctcttgtggtactttgaccaatttatgcgattgacaagtctttcttgtgtcacgcatgatcataagataaccctgaaaagtgttatggaactaagagatctcttgggaatatctttgagtatcattgcagctggttctggggacctagaaatcatgagaaggttaagatacctacaaaacgacacaaatttttgtaagtatggaaactttatggcaatcaatatggctcttggcttcctatttttaggtggaggacaatatgcttttaaaagtgatctgttctcaattgccactttattagtatcgatatatcctgtatttcccaaagtggctaacgacggagaagatgttctgctgcaagcattgcggcacttttggagtatggcagtggagaagagatgtctaatagtgagagatgctgaaactttagaaacactctcattgatgattcacgtacttctaaaaaatgggtcttctaagaagttttcaagtccttgcttgcttccggatttaaatgatattgactcaatcatagttaatgacgatgggttcttctctattaaaatggatatggacgccttgaatgaaaagttcaaaaaatcaccgacaatttttgttctcaagaagaggtttcataacagtttgaaacgtgatctgaacgaagtcatcatgtatgacggaaacatcaaccatcaccaaaaaaatcagaaccactcccaattcgccttaaattccttcaagtcacatctcggactaataaaacacgaaagagaagcacttttaaataacagttatgactttttgtctaacgcaattgatttcaagcttgaaattttacaaaagtcgaaacatccaaaagacgttgaagattactggaatctaaaattagtatttcaattttcagagcgtcaacaccacctgcactttatgaacttgaacttcttagagctattaaaagatgagttataccacacatatggaatataagaggaccataaaatcagttatttatctaagctctccaattctttgtcccatctttaacttcatattttctgcaagtgtaaagtgaaatgtttttggggcctcgaatactagcacaactgtggaccctagcttgaaaccgccaatttcttggccctttgaaagaggctggccacgtaatattttactggcattggcatatgttgcctcatagcaactatttttaattactttcttggtgcgagagctactgcgctttatcaatggtgtgctttcatcttcctctcgacaagatgaagtatctgaagaagggaaacttgtttgagcatacgaatcactttcgtaaatactgttagtaaccaaatctttatcaaaattaatcttgatgcttccgacattcgtagccccaactggtatcatgctgaaaaagccatgtttccaataacctagcaaagctactctttcattcaaaatgaataagttttgcaaagttttttggaaaaaaggggctacggagaataattcccccacaaagtgacgacgcaaagtggtaacccaatttgagggtgaatgaaatcggtggtaatctcctggtgcaagataaataacagcaaaataaagttgtttatcaaaggatgatttcttcgcaatatcattcgatacttcgtaaacctgcgaagcggatgattttctcagcgattggtcaccttgattcatatacgagtggtgtatattttctccccttcctccaataatgtcatcgatggtgtaactaatcccgtttaagcgagcaaattcttcgtgtcttcgtaccacatcgtcgtcatctaattgataattaatacgatgaacaggagctgccagtttctgttgacctaaaagcgcattaatagaataagtcattcccttgacctgctcgatttcgccgttctcaataattccaaatttcagcactttcccatcacacggcgaaaccatttcagcatctatatctatgggacgagtttctggcttgatagtcctataaaaaaattctccaaggttgcgaaatttggataaatcaggctcagccacttcgtctagatttactccaaaaacgtatgcataaaacttataacttggtgaccggagccatatgggcaattcgaatgagttgaactggccccagactctgctgatcgctttcaaaggaagagtgctataagcgtaaagtgtccatgagttgggtttcacggaatggttttcatcgggctctaagctagagtttcgttgtatacctttgtgcttgattttgttcactaccccgtacaaaactactgatattgaagaaagtgccagccatcttgacataaactttcttcttcgaccactcgacttcactttggattttgcacgagaagaaaaattccgaattttcgaaggcaccgtacgtaaaatggtggcgcttgataactgcggccgtttgaaagtgtaatagagaacattccgtttgggtctgggtattcttggaaatttgtattgataatttcgttgaagaatctggtttggctgtgagacttgggacagcttactgagaggttggccaattgggcgacgcatttggtgagataatcctaaccttgtctcatatataactgacgggaaaactccaaacgatctattcggcatgttcaatgcaatggtcaatcagtagtctttttagtggctctaattgttcgaggttaactatgatgattgttgagtttgatggacagcctcgcgaaatcttttaatcgagcatgtgatctaaattatttagttagttcaaaatataagtaaaccaccctttacaagagagttgattgtagcgtccatatatacagttggctgtaccccctgctttatgaatacatagaggggttcgcctacaaaagaacagcaactcaagaaaaaacaattggatgtgtacaagaacacttgactgaacagattcctgttttgatagagaatattttaccaacaacgttcgtttaccactatattaaggctgacaaatgatttgataacaaatctttggagttcagatttttgggtccaccacagggcttcaaaaatgatttcgcaggttcactttcgaatgccggataatggtatcacagtagcgtcttggctttcggcttccttcaggagttgagctttcttctcatcaaatacacgtttttccttgaagtacttcacccaagaaacagcacaattctgttcgaaaaatttttcttccgttccacattctgtggtcaccgtctttttgttccttccgtccagggagttgatgacatctatgttatcaaggcaccgaaagaactcatcgcgtgcatcccagcacagctttctctgggatctagttggagccttctcttcttgtttcgaaaatgaaaacaatgccataggaatctagagttctttacttagtagtaggcgcgatatggtacactttctttggtatgattacgtcagcattacatggcagttttttgtggttttgacttgaattctttactaccaaacgatgcagccattcaaatgttccgcgaagtgctcaaagtcatcgtagtcatactccgtgtagtatatttctgggaggtacattgattgcttactaaaaggaaactattttctccatgaagccgttaacactgttaaatcaataagtctgcctaggttacaggtgttttctgtgtgcttagtcccacgcagtacagcacatgcagccaagaattaacgagtagtaattatatgatggtgtttggatgcttattttatcctgaaacgctcacgttgaactttcaaacgacagtcaacatgtcccatccactatttatagcaattgtaagccttgttatatttctaacagcttacggaaacagggaatttatatttggcaagtttgaaggaaatgttgtatttgactacagcaagaactctgatattttatcacaattaggactgtcagaccaaccctcaatcaagtttcaggataaaatcttgcacggaaggtttttgcatatcactgatctacatcctgacggtttctacagagtaggctcatcttatgctagcaaatgccatggtaaggtagtgaagaacaagagccagcaaaatcatactgcttcacgttatggagatgcactcagtggttgcgacagtcccattgaattgatgcaatctaccctcgattggattaaagataacctattggataaaattgattttgttgtctggacaggtgacaacgttagacacgataatgacagggatcatcctcgtttggaatcgcaaatattcgaaatgaatcaagttgtagctgatcttattcacagtacatttcttactgataaagatagagaaaaccaagagaatataatcgataattcgagccgtgatatcaaaataattccttccttgggaaataacgatgtatatcctcataatatgttctccccaggacccactcttcaaatcagagaattctacaggatctggagaaactttgttccagaggagcaattacacgtatttggccgaggtgcatacttttttgtggaagtcataaaaggaaaactcgctgtattatcattcaatactttgtatttgtacacagcaaaccctctagtggataactgtgatagtcgtaaacagccaggctaccagctttttcgttggcttggtgttgtactcgaagaaatgaggaaaagggatatgaaaatatggctgactggccacgttcctccggtaccgaaaaattatgatgaatcttgcttgagaaagtatattatctggactcatgagtatagagacgtcattattggtggattgtatggacatatgaacattgatcactggatccctctagattctgagtgggcatataattctctagcagctgaagtgtttccatctgaaagcataccatttgatttatacactggattcccagaacttgatattaaagatgcagacggcatgtcacatcgttatgacggagttcctgttggaaaggttaggtacatgaactcggtgcgtgaagatctctacgcccgaatagcagagagtaatgattcgggtatattctctgatcgatattccattgcacatgtatctaccagcgtgataccaacctacaacccaggaatcagagtttgggaatacaacattacaggcctggttgatgaagatgaaaagagagctgagattcaaaggcatcctccatggtcgactttttttgaagatttggaggtggaaatggcggaagatgaggagaccgacgaatttgcctttcctacaaaggacccttcgttacccgtgaaaatgccatcaaagacacctcttggtcctgcctatgtttctcagacattctctcctttgaggtacgtacagctctttgccaatttgactgccatcaattcaggtcagtccccgttccagtatgaacttgaatataccactgatgactcaccttaccagatgaacagtctgttggttgatgattggatcaagcttggtcgaaaactaggtgcctccacggatgatcaatgtccctcgcaatataagcacctttggaagagttttctttcccgggcttttgtccagacagactacgaagatacaggaatatagcttgcatatttaagttcagccgcaatcgcaactgcgtcacaaaccgcttttgctgaaaattattctttccctgactatcgactatctgcgacactagagtcgggaagtattatgtcagatgagcatcttttgaatgtccaagtcgaagtggtgcctttttttgatctttttggaggctcctgttgcgacactggtagcgtggcaaaaattcaaagagatgttgagtcgaatgttccagttgatttcgaaactttaattgactatgagttagaaaagtggtcaaagtataatgaatcatttcagcttattataaatacgatgttcttgtttggtttgttcttgttaacaatgttaattattggtgcgtttatatatgttgtgaggaaaattttgatccaaggccttcaacaatgttcttccaatcgctccataataaatcttagtttgccccacggaaaagatagagcaagttgcaagaatcgaaatcagtattcagaatctagtgtaaccagttcattacattctatgctcagaaatcaactcatagatgctgatctgcaacgtcatcttgctgtctctcaaaagcaacgatctaggttagtacttgaagaagatggatctattgatgggtttctactcaatacaattagacaagaaaactctccaaccattttatcttctaacttcacggctgaagatgaaatctttcgtagtgcattggaaagaacgatcacagcctgcatatcaacgtcaaaagagaaggaaactgtgcacaaagctgaacaattggctaagcctggattttattacgaccgtgcaccttcgttatttccaatttcttcttctgattgtcacagtcatgatcttattttacctcgacacgaaagccctcgggaaaccaaagagctatcatataaattacttgatcgaaagcaaagaattgtttacagacctggcgaactgggtgggctctttccaaaagtacaactacaaacatccaacgatagccttgatctcatctctgtactagaaaccctgtttccttgtagcattccaaaatatggagatcttattgaaatagacagaatgcttactgaaattcgactacttttgatgaatgaaattatcccccggcaaccaatttccgacaaggccactcgacgccttgcagctgtgcggtttttatctctatctttgaatatcaagcaaaaccaaaatccatttatattcctaccttcctatcataggttgattcagcaattaatagatacaggggcaattttggatatatttgatatatgtcagccgctactcacgcacgccatcgtcgaaaccattacagagtactgcaaagcgatgtggaactatgacaatgaattaacagacaaattccaaaactactttaatgcatcgggacttagaccaaccctgcaacaaccatttcaatgtttcaaatttgtcataaatatggagctaacgttgatcaactacactaaggtaagaaacgctttagcgaattatgcagctaaaagccccaccaaaatagacaagctaattgtaagggaagcaattaaactgtccaggaatgaaaaccaaaggatttttttttgccaattaatgactatgatcaggagcaaaaatgggagtaattacgattgttttgataggtctgatatctctggaagccctgatagccctaaaacactgactcgcaagaaggagggtactattcttggtgaaatagcacagaacagaagtggacttcctggtcatatttaaagtcacctctctctttctttttcttaatctttcttcatatttcgttgcttctcagccttctgtaccactttttcatccacaaagaggcctttttttcttctgatatcattcatgtactttcttgcaatgttctctctacttgaaaattctccaagctcttctagttcgtcttcggttgtgggaacccaaaagggatcgatatcaactatctcgaaccctgagaaaactagctgtggtgaagctgctccagaggtcttttttcttatatcctcactaaagccaaaggcttccaccaatggaacttgagccttaattgtgaaaaaagacgtgccctctttcatctcttcagaaactatgcgtcctcttcgctgttgaacaacagcgtacactttacctaaaacttcaactgaagcttggatttcacaagagtacatggcaagcataatgcgtggtgaccaatcaagaaatccttcatgtatacaatctctggtagaggtcaacaaacggcctgttaagtcgagttcctctttactggtggtattcaggtacctgatttcatccaaagagaccagaattccttgaacaggctctgcggctagtggaccttcagatgttgcaagctgaaaaccattaaacagagattcttgaaactcgaagtagctaccttgagatgtcttgaacattgatttgaggcttccattagtgttatccatgaaaatattagggccccttcccttcggaccaaaacaaacgattcggtcaacaaaatccgaactagcattcgactgtattgatttatttcccaattcttgcaaaagattagctaaatggcccttgaaagactcagtagataaaaccgtactctggttaatttgaacatctatcatatcattgacttcctcatcagtaaaaaagtcggttctctgatttatgatctttgaaatcgaattaatgttggatattaagaattgagccacttgcactggcaaaggtttcacagtaagagttatttcaaaatgagagagtctcaaaactcgggagcctctacctaaggtaccattcttaggtgggttcatgtggttcgtgttttttatggtttctcgataagggattgcaggctctgatacctgaatttcaatgcctgcaaacctctctttcaaatctttgagacatctttccagatgtagctcacctgcagtagctaatatgtgctctccggtgtcttgaagatatgttcgcacacaaggatctgcctgatttaacatttccaagcccttttcaagataatgcatttgaacggggtttacaggttcaacggcaacccggactattggcagtgcagatgacctgaatccagccagattggttccggtaatattgggcgttaccactgtgccacttttcagaactttgcccatcaatccaccaatagcgacaatgttaccagcaggcgcttcgtctattgcaacgaaatcccggcccattataagatacaaatcagatatgtgaacttcggaaacatgcaatgatggatatttgggagagaattttgggccaagaacagaaagtgtttctcctactttcaaagtaccgctgtagactctggcaaatccaagcaactcttcctttggtagatcaacaattatatcctcagtactttcttctccattgccccattgcaggctaacatcgtcgccagcaatttcggtcaattcaacgtcagacatgctcaagggtgagttagacatttccttcccgtttgcagcaatttcaagtagtctagcccgttctgccatctttagtgccttttctctggcttgccttccacgtatctgctgttcttcctcggacaattgaactacttgatttctacccagctcagcaataggaatactgagcattttagaaacatatgcacacaccaatccttctctattgcacgatatgatatcattgctcaaggcagcatcgattaactccgaatggggggtagttgacaaaagtgatggcattctcttattctgagcttcaacgggtgagggaaccttctgaataacagtcaataaaacagcagatgatacaggtaaccattgtgaaagtattgttcttagcaaagctctagaatccttggctttaaaatcccgtggacctactttgacctctaatgccttaacaattttttcaagtttcgcttggtcccttgtttccaaacagtgctcatatactgaccaaatattgtccagaaccaaagacacaaatataggtttaaggcgtttctcgtgtttgttcttctgagtggtaatttttttacttttcgggtccaaacaaaaatcaccccagataaccttttgtagtttttctctcttcattcccagttttctaccaaaaaatccggctatttgagaaatagaaaatccccagccatccattgcacttgcaaaaattacgttattggtttctggggcaaaataaatatccttatcatctttctcagcaaacagttctccagaactgttggcaatcttttctctccataaaaaatcttgttgcattctctctccagcaaaaaaagacccgattactgaattcacctgctcaatgactttacttaagtgagtgtaagcctcttgtggagacaatttcagttcggtgattaaacgatcaactttgttcaatacaagaatagctttcaacttgtctgaccaaacttgtcgtagcacactaattgtctgagaacaaactccttccacgacgtcgactaatacaactgccccatcacataatctcgaagctgtactaacttctgagctaaagtcaacatgacctggagaatcaattaaattaataagatgttcattgactgtgatatcactatcagaatcaccctcatttctgtgtatcaccctaaaatacagcgaaacagcgctactctccattgttatgccccgtaactgctcatcctcccttgagtccaagtatctaatcttgcccgccattttgtgtgagattatgccatttgtcgctaagagactatcgcttaaagaagtcttaccatggtccacatgagcaactatacatatatttcgaacacaatcggggtcattttgaagagtgttcagttgttctttagttaaccgcatagttaccaaaactcggtaacgaacaaatggtatcacgctcctccaataactagtaaaaaaaaaaactaatccgcgcacaagcttaaatcgattatataatgatataccacccaggggcaattaacctttgaaaatataatgatttctatccaattgcactactaggctctcggttatctttttcatcaaaaaatccgtttgtccagggtacagctccatctgtgttagagaccgaaaattccaagtcttcagttgtaatcatgtcccaatacttgtacagcatcatcactgcgaatagattgcaaagtgtaccaaaaaacagtccatcaaggtaatgattaacaccctcgcaaatctgatttgaaaaacgatacatgagaacctgtgctgcagtgaaaaagaaacatcctaacatgattgcacccaaagcccaccagtttttcaaaatagtcagtataagaatgatttgagagagtacgtaaatgccaatagtgaccgcattgaggaagtacatggtcacgaaaagagcgagtgtatttgtgttatcgacaattgagttactggaccaattgtgaaaagtgaaaagcgaaaggataaagttaagggaaaaggcacataaagcaatcaatctagtaaagttaatagattttcttgtgccatcttcccaaaactgaaaccccagaaaaccattcagcatcagagaccagcagcaggctgatgccaggccaatttgaactgccacgaagtatccgtatgttgcactgctgggtggagaaacaccagcatcaacgaccaatgaggcgatggtgttggcaatgtacaggtagaaaaaaaaagcatttcgatccttccaattgctgtgtatttgcttctaacatggaacacaataatcatcaagacgacaatagcgctgatgtgtataaaacagttccctacctggaaaatcattgtgttggttaccgatatacttctagcgtaacaagtagaaataattcccttgaagtttgtaccgtggttgggcagtaaaacattacacagaggtaatggagttttttgacaaatctcataaaagttcccaaatgacataacttgtttcagttaatgagctacttctatgccttcgttataactttatatatggttgtcaaattcctcgcctgaatctgaaaccaagatatattatatacttatgtaagcatccttacctctgtcctgcttcactttttatgtacctcagccaataaaaaggcgaagactggatcaactcctctcttgaaggttgatctcaaattaagaaaacataatgttatgttggctggtaacgttgtaactttccagccgagttatcaaattgacttgccgatagaacatagtttcagccacatcttcttcgacactaaccaaataggcgcgagcaatgatagttcaaccccgtaatccagccttatcggatgctatagatagtttcatactatttacaagtaaaattcgtttcacattgaatcaatgatattacacacctatattattctctcgttattgactatatttcctaaagctattggtctgtccttgcagatgccaatggccttggaagctagttatgcctcattagtggagaaagcaaccctcgctgttggacaagaaattgatgccatacaaaagggtattcagcaaggttggttggaagtagagacaagatttccaactatagtgtcacagttatcctatagtactggcccaaaatttgcgatcaagaagaaagatgcaactttttgggatttctatgttgaaagtcaagagttgccaaactaccggttacgcgtgaaaaggaacaatcccgaagttttgaaagttgattttactaaacagtatagcgggtatttggacgtagaggctgatgacaagcattttttttactggttttttgaatcgaggaatgacccacagaatgacccaattattttatggttgaatggtggccctggctgctcttccttgactggtctctttttcgaattaggatcgtctagaattaatgaaaatctgaaaccaattttcaacccctattcgtggaatggtaatgcttcaatcatctacttagatcaaccggtcaatgttgggttttcttattcttcatcatcggtgagtaacactgttgttgcgggagaagatgtgtatgcatttcttcagcttttttttcaacacttcccggaatatcaaactaatgactttcatattgccggtgaatcttatgcaggacattacattccggtgtttgcagacgaaattttgagtcaaaagaacagaaatttcaatcttacttcagtcttgatcggaaatggattaactgaccctttgactcaataccgatattacgagccaatggcttgtggtgaaggtggtgccccgtcagtactgcctgccgatgagtgcgaaaatatgctagttacccaagataaatgtttgtctttaattcaagcatgctacgactcacagtcggcattcacatgcgcaccggctgccatttattgtaataacgctcagatgggaccctatcagagaactgggaagaatgtgtatgatattcgtaaggaatgtgatggtggatccttgtgctataaggaccttgaattcatcgatacctacttaaatcaaaagtttgttcaagatgctttgggcgccgaggtcgatacctatgaatcttgcaattttgaaatcaacagaaactttttatttgctggagattggatgaaaccttatcatgaacatgtcagcagtctcttgaacaaaggtttgcccgttttgatttacgcaggggacaaagatttcatttgcaactggttgggtaatcgagcatggactgatgtcttgccgtgggttgatgctgatggttttgaaaaagccgaagtccaagattggttggttaatggaaggaaggctggtgaatttaagaactatagcaacttcacctacctaagggtttatgatgctggtcatatggccccatatgatcagccagagaattctcatgaaatggtcaatagatggatatccggagactttagctttcactagggtcgctgaattgcaaatatagtcagtaaattaagccttggggtgctctttattgcacgaaaaactaatactttcaaagttgaccatgagactgattattgaatttatattgctgaatctgaattattgaaattacactattgttacttgtgtaaccatgctggtctggactgggcttgctgagtcagtactgtatatcgtacacgggaagatctgacatgtttgggttgcttttgttcattgcagagtaatacattgggcaagccttatttgttctaatgtgtcctaacgcaccgcatgttgcacaacgtctactcgtggacttaccttttccgatacctttaccactcagtcttgcatcagaatcagtgttgctcaggctactaaccactggtaagccttcctttaatttctttctggcaatacgacgttcttttgacttttcaagcctttctaattcttcttcaagtatcttttttgctcgtctattctgttcctcgtcattagtgaaagatattttctccgcatcaatctcggccttttcttgttcctgtttgcgttggatataagcagcaataaccttctgatcagtcactaattgggtgcgacgttggagtatcccattttgatcccgcaccatccgggtaattttcatatgttttttttctttaatagatgctggttttacagatgaaactgttgtctgtagaggactcaacacaaattcttccaaagttttcgccatttcagtgatttgattctgatcatcgtaaacgcttgaagcagttggtgcctctgtaggtcctagttctctttccatcatgtccgaagtcttgcttagggctctctgttgagcataccaaactctggaaatttcttcatcatacatcttctgttggacagcaacattataactgtgcccttgtgattttttgttatccatttgttctgctttttccacaatatcttccatgctagatttgaagccacctttcatggagattcttaagaaagaaattgcttctcccttctttgagggatcacctatcccgtgtacttgcagcatagcctttccttgagttgcttggataaaattcttagtagtgctccatggagccatttgaacttgaagagcttcttctgtggttgctgttgtttgtccaatcagtgtctcttccctcaaggaatcgtaatcctcaagattcaactgtccaaattgcatagcttccagtaaggcaatatcttcgggctgtatcatttgttgaatctctttgaatccaggaagaatttcgttccccttgattttccaaaacccgtgatcctctccgtttttttggtattccatgaattcttttagcctctgtctattttgcatgtcattttgatcaggaaagtgaattgaaatatctttaaccactagtctatgtctctcatttttatttagcactcgataaacaatcattttgagtctgttttttgaagtacttgtcaccttacgagaatgtggacctggaacatcaacaacaggaaacgtttgtccaacagtaaaaacatgatctaagcttcttaaaaagtaccgaggacttattcctcctccagagcttctgatcagcagaaaatctgtttcttctggctcatgcctgaaaatgggggcgcggaccatattgttgtaaaatgtgggcacaagatttccaggttctacgaagccaaagttccaaaacggtgatctatcttgaacacctaacacatgggtttctcccactggtagttttggcctgctgttgtcatcatcgttaagttttcgataataattgattaatttagagcccattccaaaattagaaagtgctactggctgttcttctgaatactccagtaaaaaaaagctggctgaatcgcccaaggtgagatcaactgactttttaaacaattctttggtttctttgcccctatctttcttcttttttctggttttaatttttgaaaataaaatagttgagtttgggcgagaattgaataccgggcgatggaatcgacgtaattcctgcttcgaaagcttaactttgtaaaatggcgtctgcaaaattgttgcgggtatgctgtggtcaatggagagattgcctatagtcgatctaatcttggattgataattgtcctttagcatttgatactgcatgtcgtttgatatgttgaacttcatttcaaacgacttcgaattcataggaaaacgagcattcatttttccagctggtgaaggtttgtgtttttggttcaaaaataaaaggtgtggatcattcatatcaagttttaagttcaatcttgaagtgtctaatgtcccctcaagtatcatatccgtatccacatcccagtcatcgtattgcatctgttgaaaatttggttttgtgcgattgcggttgtgcctttcctccaatttgtcacttaaaagctcagtatcatcccaactaagggtggagagtacaatgttacgatctaaatgctttagtgtctccttttgtttccttggaggaatttgagtattgttagattctagttccattagttcaatatgcttcactgattgggatcgcttatctcctttcgactgatgtgcactaaagctagacttgaaaatctttttttcatctgggtcaacttcttgaagagccttcagtggtaaaagtggtgtgcaatcacggccatcataaagttgaaaacttgcaagtggcggtggaaacaaagaagaaaaggatataggtttacttttttggaagcttggatagtaatacttaagcatttgagttcggatcatagtcttctcaagatgtttcacgaaatgactattagagatttgattacactcattgcgttctgaaattgtctcgttcaagccaatgttattgtcaaagttgggaactttaagtccgcctattgtaggtaagggcaactcggttccttcactggcctctctttccaagtttttaaacaataggtcttccttttcactacccgacaaattcatttcatatgtaccttcaggaggcttatgttcatcatctacgtcagttctcctttgtggtgcatctccaacctcttcgtcggcaagttcttcttcatcactgaaatcaatcgcattatccgcatgtttggttgttccatcaaaaaattggtcgaaacctcctacttggccgttcagtgcgttgtcaaaatccacatccatctttcattgaggaacgttgtgttcctgacttcagttacatgtcgtggtagttcgcgaatcaagtgtagtaattccatggaatgctcaaaggcttgaaaataataagccagtaggtatactagcaagagaggatacagatcagaagttcgaattcatttctctagtcacaacgcaacatgtccgcaaggtttactctgtatggccagtctttactacgtaatgcaaatggggtcaattttttggatcaggatcgccattggggacgtgactggatatatcctcctagatctattgcaccaccagatgtcataaatggttcaccatccaatattggtaccccaatggagtcaagttccaatactcctcagccttctatttataactttcaaatcaaaacttgggtaatcaagccaaatgttgatcttgtggaagacggtactgatgttgattttttacatctttcagaatttgaatacttcaaagagggcaacaataatcatgaggtgaagcaaaatgaagatacacctggtggcttaacggaagcagatatcagaggggcagttggcggagtgggtcaaataggattcggcagtagcgccgccaaaccagagtaagctatattatgacaagtgttataagtacatgtagtacgagccagctcaatttagatccataaatcgataactgatgccaattgtagttttctatttttaattaactgactacccatcactattccaaaaccatttgttgacatgctagttatattcctttgtccacgacctgtgctattacgcgacaacggatattttcaaagttggtttcgtcgaacacattgggatgacactatgggatcagttcaaagctggcacaggcaaagaagttagttcagcacctattgagaggaccctactaatccttggaggatcatcatttgagcacgttcaattgataaatcatttgaaagaatccaccaaaagtgagatagggaatttcagcgatgttagggagagtcaaacttctccaattgggtttcacttcgttgaattcagagacgaagaacatgtattgacagcaattgttaacatacacaccattacagatacttgtattcatcgagctgaagatctaataaacaagttcgccagcaataaaaatacagtggcattaattctcttggacagcaataaacttctcaatcaaatattggacaacaatgacactcttgcattggatgcactccctcattggatatatatacttaataaaggttttggttccaaattgccaaaagcagagtcgagattactggacaaagaggccgaatgtcagcacaaactggtaccaagaaatactgcacatgaaagagcattgtggttggaactaagggtagtcattgttgtattttccgctgaaattttggattatatgacgaatacaaaagttcttgtacacaacagaacaatagacactcttcaacagacgctgcgactgatttcaatgtaccacggatcctctctatactattggaattctttatctactagcgaggttcttcaagggcacatctttcatattatgggcatacatagtgctactgcgtatgactctgccatttttgatagcctttcatcgatatttatcccgtatggatgggattcaattaacaaaattgtagctattgataagacccgaaatattcaagatttcaacacctgttggaaggaaagattggttgcgccaggctcccaaacaagtattactctcaacagcaggatgcacttttccatcctgcaggactacaagaaatttcttaaaaaaaggtgtcaatatacaaatcttaaaccctaattttctaataatctgacttcattccaatttaccaaagctagtcaaagaagatgctgcactgtaacagagctctgaagttaatagatcatagtttgaatatttggtccatcacgcatttgcaggtagatggatatctacatcttgtagaaaaatcctaatggtggtgtaggttagtcattaaggctagtacgttactctggagtaggaaccatgtgtgtgcactgcatagcatatagcatattttctagatcgcacaaaagaatcaactagaaagaggaactcaaatctccattcagttaccactatgaaaatcttcaacagatccccctcgggtcatgttaccatccccactctgtaaaaggttgaagctcggggttcttcagtcaacggcatttagagtattgttcgattgaagtgagtcgaaacattagcagatttcaaatccgggggctctctcaaaagtggtctttttgttcatcacagggctcatgaagatagtcctgaggaattgaatacccaaaaaaaaggagattaatcacaccaacttatactttaattgatgaattgtggcagaactcatctcccgcaccctattcagtatcaattcttatagaggagatagtaaaaaatttgaggagctcaaggaacgtcacagcaagtacaaaatgcgaaataaatctgtgcctatttcagcaaagctgggcaagtggaatgttgcggacgaattagcattccaagcatcgttgaaaagggcttcgaaaacattgacatttattactatcaaacagaattggtgttctagtatttaaactccagacagccatttgtaatatctttagatatttcttaccttgccaggtagtaaacaagcaagtgtatctacagattccctctaaaagctccaaatactaacaccttcagtttcatcagttgtgactcacatttaaattatttctaaaactacttcccagccttgacatccaggatttgatggactttcccaatatgcgcaatagccttgattcatatatatgcctcaaacgcgtaatttatcatgcaacaggaaaaatggatacaaaaagttttccctggtatttacttatcatcctctttcaacagccagccttgagttcctctataaataccgtaaaatatcaatagacatcctcccatgcgcactgacctcttccagagcataggcgttcgaccagacacttcccctgcaaaagcataccctgtagccaagtaacttccggctaccaaactagtggcagtcgctaacaattggcaaggcaaacaattatttatgtgttcgtcttctaatttcttctttggaaaatcgggactaatgactttgagaatgtttgacatgatacaatgtctcggcgagtgaaggagtgagtatactgtgaagtttttctcgactagcaaaaatatggtaaccaactttaccctaagtttttattcacttccactttaacaaagggtatccttagtagatttatcactcctttaatgattaccatacataagaacatagtttgcctatagtattataaaacagtcatacaggagttgtatgcagctaatattctatccaaaaagagatattgttctggcagacacatagttccatttctatttatagattcattccctttcattgtcaaaaaggtagcatttaccacttgcagaaccaccaaccaaccaattctgggttggatggaaacaactgacagcaggaacagtattcattaatgcatgacgtatattacccacttgaattccatttgaacaataaatatcgaagctacgattcatatttgcaataataaacttttcaatactgtctgaaggatttgtctgccacttggccttgaggatagacacccacctaccagtttgacagttgtgttttagtatgtgatctggaattaagttttcagcagcgccatcgtttgctggggttttgttgcgctgtgacgaatagtttgatcttggtaaggatagaaaattcttgttattaaaaatgctaatctcattggcataaccgttacaaacgatatccccacttctgttccaatctgtaccgcttactgatagttttgaggtaaatgatcctaggcatagcggggaaggataatgctcttggtcttgagataacgatactgtgctgatctttcttaggtcccatacccgaagagatctgtctaatgaagcggtagtgaattgggaggataatgatggattgatggcaaatgacccaattttcttgtcatgacacctcaggactttgaaatccttggtcgattctggtgttctgagatcgtgctgaccaaataaaccagacaacgtagtaaaataataaacatttggactgacaaagttgatatcagttatcccctcagctgttccgtttacgctgttaaaagacataatattctccgataataattttccgagattgagacatctcaccgagccatcatagctagcgctgtagatctttttcggctcttcaggattgacttggagtcgactaatattctttccatgaagttttaaataggtgatagcgggttcataatcctcataatattcctcgcctaaactgatcactttcttatcatctgtgggccatattccaatctgtccggttttatcaccaccgattacaatttttcggtctacatatggatgaaactgtatggatgtcattctttgactcgtaagtctaatcttggaagggtcaaatcctttgaaaaggttgagagaaccaagttcatctcgcagagatgctatgccctcgttgccaaaattctttcctgcttcacgttcaagtgctgtcctgagataatctttaccgtgaaaagatttactcaatctttcaactgtgtcaggctcgttgccaaaaacatcatttaacttcaaatcaccctcaagacgtaaattgtcggagaagtcagagtctccccaatctctcttttttgcgttttctattgagagattgaaatcattttgactatcttgtagctttaccccagctattcttcgtgatctccttacagggatatcagaaattttatcttgatttctcttctctttcttaactttcttgagaagattcgttcccttatttggagccaattcattgtaaaagtcacccttaaccttttcaatcccaagatcgtttagcaataactgattccttgcgatgttagcttgcctcttcctctctaactctgaaataggcatggcattagttcgaaataaacagaacattgacgtgcgcgccgtctcgtactatacagatcagtcagagaaatcactacctactaagcttgttgatgcagctggtgataaataatgtaaagcaaaaaaacgttgaattgttgaattacttagtgagaatcctccttaaataaatggtatagtattttgcctaaccttattgacactataatcaccacaatttcgaaaaacatctaacagatatggggcagatggttttcacaacattgctcctttagtacgagctcctgggtttccaggttttcgccttgagtcttacttctcaatgggagtaggagaaacgttaaatccagaaaagaggtcatttagctcattcaactcatttatcccaatggagttggatccagataggccatcctcttcaatgtcatcatcgaagtcaagtagatgttctgcctttacggtgttatccattatttcttgtttggctatcaactgcaattcttcaatccttctcgattgtatattgggattgagatatcgattagtgtcatcagtattgacgaaatctcttcctggcctttcataaacggtgcttaacatggatatctcatttaccaattcattcagaacgctcgttggaaaaagaggtattattgtgtcgagtttgggaagagttgtcaatataacttccttctggatgtgttcttgctccaatgaaagcaatctccaatatataaatgctttatctctcacatcagaattatcaaccttctgcgtggcgtattccaaaacttgctgcaaaacttgttgagtttgtgcagtaggcttagacaaatgacacttgcaaacggtggtcaggctgactagttgcacagaaggatcagcttcaagaaaagtctcagcaactctttgaagtttagattctagatgaggaatctttgaagtatattcgccaatgatccatatataagaagatatcgctcttggattgttaaaatcttggatactcatgtctgcaatgatcgggataatactactagtaaactccacgggatacctgcgtaaaaattcctgtagcaccacaattgcttggtcgatcacgtattcaggcctggatgctactatgtcgtacaaaatatcgacagctttttttgatatggaaggcagtttaattgagatttgcccaattgcctgaatggctctatcaacgaactgttgatcaaattctaaagcgtattccttcagttcggataagagtagagtggcattggagtcgttcactagccttataagaatctctattttctctaatttcaagtaaagcggatcgctgtatttgcaaaaaaagactctcaattctctggacaggatcgtgggatacttttctagaatcactttgatatttttgagcccaacatactgaatttctggtggagtcgaaagtaaggataccaatggtgaagacaattttgcaagcaagacttgcttcgcctcaccttcaatttggtcaatgtttttgattatgaccttaactgctgctaaaacaactgcaggattctcatgctgcaattgtggggagcatctttccatgatatgaaaagcgtcttctgagtttgtggactcaaaatcggccaggcaggttaatattgtaatccttccccattctgtacattcatttaatgtcattaataactttcttaacaccacaggtgaaagattcaaaacttttgaatcattgctgaaccgggaaatttcaaccagagacgaaattgcatttgcaacaaccatcgggttactatcatcaatcagcgcaacaagcctgtctagaaatccctgctctatgcaggaatcactatgcaattcaaacaatttagcaacgcagatcgcagctgttttccgtacatacggattagtatccatcaaggtctttttcaacggggttgccatgtaatctaccattttatccactctaatacatcccatggtcctgatagatagtgccctaactaatgggtttggatcctcactgtctttaacaaaggtattgacggccaaaattgatagttcagggtttgtttttgcatagttcatcagataaagataaacaagctttttctgttccaggtcatgtgttgcaatattctttaaaacatcaggaaacagggaagatacgtccttccctactgtcatagcggctataactcttcgaattgattctttcctttccatagcataattagaggctaggcccgatttgagttcaaaagtttcacctttacggggagacgaaaatagattcctcaagcgcttttccagctttgacatatttgacgattgtaggaatgctgtttgtttcaaaaaagccttgaatattgttgcaaatcttcttgcaaagttgattgtagtataatcctagaaaagtattagttcgagaaaagagtccattctatatgacctttggtaaataatatcaccttccagattatcttaatgttacatactgcaatttagtaaagaccacattttatactatacacagtttatcgatgtagttactaccaaggtgcaccatcactaaagaaaaactagttgaaccgttcttcacgtagattttgtcttgatgaagcagttttggtttccatttttttattcgctgctatttaatattaaaaggtactgcaactctactaatcaaagtataaaggcatctgagcgtagaaacaatgccaatagatctaagcctaggaagagtgacccaattgcttacggtactgggaaatccccaaaaattttggaaatgtattcatgttgcgggaacaaacgggaaaggctctgtttgctcttacctttcgcatatactggagtcttctaatatttcaactggcagattcacatcgccgcatttattttatcctaacgactccattaatattaacaatcgtcctattagcagagcaagatacgattatgaatttcgaaaggttaaggaactcaatgaaagagagttgattggagcgacagagtttgagctattgacttgtactgctttttacgtttttgcccagtttgaaattgaagttgctgttgttgaagtaggacttgggggcagactagacgctaccaatgtgattcccggttttgatggcgaatggggagtattggtatcagctataactaagattggtttggatcatgaatctttacttggtaattcgctgactcagatagcaaaagaaaaggcaggaataataaaagaatccgtaccatgcgtcatagatggctccaatgataccgaaatccttcgagtggtcaaggatgtagcttttcaaaacaattgcaagctttttgagacattccctcgccgagcagctgtttttgatcaacaggtaccgctattaggcgagttccagaaatccaacctggcggtagcactcaaagttgcagacattctaaggagcaagttcaactaccgaattacggagcaagccatcacaaatggagtacgtaataccaagtggccaggaagattacagagactgacggcaacaattcgaaagcaacgtttagacctaattgtggatggcgctcacaatggacaagctgctatcgaattatccaaatatcttgatacgctacgtaccctagagagcccgctgacttttgttatagcagttactgaaggaaagacactaactccgatgctagcgccgctaattaagaagcaagattttgtaactgtaactacgttttcttccgttgagggaatgccatggataaaagcgatggattgcgaaattttagcacgggagataagaaagtttacgtctaatgtaacggtccaagaatacctcgaaggagcactcataaacgcagcacagttttctcaatcaccaactgttccattaattgtatgcggtagtctatatcttgcggcagatgtcttgaaatttgttgaaaagacatcgattccgtaaatgcctgaggcgtcaatttcactgctttgtatttctcactttgtttcccatgtcttttcctttaagaatcctcctaacattagtagcccatcgttttactttagctttagtattttcttgcttacaatctttcaagaacgggtgcctaatcaactcaattgggttgggtctctctgattctttcttcagacatagattgacaaaatcacataattgggatgaaaacttctctggatctaacgacggaggcttttcattaaccactctttgtaagagatccaagatggaatcaggtcccatggaggaattatcaccaaatggaaactttcctgtagccaactcaatcaacattaatcctaaagaccacacgtcacctttaaccgagtatttgcctccctgaattcgttctggagacatatatgtggaagttccaacgaaagtttgggcgatggaattaatcaattccctgctaacaccaaaatcacaaagcttgacccctcctttagagttgagcagaacatttgagggcttaatatcccgatgtattatcttgtgactgtcatacaaataattaagcccacagagagtagaaaatgccacatgagccagaataaattcctcaaaaggtccaaccagtttcaaaactctatcaagtgatccacaatcgacgtattccatgcaaatagtaacgtcgccttcgtgcaagaatgctccataaaagtttatgatatacggactattgcattcgtacataattcttagttccctaacaatctgagtcagaacagtcttcttagtctccacatgtatcactttacgcgccattgttttcttggacggtatatgcaaaaccttactaacagaacctgagtttccacttccaagtaactttaaagtaagcaaatcgtcgtgacttatgcttagttggtattcaagacccaattcaagattttggaagctatggaccagatcattggaactaattatttcggtatctccatcatcagcatgaatattattctctaattgtaatttcttcaagtttttacgcttcaaagttttagcttgaaacgtttttgtgctttgaggattcaacagttcaggcgtcattttagttgtactgggtatagttgtactagttacttgctttctggtggtagacctgccaccttttccttcgttttcctgtatggtagaggtctcatatgttgggctgaactgttttatttccaaatcagcatatttctggctggaaactgtcctaataggaatatttgttgaattatctttgtttcccatacaagctgtatattgttactaatttacgtaccatgcctctcctatcaaggtgcgaagtgtggaatactaaattgtgtattatgtaagcaagcaccaacataggaagaaacaaagaaactacacttgcggatcacatggaaggtagagagaggaaagggaaagcgggtgtattgtatgtattagctgtcaaaaaaaaaaataaaaataaaaaaaaaaataaacgcagctttccacataaaaactaccttgacatcatagagggatctaaagaatcagctgataaactaactgggattgtgaaggatagaggaggacagatagaagagatagtccctctgaatttcaaccgtaaacaaaattgagtgaatgcaaaaagttcataacttcaatcacaattaatcaatcaatcaagaaatatgaagagtcaactcctatgtttgttctcgtgctgagattggtcgatcgtgaccagaggtctcgttggtcgagttgtaagtaaattgagggttgccctgctgttcagggacaaccacgccatcgaaagatgaattggattctgcgctcaattgactactctggtagttagacaagggaaacggtcttggaacggcactagtatcacctgcaacgtaaagagacttatctatctctgatgggataggtttgatctcggtgcccaactcttgctctattttgtacaagttaaacctatcgtcccagttgattaagttgatggcgataccaaaatgaccaaatctaccagacctaccaatcctgtgaagataagtctctgcgtttttagggaaatcaaaatttatgacaacattgacagcttgaatgtcgatcccccgtgtcaaaagatcggaacaaactaagtttcgaacatggccttggcgaaactcatgaaatactttgttcctagacgcctggggcattctggcatgagaataataacatgaataatctaaatctgtcaacttcttagaaagtaattctactctttttgttgagttgcaaaatataatcgactgattgatctgcagtttggaaaatagggtattaaggcagtgaagtttttgcttctcttccacaaacgcataatattgagtaattcccttgagagttaattcatccatcaaattaatttcgtaaggcttatacaaatgcttatccatgaaagatttgacagtcagaggaaacgtagcagaaaaaagaagtgactggtatgcgttagcaccacctggcaatcttgaagggaaaaaggttattatctgttcgataacatttctgaactccctgcttaacattttgtcagcttcatccataataaatgtcttgcactggtcaaattctgctagttttctgcttgctaaatccaaaattctgcccggtgtacctaccagaacgtgaacagggtcgtttagtctaatgatatcatctctgagtagagttccccctgtactgaccataacctgaactcccaaatgcttccctaatgtctttacaacttgcgaagtttgtagagctaactctcttgttggaacaagaatcaacgattggatcttattcattttaggcttgattttttgtagtgagggaataacaaacgacgcagttttaccggtaccattttttgctctggctaatatatctctgccagtcagtgcgatcggtatactctcctcttgaatgggtgagggcttctcaaaccctgcttcaaatatccccattagcaattctcgcttcaaatgaaacgattcgaacgagttacccttggtattgagtacatcatcagtttgcggccttgaatctctctggggaagattaagctctttcttccattcactcatttctacagatttcaatggtgcaatgaaaaactaaaatgttcctacttgaattcgtgtggattaggattagaacatcgtcagcatccaattgtccgcctcgaacctagagcaaattgagtgctgaacgacagaggcaccgttcgagtactattatgtaatcgttcaagtgcctcttctcccctacagatttttgatccccgcaaagacaatcaactggttaattgaatcttttaaggctgtgatttggctcaattttcaatttcgcagcatacaaacaataagtccttagcatgcaatagagtcaagttcacagaatcatttgtttcacaagtctgcatatcccagtcatgtgattaaatgtggctgatcgaatcaacctttatagttcaaccgcaggtagggacaacttgaaaagtagaatagcataagccggcatccgcgtttgcagcacctaatactttaaagttaggttaggtgcttgcaacatcagatacaaaccagctcttttgatatctttctcttttgctcaatatgtaattctacttccaaatttcgtgccgacgatccctttttacaactttcacgtgtcatgaggtagtaactaatttttgttgcacttaacaactgtggattcactcacattgcatataaagagaaatcacggaacacttgaaaattggtttgaacaaagatgaccttcggtgtacaatttcaggtgaagagcgtcgcaattattggtgccggtccttctggtctagcagcactctatgaactactgcacacttctagggagggtacttcctccgtgggcggtgcctcaagtgagagccctgctttcgaagaagtagtagtatttgagcaaaagaacaaaagtggaggaatttgggcaccatactacgatgatccaggatatctcctgccaccccaggatttactggagacttctcaatataacaatccagatgtgatccatcctaaagtgaagcctccaaagggtattgatgaagctacatttgaaaagccgattgaagttgaagttgctgatagggaacagaaactccaatgggccgctagtggtgtatatgctgatttattcactaatatccctagtagatttatgaggttttcctatcttccaaatcctcataattctaaggaaaacaatatttacccttttattaccaatcaagaggtagaatctagactgaataacctcataaatgaaaacgatctggagaaacacattcgattgaattctcatgtagatagtgtggagaaacttggccaaaaatgggttgttactgtcaaagaaacgggaggtagaaaagctaaatggtatcgacaatcttttgacgcagttatcgtcgccaacggacattatactgtcccctacattcccaaaacacctgggttggcggagttcaacaaagcccacccaggttcaataattcatagcaaggcgtaccgggatccttctatatttgatggcaaaaaagttctgtttgttggaggatctataacttccttagaccttgtaaagtatgcatttcccagggcttctcaagtgactatttcaaaaagagggcctcatttggtttttccgtatatcaatgcagcttctgagtcccaagggattgtgacgaaaccaacgattgatagattcgatgctagttccaaaagtgtcaccttctcagatggcacgaagggtgagtatgatctaataatattagcaactggttaccactatcattatcccttcttaagggacgcgttaaaagtgattgatccttccaacttgtcaagggttaagggactttatttggatgttttttccatgaaagatccaacattggctgcactttcggtttctgtcactccgttaaacttccatgccatcgagtcagaagcgatggcgattgctggtgtgtggtcaaatgccaaagcattaccatccatagaggatcaatataagtgggagaataaaagagtggaagctactgcggataacttatttttccactactacgatcatgaacatttagttccagacttggtcgataagctatttgagctggcccccaagaagagacagcatcctctacaggaggatggtaagtttctttccgaaatcgacgaagcttatgcatatcaggagcttttgttctaccaattcaaacatggttatttgaattcagatgatatgcatgaaagcttttctaagttgtcgttatcccttcaatagtagtcagtagattagtattattatattaagtcacgtgattccacaacaagcgtcttcacaaatgaattctatagtaggcaatctctcatattgagttcattactaccatgttgcaaacgcacagtttattaaaggcattccagagtaataaattccgagggaagcaagaacaagaacactttcacagaacttttacaggacgatatcaaaatttaatcaagaggaattcttttatctatttgggaattcctatgattggttcagtcgttcttgggtctttactactatccaatttcactgcaattcgatttgagcagagagatacgaaagtcaaagagttagacgaaactgagcagttgaggattgtaaacggcaagaagaggaaagttgatttgaaggaagaatactataggctacagggcatggttgaagaaaacgaggattgggaacctgtacgtgttcctagaatgaagggtgaaggtgaaaatgtatggtagtgttgaactggtttttgctgtgcttatgagcagtttagagtatacattactgacggttcataattagtcgaatcgctttagtttcgaccgtcaaaactagagcgcggggtctttcagcatttgtttgatcaaaaaaatataaaaaaaatcatcatcgttttactttattaatcacttgaatagtcatggtgtctttttcttgtgaagtctgtaacgatactgtgataaaaaagaaacttgagcagcacaccacagtatgctacggtgcctatttcacttgcattgattgttctacaacatttgaaggtaacacttttagatctcatagtagctgtataagtgaatctgaaaaatatgaaaagggtttattcaggggcaagaagtatatgccctatcaccaaacacttcaaagttctgggaagagtatcattccaaatactcaagcaaaaaagctgaagtcaagcgaggataacaaggactttcaaccctcctcaagtaataccatatcttccaagattaaaaattcaaaataccacggaaaggaaatccttgatattaatattggaaattatattacgaagaggcaacctttgaacaaatttctaaaaaaaattgccaaggaaaccaaacaagataagaaaaaagtcttaagcagtatctacatttggaaagatgataatggaagggttttaatagactaatcgtttaagcctcttcatagcttgcagtaatttaaatcttcttactcaccgataaactcctactaactttgctgaaaaagttcctcaacgtattgtatgggaaagtcagatcatctttcaaatagtctggaagacgtgacttcactgattcaaagtcttgctgtagttgttcgctgaatatgggatggtattcaatttccccaatatgtcgactagtagtcttattaatcgatagtttgtacatcaggaaggtagagtctactgatgattgcctcattgtgaatactatctgctcgtttgtttcctcaaaatcggtgcatgatacacctgtcattaattcaaacatgtcgaaaatgatttgtatgtttgaaagttgttcgtttgaactatcgtcaaaagattgatttttcaaactttgaagctcccgcctaagtttttcattctcatcttcaagttgctgtagtgcaaaaggtccttcttcaagctgattgttcagatctttaatctgttgcgtgagggactgaacaaggttatcagactttctcatccgttgctccgccatgagtttataagtgttaaagatctcctctgtcttatctgtcgttaagtcatttagaatttcattcaactggcgtacgtcacgcctcaggaacaattggtttagcaatacatctgaaggaagagtaacatttcgggtaggtgtttgttctagtggagatttgacaattcctcccttcttcgttaatttgacagggcttagtttattataacttgagtttgcagcactagcctcagagtttcgtttcttatcagggttaccttcagcatttatatctacaatattttgcttcctcttgttgttttgatcagattcatcatctgttaagactgttatatcagtgtgggttctacttgatttcttaaataatgatctagtcctctttgaaggggtattttcaatattcgtagtaattgctttgggttttttcggagtcaatctttcatctctccctcttgaagacatggtatctgacgtagtacgatgtaaaatgaaataaaacaagagacgcgaaatgtcaaacaactatacgtgaatgcatctttgaaaaaagtagctaattaatctacttatgcagtcaacggtctaactaagcaattacgtttaaggagcaactaaaaacatgtcggactctttaggtccttctcccacttgtgtcaaaatcactcttgagactccacttgcaatagttgaatccaaactcgaaagagggactccttcaggcactttcaatgtggctgaattcatctcattccagccatcaacgttggacagaacaccaaataggacccccagaaccacttcttcattttctgactcgtagtatataactgcatttggacctgcatcgaatgtatacgccgctaccaccttaccgatcgcatcattcaaagtgtgtatcagcttgatgattttcttagatgtatcagtcagatagaatatgggggggtacgagtccaagcaagtggcatgaaaagagttagaatccttcatcgttaaagtaccgaacgtttcgaaatctctattcttaattgcatcaaccatctgtgaatacctcggaggaacaacttgattgaccctatactgaaacagttcagaggtttggacagtagtctgcataccactcgtagatgaaacatcttttttcaaatcactgacgatgcagatggctgctttcatatttggccagtgttccggcggcgcaatttgaactgccttagaatcagtaccatctagtttctcacccatttcccaagcaacgtaacctccaaacatagatctacaggcagaccctgatcccttacgagcaattcgacttaactcagaagcatcctgaggaagttcatacaatttagagatagcagcaaccatggccgcaaatccagcagcgctggaagccaaccctgctgcggttggaaagttattttcactaattatatgaagcttccattggctaagtttcggcaggttaggatcatcttcttccagttgttgtctcaacgagcgtagttgctccaggcaattagtggtacgatcattttcaatactgtgagaaaccccatttaagtacaaagagtctttctcaaagtttctgctactgttcacggttgtcaaagttctcaaatccttttgtgacaaggttacactaatggagctgttggtaggtaagttcaagttcgtgtctctcttaccccaatatttcaggacctgaaagttagtaagtagatcaatgacgatactttgaagacacatactgcaatgttaacgggagcagagcttgatgcggtatagatctcgtgcatcgatgattcaaaataaagagttgagaaatgtttcgaattgttctagaaaacaaaaaatcaagttagcgaagttaagagttacagaatatacaggtcacaaaataattcgcgcttagtaaaaactcctttttgtcctgactatgcgaggaacaaactattcaccatttctcaacagttggattcgacttgaatttcagataagcctctttgttgaacaagcttatctcactctcattcctaaccccacaatcatacaagctcaccgactcatctgatacattcagcaaccagtcgttgtcatggtcaagattaatcactaaattcattgatttgaagccatgagcatgtgtgtagaccttgagggagtcataatttacgttgcaaaaaggtttgagtgttatgtcttgatcaattatcaatttcatttcccttaagagctgttttgcattggttctagtcaaatcaacatgtgtaagaacgtagtttttgacgtttcgatatggaaacgatttgataatacgtattgtcaatattgaatctgtcactttttgagttagtagcttggtttctaatgtaaatagatatataaactacttaccaggacgcgcactagaggttaatggctcttcaacgttgtcaagatccattttgttcagtattaagagtgactagaggaatcgagaaaaccattcattcgcgcggcctccggacaaatagtgtgacaaggagttattgtagccactgaatctcataaacccaaacaggtttaaatcacagcaaactcaaagcaagtatttttatcatttagttgtttccaggtttcgatgtagaaggatacgaggatcattaatgcgttctaattttctttctaagtcgctgtaactagtatcacttttcttgccaagtagtaaaaatgtatggttagacttccttcagatatgatatctcacacaaaattttctcaatgttaccactatccccaatgcatctgtgtcctttgaaaatacaggtttccttcgccccctctagtacatgctggagtaaaaaaaaaaacttccccggtatcacgtgactagttttagcgttggtcatattcagacctcatcaacgtgcatattctttagttatacccagtaatcctatgcatattcagtcattaaacaagtgagaaggaaacaactggtttcctttttctacaatcaatgttaagagaagattctatttaaacctttagatcttgattgtgctccttggctaaaataaatggctagtaatatccaaagcaacgagagcacttgtttcgaactccatagtcaccccactactagaatttctatccatttcagtggtgttgcttggagatcaatggaatttataattctcacttttgacttgagagctaagatgaacaaggaaactaagagcagttttcaaaaaaggtatttacaaattagattacttatagttttccggtgataatctcacataagacatgtgattattcattcgcaggtaggtcacacttaacgcaataaaagaagacaaaggaaaaaactaaaaaaacgctcctgttgatagaagaaacaaagtgagtgtagggtacttatttcaacgtcccataagtaacatttcatacccttcttcacttggaatatcatacttacaaagattgcatgcagctaatggttctgaatacatggcaacaatgtaatccttttgagctcaataattttcacaaagtttgtcctgaactaagaagctttatcgtcaaaacattaaactagattcaattcaaagaaaaatttggattaatagctgaaattcgatatcatatatgtatataatctgtgaagctggcccattatagacatgcaatggcccactattgaatgggtcgttgatttcatctaagaaactagacaatagatcagagggtccaaatgtaaattacaaacaattgtaagcaaagttattaatatccttcttatttaaatgagaccctgacaaaggcggagaatctagtaagtggacagttttcattttttttgggttcctgtaaatgtcacggaccaaatcgggatcgaaatctgacttgattgtcgagattggtgagtggctctgacctaaatgttatgggcaaaatcgcagaccttagaataaagcaccacaatcgcaattattaaatatacttctctttatacttggtgtctctgcttataaagtaattgattgcaatgtctttttgacttcggcttcctgaatgatgtttcaatacattttactattgaattaccgctcaacactggatctcattgggggaacatataaacaaaagagttaaattagaatagtactgtactttagctcgtataagttttagtcaaacctatgaaggtctataagcgaggaatacatgatgacaagaggctctgatatactaaagaactaatgaatgggttcttatcagcagcttttgcaaaagaatcgaacccaaatcatctgaaatacagatgtgattcaattgcgtacacttacttacctacgatgaaaatcaaaggtgaacaaagttcttgggtagagtgaatgaatccccatcttacatccttccaaccagtaaagacagacgacggtcgcgaattccaagtttaccgataaaagagcagatgcacagaagtctattcatcgggacgtcatctcttgcaaccatgaacctaaattcaattatgtggcaaataattgaggcataaattcaaagatgcagtattcaacatttttgaagctaaaattgtcagaagatctccaatcttgctaattggtttttagctgcaaacttacctatagacctggttgatgcaacaaatatattattagcaaatattttagggttttgtggagttaagaaagttatcagatttatgagaacgtcgagcatgatcacctccggatggtgtgaagtcataaattaaccaggcattataaccgataaacaaacccttgcagaagtttctataatgttcgaaaattactggtgttcttggcataaacctatatcataccaaccttttgatactaatgcaaactcacttgtttccaaatggtaagtcttgaagtctttcagagaggagcaatgcagaagcttagctcccaatgtcaagtacttaacttttgtctctgaaaccaagtttcctcaaagataaacttgttattcaagctagtaggtacaacaagtgtaagctgaagccgaaatcaaatacaaggcaaaacgatctttgaaataccgtggaaaaagcaaaatccccctggaagttacaaaccacttgctaatctcccaatatagctgtgcataatcaccatctggctagcagaatttaaatgtacatgtggctgttatactgtctggattccatatctactgcatgcacagcgacgatttatcaaaatcatgataaagtttgagttggcatccaaattatgttaactacaccttg

SEQ ID NO: 103 - DNA, 1408991 bp, Pichia pastoris
ctcaaaccaaactcatactcttgatgaaatactgattgattgagtgagaagttaacagcatcggttagtcaatcgaaaagttcaatcaatgaacagtggtagtccttctacggtacttaaattccaatcccaaaataatatcaataatgaacaggaatcctccaagagaatctttctaccatgagaattgggaaaaacagtatccattcaagaactagatctacgtaccagaacgccaggtttctacgcttaatcactctatcaaatacaactcaagctctaagttcttgcgggttcagcttacgtttacgcacaaaacaactactgccccgaaaccagtaaaaatacattacaaatgctacgaataagatgatcatagtagccacaataattcgacctgatagctctaaaacacgtctttaggttgatctgacaatagtatgaaccgataatgaacactataacggattgctaataacgaacccagaaatgaaacataggaatactaccatggcacgaccagctatgcgctaattggtgcaaagtaaagttagctcattcagtgacaccataactccacccattaaagaaatgtgatcataataagcttgagtttaatacctacaggttgtcaagtaaaaattatatagtttgtgaaaaacgattccagaaacagaactcttcctgaatccagcaaggggaaatatacaacggaccatgacctagtactactcaaagaacactcaatgagaatataaaagtgttcgcaggataccattcgcaacatcttgcagtatctcgtattcccgcgatggaaaacgtagcagtaatcgacgcctagtagtactagcactaacatgctgctgaatgatgattgaacatattccttcaataaagaagaaggaagtacaactgtataactagaattgacaaaacttggaaagactaggtaacgctcagtcagtaggtccgtttccactccttcttttgtgaccgactcagactgaaacagcgcagttgcgttagattagccataatacagtggtgaggtctgacacctactgacgtaatagagtgaaccaagtatgcgtgatcccaggtttagcaaataaggatacagagccccacaattcgtaacgataatgactacgtatatagatgttgtacagatcagtgagactttctctaattatctatggattgagaaagttattaggagggacacacgacgacggctttgacctacttcccaaaagtctccatcgatgtctcaatatgattgatggcaagtacacaaatgaaggtactaaggtggaattgataggtattgctatccagaaagacaagtcgtagctagaaacgtctgaccctttgaactcacgtagcttcgtacttttgggagcccttgcccagtacaaagtttaagctgagtcccggtatattttgctgtcgagcaaccgtgtaaatattgttttgtaagttcggctacgagcaaagagctcataccttgtactgcctgctaccaagcttttttctgtggggattcatgaatccggaagaagatgcatctattcattgctggatttgcaggcaaatgatgtacgctttcacaacagaatccatcaactattagttggaagattagaagtatatttcaatatagttcagcaaagagctatagtcacatacttttttttgctcgatgtcaattcgaggcaattagctttagagcaaatttgttaggttttgcttcagctttctaatgcctcacaacttcattccttatcacgcagcgaaagaaccggcgacagtatcaatcacttcacccatgatggcatagtagtattcctatgtttcacttctgggttcgttattagcaatccgttatagtgttcattatcggttcatactattgtcagatcaacctaaagacgtgttttagagctatcaggtcgaattattgtggctactatgatcatcttattcgtagcatttgtaatgtatttttactggtttcggggcagtagttgttttgtgcgtaaacgtaagctgaacccgcaagaacttagagcttgagttgtatttgatagagtgattaagcgtagaaacctggcgttctggtacgtagatctagttcttgaatggatactgtttttcccaattctcatggtagaaagattctcttggaggattcctgttcattattgatattattttgggattggaatttaagtaccgtagaaggactaccactgttcattgattgaacttttcgattgactaaccgatgctgttaacttctcactcaatcaatcagtatttcatcaagagtatgagtttggtttgaggcataggtttattggtagaccagatcttaagtttggcgtcccccctatatccgaagatttacctgtatttgtcttaacagtgagtaggtttatagattttgtatattcgccatattttgctcctaaacttatgggcctacattgaagctccctttaacacataatttttctcttggtacccgtcgtacgaatgaaaagtctgccggaatttcatcgaccaaccagtacctccctagttcattacccacaagcataagcaaagggctatctgtaaatagtggctatcagccttatctaagggccagcaaacttctctagaagttagactgtttcatgtggcaagtattgtattgaactttggccaatcttattggagagtgcttcattcaagttaaggtctacatagcatcatacatagatataaaacctcaactagatgatacacaccgatagttttgaagttttgttctcataatcagaatttatcaataccatttagttgactatgtaaggtatcttctactttaactgtttccctcgtttgccttggatcagattctgtctggtcaaggctctgaaaacatgataacgtgctgcaagcaccgaaaattgcttctagaggggacttcacgtatattgacttccatactccaattagctgaagatgtatctgcccatcgggaaaagcatggtcattggaagtaaggtgaaaaaccctgagaatgtactttatttgatgtttttctttacagttcaggcctaattgttgttgataaatcactacccattaaattctatctgatcaaccagatcaaatttatggatcaaaacggattgtttttgccctattagttgccagttcgtacagaattggtgaatgtaattgttctaaattatcaaattgaagtaagagactatcagttattaagaattaggcttactacctctactagattttgccagattgtgacaagttccacaaagctgagacgtcctttttcatttgcacgtgtaggtctataaacactcagattgaaaacaatcttaaggaggtattactactgggttcttgtgatatgatggaagttaatgattgtgctgtcttgaaagcatcaaaaattattacgctatccgaacctgccagatgaggaaaaaagattccaaggtgtagtgaacataatttggatgccaactcaaactttatcatgattttgataaatcgtcgctgtgcatgcagtagatatggaatccagacagtataacagccacatgtacatttaaattctgctagccagatggtgattatgcacagctatattgggagattagcaagtggtttgtaacttccagggggattttgctttttccacggtatttcaaagatcgttttgccttgtatttgatttcggcttcagcttacacttgttgtacctactagcttgaataacaagtttatctttgaggaaacttggtttcagagacaaaagttaagtacttgacattaagggtctgactgctggatattaccacaaccgtcgtcatctatgggctcagagactatttgtcgttcgttacgtagtgcctatccattgcttcgtaattcgcgaaaagtttctcatccaactcgttgattctaatggaggtggtatagtattttgatcttgtgaataagttgaatgctctgaagtagacgacgtagtgagtatcaggaagagggcagatgtcattaggtcgataagaaaagatccattctcgataaccatttgaaagccactcgttgttgttgaggatgttcaacatagaaagacctaagtcttgcttttttagggcagagaaaaacttattaccgcatagaaatcgatcagtcttgaaattgacaggtgtttaagtttgctatagataaccgagtttgaacagttttttttggacatcgtcgtgaggtattttgattgaaaaggttcgtcatttggcgtaaactgcgttggtggcaagtactggtgcaataagtttactgttatttcaaagccgagtttgtacagttatagatgaaatcgaaactagaatcgacatccgagtatctggcacttttgattttcaactacaggtggttgtgagccttaattcttatcgactgatgattcttgcgtccacttatagtttttggcctgaaggtctgtaaacccagattatgtgatatagtttttttatagtaatttcgtattgaagggcacacaatatagactctttgaaatgatgtaaattgaagttttcttttttttttttttactccgtgaaagaagctgatacgattagcaaaatgaagatattagacaagtagcctcagaaactgggcttcaaaaacttatcttatcaagtaaaaggtttgttctgaagttaaataccacaagaactcaagaccaattttacctagaaaattgcttatggcttctctgacaaaaattgctttttttttgttactgcagagtctgtctgaaagtgactccgctatttgtaaatcttgtagagcgtccgggttatatagaaaacatgtctggagtagactcccgtctgctcaggggggattccaaaggcgcaatcaagtctttaacattgttttctaattagatgagaatctactgagttccgtacaaactgataaaaacgctcaccatactccatcggtggtaccgcacttacttcggctcttttatgactcagggatctccagagagtttccacctttttgaaaaatgagtaattagttaagcaatctataactcccacataataaacctcatccagatcgttattcagatagtctgtagctctcaattcagatcttccctcaaaactcatcaaagtttcgggtgtgttgttctttttaagtctattaggttcatagtgaattcctaccaacagtgagtaatccatgatgtttagcctttcaagtagatctacgtcagaccggagttgattcaaaaaatcttttgccttctggggtccgagtttgagcgttttttcctcctttaaccaattctggtccttcaacacaatagtacgggctagttcactattagtagtaggagtcctagttattctaccagctaaagagcccttcaagtcatactggcttcgtatatcttttgctggaggaaatatattgttcataactataaaatgaacttttcttaaaccagcatttcgaccccatggcatttttactctgtgaagcccatagaattgagatattagagtctttggattttctttgatatgattatagtattgtggaagtattcttctcagttgcctgtgttcagaatgatgtattgttttgatgatgaatttgtagtcacgagaatagtaaaagaaagaaccactcttgccaggagatcctaactcggacagaatgtatttggaagttaacgagacaaggtaatcagcggggtctaatccgaaaagaagtctcagtgatctgaatacctggggagcatagtctttgaatttgaaatcgtactttgacgatggtgtgagttccgaacctgatatgtcgaaagctaacttctttgtggtcctaaaatcgacctctgtcagaggcttcattatcccggaacatctggaaacgctaactcggataccagttagcatattgtatgccataacataattggaatgtccctcgctaactttgtttccaactaaaactctttcgtcttccaaaaattccttcctttttcgttctcgctcccgcttggcaataattgaagtcctcattcggttcaactctgtattgattgcatcttgagtacttatggttgattcattctgcgtcaaagttctagatgtattaacgaaagatttggaatttgaaatagaagacattggagcatttgctactaagcgctgtcctatttcttcctgcgatagtaaggtagtagaacggttgttcatgactgagattctgtctctactatgagagttgatgcttggtactagtacttcttctgaagcagaatccaaattatcaatgtgaagacttgtattgcttgtagctgtgatagcggcaataggtaacgacgatatggaattgccactaggcgaaatttcctcgctgcttttgctttgcttcgaacacactgtgggtgctaaacgtacgggatttaaattcttactcactgggttcgtctttgattcttcactccaaagcagagctaaatcgttctcattaatgttgctgacgatgttcattctaatactactgcattttcaagtaaacgaaaagagtatgtgcaatttctgacaagtagtcgaagcccgttcaggtaatatttttgtgtagatggattgttaaaaactattggtgatggtaagtgagggcatgtaatcatagatttgtcgcgacactggatttgtcaatgcacaacttctcttctttagtaaattcaatttagctcaatacttacttaccgatgtgcgactggcccatagaacaagaaggatatacatggtatggcttgaaaaatgataacatagtggtcttccttacatacgcagagattcccgtccaaaaatgtatagagtttgtaaagcacggtgatgctggagcggttatctactttggtggcaccactagagaaacttttgaagggagagaagtggtccacttagagtatgaggcccatataaagatggcactaaagactcttagaaatatcgcaacaaacactatcaactcaaatcattcaaagattcaccgaatagtcatttgtcatcggcttggagtagtgcccaagaaagaggaaagtgtactaatagcgttaagtagcactcaccgagaccatggttggcgtgcggcagaagaagcacttgaagatataaaaaagagcgctgagatatggaagaaggaacaatacttcaaaggccattcatggaaagggtccaatgataactatttacaataagacaactatgaaggtgcgaacgcatcccttgctcttgaaatagtatcaatgcgacgggatttatcattccagcggcgaacaatcacagcgtccttggttgagcttacacctttggattcacggaccaccggcttcaagtattttcgacgtaagcgtatttgcgcggaaatatcaaatgcaggggagtcaatcaaattttctaccttgtaacgcgtatctctagtcatcacggtgtggttaccgacaatttcctctattttcgaaaggttgttcttcgcaagctcttccttttgcgcagaggatagttgtttacagagacgaaagtgagaatcgaaagttaccacatcatccactttcgaagccaccgttagatattgggttaacctttgatcaaactgagtttcggttataatcatctttttcaatagcaattgtaaatcgtaccgaaaattgtaggtggcatagaaccgagcttcggcgattgattttccaccacgaaggaacccgtctagctttacaagcctagacgaagcaatatcaatgaattcttgactgtctgaaaagaattcctcaaaacttgtcaattgactactaagttcttgtttcttctctaacctggcctcttgcctcttctttaatgcaaactcaatgttcggaaacagcttgtgttctttgcgactcatacgaccttcttcacgatcggaatcaaacttgtcggtgatttcaacatagccgaaccgtctcacccttggttcccagtggggcaaaggtaacctgatattgcgatgtaaagcaacaccaatgaacttgcgtttcggatgaaaaggatccaagtagtacctcacataccctggttctaatgcaaacaatgtatggtcccggcctatacctacattctcaccgggataaaattttgttccacgttgtcgcatcaatatttgaccaattgatactagctcaccatcttgtttcttgggccccaaacgtcgcccagcagaatccttcatatgtgtttttgaacctgcagttttcttcgtagcggtacgaatttgaaccgttagaatactctgctttatcgattgataaatgaccccaggcgctgcagcttttgaggacactgaccataaaaacattacactgtaaggcaagtagactggtaatattcttcgaaaattttcattgatcactaagtcgtgtaggaaccagtaaaggttagtggagggaaaattcaaaacacgttacacgttcaaggcagctcacgtaaaagtaatggaaatgattctttctaatcgaaaatgatcacctctggtagtgtccaaactcttaacgaggaacctgataatggcatcattccttttggtataattatgacagggaacctacagcaacaatcttgctgtaggttgggctactggagcgcgatactgaacctacgaatcacccacattcgaaatgtggagttcactctaagattaacctctacaagttacaatggaaagcagttgggatgtagttatttcgcaactacaagacatttgttcttcgaacaagacttgttcttttgacctactatacgaaactgacgaagtttcaagcaagcacgaagtaaaagacctgggtgaatatcaagaacagctgcagtctcataaacataacatcgataaatcgttaaaccttataaaagagactctgaatgatgtatcgacactggcggtttcgaaacagattcgaaaaagtgaagcaaagcagaaggttggtcgaagttttcatcattcaaaatataatccgtctgaacctattattataggttcacaagtagccttcaaacttcgacagaagggaaaaggtgaagatgaggaatggattcaatgtgaagtcatcaagattatcggagatggtactcgattcgaaatacgggatccggagccagacgaaaacaatacgatacaaatcttcaagacaaattggaaggatataattatgattccgacccagaaagaggctcagaatctacccatttaccccaacggatttaaagttctagctaggtatcctgaaaccactacattctatcttgcagttgtctctggctctagacgtgacggcacctgccgtctccgatttgatggtgaagaggaagttgataaggaaactgaggttgaaaggcgacttgttctaccttttcctgggcgttgattcttagatagtaatatttggaacatagtgccactcgagtgaagttttgtcgttcctcactcaattacatctttcctgacaccggtcgacggtgtagatagacaaatagtcgataactaaatgcctgacgaaatggatattgacgattactcaagagtaagtcactcgtatattactggttcaaatcctttacattttagcctaacaaataaggatcgtaattcttctccaagacgggatgaaagagatcgttctccaacacgagatgccgctagtgatcccactttttcaaccaatgcatacagcaaattcagaagacagccagaaagagagagttaccgagttaggctcaatagcaatcgggatagacgagtaggcattgaaaactaccgtgaccgcgagttcaaagcacacacgggaggtcccccaggtagggacttcaaaatgaaatctgaccgagactacacaaaaggcgtttttattggtaacttaccgtttcaatgcagctggcaacagctgaaagatcatttcagtagtatcggagaggtgcatcgtgcagacatagtaactgaacgaggacgatccagaggaatgggcaccgttgaattcgtaaatgaagaagatgtgaagctagccattgaaaaattagatcacaccatttttttggacagagaaatatttgtcagacaagactacccacccccagataagaatcgagtttttgaaacccgcccgagacgagacactcctgaaaatcgagattatagagaacctccaagggatggtactgagatttttgttggtaatttaccattcagaactcagcgtaaagatctagccgatttatttgggcgatttggtggtattgattacgtagatattagacttgaccgactaggtaggtctaaaggatttggaactgtcgtctttaaaaagcctgaggattcagcgatagcattgaaagagttacaagggttccaattggacggtagaaagttagatcttcgtgaaggggtcggttctcgaagaagggaccgaacgacacgtgaaacaacgtatcctctaaggaagactttgaggttgaatgagagaatttatgcaaacggacccccgtcttctacaatttttatttccaatttgccttgggccactactgatgatgatttatatgagttagttgaaagtattggacctgctaaaagagcagaaattcaactagatgaaaatgggagatcatctggtaatggaatcgttgaatttactgactcgctgactgcagagtctgctataactaaattggacaactataattatggtaatcgtgacctgtgtcttagttacgcatcattctactctggaaataggcctctcaaagatgatgctgagttgtctgatatcaaagacgatgttcgtcattcgcgcagccttgaggattccgaagttgaaacagacggataatactctggcggagaattaagaaacacatcattgagatgtggataaattaagagtcgtctttgtggaatacttattgacctcgttaatataattccgctagtctcaatagaagaatagcagtttcagaacctgttaaatattcaactgtttaggagatttataatagactcaagctgctcgaaaattctgtgttacacttggtggtagtagtattttcatatttcgatcggggtagaaatcaaaactgtttattatttctgcttccatacttgaagggcattcacgacttaaggagaaatgggatccagtaggtccccctgaccgttaatcaaaacctgggactcgcttctaaaaattgataattgcaaatctggggggtgaacagtatcggacatgcttaaaaggaagcccaccgagttattcttgggagcatctcttataggatgcgagtagttatactttggagtattggtgacaatttttgtcaacccatccttccacgtgggttgataaatggtgtccattgttcgcacagtccgtccttttggatttagagcacagaaaagaattatcatttatagtttcttgggggccaatacacttgattctgaggcatagttccatttcttgtggttttgacttgcagggctattagtttcacaccggtagccttcgttcaccacttgagctgaaaacgctcagtaaacctgtcatttgcaaataactcaatttcaagctcattgcggaaagcaggagaactgtcattactattgcaagtggaaaattgtgaggggccatcacttactactctcaaactgtccctcttcaaaagaaattgaccggaaatagcatgacgccccttaactggatgatatcttacttctgggggaggggggggggattctttcgaagaaacaaatccctttttgtagtaaactgatttccaattgctttcttttagttgcgtttcaacttgataatacgcagccagtgtcattaaattctcggacttcgaaatccttctcatgagatcaaagtccagtagtggaaattccaaatgtgagtttgatcccttaacatttctaactaattttgtactcattgaatttatgtcttctttatggttaaccgatttcctcctcaatctatgatacgaagtgctaccagaggacatcccatgcaaagccatctttgaatctttggaacatttgtcaacttgactgttctgatcaactttttgcctcaaatcagttagtagactcttgctttgtggtaagtcaacgtcgtttgtagctctacacgtgaaagaactcttagagcttgtaaccctcctccgatcatcgtaacattgctcctccacaaattctaaaaatgttggtagtagcttattctcctggtattgcgctaacaatttggctttttctgcagttgaatcaaagtttagccaatatttgaaagcttgcaacctagccttatttccatccaagtcattcttccacaactggtagctgtcttttgagaacatgtgcggtacccattctttaagctttttcgagattgccgtaattaattgttcaggtctcaaagaaaccttgaatatttctccttggatactcgccccaactacgtgtatctcatcaccaatagttgaaacaaaaaatccgcaaaaaagatcgtacttaaacaaaaaagcctcatcataatccatattcagcacaattgcaaagggagatttattggcctctagttcgtaattttcaatacattgtgttacgctgtatatgctgaatggatcgcggaaagagctttcttgatccttgaaaagatgaaacggttgggtcttgcttgaaattttacatttgaacattgtgtcaacaattgaaggcccagaaacagaaggttcaagtattttatagtacctgactgagaaaggcaaattgggcttgggagcagtgtcagaataattgaagcatagtttcaaatacttgaagtccgatccgtaacacaatggcattacgcttcctactgaacaccatccaaccaagcgtagtaatggaagcaatttgcagggtgcaccattttgtaatacgtcaaggataacgtcgccgacgcatagttgacagtcatcattattgaacagaatatcatggtaataatcatcatcttcgatcgagaggaacaatacgagatcagtgaagacaattaatacttggtgagacctccattgatttaagttgcacaaatcttctaaatgataaacagaaacaacatcactctccagtaaatgattatgaaggtcatttgaccagtttgtaattctgtcatttaatgagactctcattgaatcatttttacactgaaaagctaaggctgattctattgttcgaagcacaaaatgataatatttatcgccaagttgaatgttagattgtaccgaagactgaacgcagtgctcatataaccgagtaacagggagcttcattaaagccgtcttgcaccaaatttgtataagagggatcaacttgtcgaggttgcagtattttttgggcacctcaaagtgctcctcctcaagtttcctaaagaatgtgtagagattataattcaggtttctgcacgcagctttgtgcctagtcaaagctttatagaaatatggaatcacttgcgcacatgctttaagtatttctaggggcccaaacggagcagcctcttgcaaggcttctaaccatatgcgacaagctcgggcaacttcatccagcgtaggtgggaacactgtgttgactttttttaacgttatgctcttgaaacctctgtcaactatgcgagctcgtagaggaataataaagtcctgtagaagattcactaaacttttcgtgatacatgactgagtgtgtagaagctgttttatctctgagctgatggtgcctgttttagcatggctgtcaatcggcggtacgtatacatgcgacatatgctcaaggtaatattctgatgaaggattccacatatagtgaacctgatctcctagttgagagacgactttatcattcaattctaacaaagagtccttactggaatacacaacatcgacatcaatactattgatgtaatagttttgaagatacccgagttgaagcagccgtgatccaacttctgatggagtctttgtatcaatcaaatgcatattcgaagctaactcccctgcattcgtttcatcccagttatgcaaactttttgtgcttgcatgcatcgaggtcatcactctcgtcaggcaattgaccgacaatgaattaaaagctctcaaagatgtaactgctaaagcttttcgaacattgctggcttttgaatcgggcgatagattttgacaggcagggaagaagcgagatctggaatcaattgtgacttggttgaaatggtactcgccgaaaacgctaatccaaacaacagatagtttgttatgacatgtggggtcttcaaagacaaggctaactaaatccccaaataataggtcattagtgccctgcaagtaagcaatatcgcccaaccctcctgaaatcaacgtgtcattccgacccttcggttttttagatgaacattgatctacaaatgtgattctgatgaaggaactggatccaaaagaagagtttggcttgcgttctttcttcaccagttctgaagcattatacccagggctcaataaatctccattaccatcaccctcaagtacaacctggcatgtagttaatctacaagagttacttgtagtaaatgtggccatataacttgtaaattggaacaatttcaacttgtcggctggctattcgataaacaacatgtacatgaagacttgatcttccgcgacaatcgcgagcgtgaacatataatagtaacttgattgagtaacaatatctgctaggactccacatgttcaccatgtctaaaaatatgtattcatgggtaactttcgacgagtccttcaaagttattgaaatcacaccagaattattgcgtgcttttaacgatcaaagtgagagtattaccatcaaatctcctgaacctgaggattatccagttttatgtacaaacaataatagttatcagttgaggcgaaacaatcacagcaattgcatgttggtttgccattcaactacacagggactgatatccttttgtggtttgaactcacaacttgaagcaaaactcgtccaaggtaaaatccttacccagggacttccaattgtccatgagaacggagattggcaggttaccagcaagaaaataccatccgttggaagtctagcaaggcggtcaccaatttctgaaggtgaattctggcatagctggcatgatttgaaagggtgcgaaattgaaggccaagcagttattctatctgattccttggtttcagttatcttgcacaacattttaggggtaattgtgagagacagaatgggaatgaaaagtcttgcatcgatagaactttacaacacagttgacagattgcagtttgtgacaatagaaatgattgagactgttcttctcaagttctcacaaaactatgaggagccgtgtactctgaatgaaagaaaaatttcacaatggtacggaattaacgttctccgcaacattgcaagatacaaatcgataaatgtggaagagtttttaatcgcttggaagtctgaatttcctgctttttatgaggttgaaatagacatagagcaactgcttgggtattttgtacgaccttccgcgggtaaaataaggtacttggacaagagcaagctttcgagtgatgctgcaactagatttcaagaactgttcagacttcaatccgagtggaatctgaaagaaatgaccccctatcttaaggatgtcaacaatagaaacttaaagttggaaaattttgtcatgaaatttgcgaagcgaagaaaagttggcgaacaaattattgtaacgtcacgctgagatgaatactccaaaagcggtcatcttgcataaatattgccttttgaatcgttgaagttcgatgatttaataagaacgaactttactgataagtatggaagaaactcagtcgtaggtggtttgggtcgaagttaaaacagagcttatcggaatcgcgcttcgatcaattagtaattccggtgctctctgataacccgcgtgcgacgtacacacaccattaagattgaaggttgaaaatgtaagtcctggagacttttcaagtcgcgcaaataattactaactcttactcagagaataatgtcgtggtactgattacctacatcatacataacactacgtagaagcagtcctatataaacaacaactttccaaacttccgcaactaaccaacatcacgagaatggctcccaaggttgcagttattatttacaccacgtatggccacgtcgcaacactggccaaatccattgccacaggtattcaatcagctggaggaagcgtcgatatctttcaagttcctgaaactctttccgatgatatactagcaaagatggcggccccaccaaaaccaaattttcctattgccactttggacaccttaacgacctatgacgcgttcatgtttggctttcctacaaggtttggtaatctcccagctcagttcaaaactttcattgatcgtacaggcggcttatgggcttcaggggcattgtatggtaagccagctggtctctttgtttcaactggtactggcggtggcaatgaggttaccatcgtcaatacattatccactttggctcatcatggtatggtttacgtgccattaggttacggtcctgcattttctcagttgtcaaacgtcactgaagttcatggtggttcaccatggggatctggaactattgctggagctgatgggtctcgtgtaccatctgagttagaactcgaggttgctaacatccagggaaaggccttctacaacactatcaagtccttgaagagttagttttacttgaagagtaacggggctgcttttgttcagtgttataaacaatatagtatagctgtatgcacaaactatggagcaattcgaacaatgctccatttgttgtcctccaaattttcccttctgtatactagtctatcatgtagtctacttggtcttccttgccaaaattctatttccagcggtacaagcctctgcccaccccagtggtcaggtaccggaactgaaacggaatctctgaattgagattcaattgcctccagattggattccaaggcagcgcgactaggaatttcaacactttgtggtgaagcccatgcacctaaacgagatcccctcggccttgtatcaaagtaccgttgtacagtagagcgactaactgcctcgaatacaccttcaacacgaacctggcgttgcaatcccttccaaaaaaaagttatagctgcatatttgttacttttcacatcttggcccttcttagactgttcccaatttgagtaaattacgaatcctctatcgtctaactctttgaaaagcacaactcttgaggacacacgaccagaaggcaatctagcagtcgcaagattcactgcctccgggagatcctccctagcctcttgggcctcttgaaaccatttagtaaattgttcaattggatcctcggccatatcctctgggtttaactgaaatttatcatattggtaggtcttaggtgcaaatataattggttctttcaaggtgtcacccataattggagtctattaaaataaggaaaaaagctaagatagaggaagacttaaattttattcaaacacgggaacaatgcttagtcaagttaaagtggtctcattctcctggtagtgtgctgaacaatacatttcagaagatcaattcgtttttgctagcatttctcttttctggcagcagtgtttagttttaattgctgagtgaagctattctgtgcaaaataacacaaaatataaaagaatttatcatctacacgaagcatacgcattcgcttcaaaaagacagatgttggattcaaagagccgtgtatcgtgacattgtaaactatatcacttaacgttcctcgataattgatatccattcaattgactgcctgcataaatgacgttgaatagcatctcaaaatacgaaacttttatgcaataagaatcatcatatagcttcgtgtgtgtgattaaagtttcgcttgtaacatcttcaactcaaggaagtaattatacaaaacaatcgagaaaagcaagattgtaaggtggctttccaaaagttttttcaaccctcaaaaataagagatggcttttttgcttcaaaatttcggagatagatcagtgcctctgatcaaatagttgatccgctatgaaactctggcccaatagtggaatttccgaagatgccatctatacataaccatgctgttagaacatgttgctaggttgtacctctacttcactgaagtcgataacttctttcactggttcgtatgctgtgtgctttatcgctagctagctatacttgttcttctcccttttgcgatttcaatttttttgaaaatgtgccatacaactctacccacgccgccgtacatcctctcgggtttgtctctgaatttacaattatacgatcgagttagaaagtttgaaagtctctcagaaaagaaagaaaagatgcttatctctgtgaagctctattaaaaaaacgtatatctcatgatcttgaagtagaagttctactccttttaaagttggctagtgctacatttctctttctatccagttcttgacgattagtatcccgggttggagtaaaggacaccatgtagttaaaatgcaaaaattactctgttagtaatagccaatggcttttctttgggtgacacttacgaaaaaaaatggccctacttttagtggcatcatgggtgcctccgacatatgtccatattggttcgacatgaaatatagttaacaaacccgtccagcaaccatctaccattgggcacccaatcaaaatctgagaattcgtgtgaccagtaaaagtcttcatttactatacgcaaaaactgcaggaacagtttacgaaagaagacttatagaagaaagcaattcaatagggcagaagttctatctcactgttgctactccatctcgataactgtaacaacccgacgtagaaaatgaactacaagataaatgaaaaaagagcacgccccggcaaattcaactcatcagctccataaagttcacagaaatctacttctctggaatacgacagtataacttgactgaatacagcgattcctttagtaagctataagcagtttgaaacaaaaccaactactgcgttctgtagaaatctcaaacagaacaaagcctcttgaaattacttgggacagtgtcatgtgcgatcacaagtgttccatgaaggctgtcaaaaaaatatgctggatgctggtaacaccttataaagaagataagatagttgcaagtccattgaatctcagatctgtgtgacaggatatctctgctgaaaaggtaccctttttatagtatcatgttaccacctgtaaggtccatcaagtagaatgcagaaaagttttcgacttataggaagaatctctctactgaggtttggctctaacaacccggaagatattatttatccaaaacttattcccttaatcttgttctagcttgatctgatatcattatagaaacggtgacaatactacttttgaaacggcgctttttatctccaaaaatatcagaagtctatacatatgtgttgtctacaatttaaacagagtttacagatactctcctaacatgagttgaaaacgcttctggccaataatgaggacatgaatcaaatcatgcttgtaagtactttggtgcaaattgggcttttagtagccaccttcattccggatgaaggcattaaattggatgcaagacaaatgttatgacctgaaatttactgttcgtggagtaaaggacacatgcatgaatcaaaaaaaaaatacactgggcttcaaaaaagttggtttcatctactttgatagagtctttcagagtagcattggatgagccgactcattgtttggatctactacttacgttggctgaattcagcaaagaggattaagtagggattgcattaccaaattaggtaattctcaagaatgtgtcatactagccatataaagagtcgtttttctcactacaagagaaatcaatctcgtagaatatgtccaaagttatcctccatctaagagctgaaactaaaccattagaggccagagccgcccttacaccttcgacagccaaggaattgttagatacaggaagatttgaaatctttgttgaggaaagtagtcaaagcacttttgcaaccgaagagtataaaaaggcgggcacaaatattgtaccggaaggttcctgggttgatgccccaaaagagagaataattctggggctgaaggaactcccagaggacacttttcccttagtacacgagcatattcaatttgcacactgctacaaagaccagtccggctggaaagatgtgttaaaaagatttcccgaaggaaatggcactctttatgatctggagttcttggaaaatgataatggaagaagagtagctgcttttggcttctatgcaggatttgcaggcgctgctcttgggattcaagactgggcgttcaaacagacccatgcggatcatgagaatttacccggtgtttccccctatggcaacgagcaagccttgatcgccgacgttaaaaaagatttggatgttgccgtttccaaaactggaagaaaaccaaagatcttggttattggtgcccttggtcgttgtggatctggtgctattgacttacttaagaaagtgggtattcccgatgagaacatctctaagtgggacgttaacgaaaccagtatcggaggccctttcaaacaaattgcagagtccgacatattcattaattgtatatacctctcacagccaattcctccttttatcgacttgaatactctaaacttcgaggacagagctctaagaacaattgtggatgtttctgcggacaccaccaacccacacaatccaatccctgtttatactgttgcgacagtattttcagatccaacggttccggtagaaacctccaaaggacctaaactttctgttgtttctatcgaccatcttccatccttgttacccagggaagcatcagagttttttgtcagagacttattgccttacttgaaacagttaccggaaaggaagactgctcccgtttggaaaagagctaaagatttatttgatcatcatgtcgaaagactttaatgatattctggttgtttagctgctttgaagtgtttcatcttaaaatatatacttattcgtacacaatgcttaccaaactcttattagtgtccaagtcttctgtagaggcagttgttccgttcaatagcacctcagcttcactgtcaaaatcactgtcctctgcctcaaatttgggggttgttttttttacattcttcaagtcctctatgttttcattcattgtagtaactaccgtaaggcgctcgctagtagcatacactgcaacttggtcaaaagtttttaagctccagacaacaatcttaccatcagaggcaactgatactaaaaatgagtcttttgagtcatcgtcttgataaatgcttatgtcctttacgcgagttgaatgacccaagagtttgtaatcaggttgaagcttctccacatctcctagaaagcactcatatgaataaaaacagatctccccattactatgacaagtgattaagtattctttttctagctgcacaacctcaattttcattattgtggactgaaagggaatatttgtgagaagctttgcggtcctagtatggtagacaaatattctgttgaccaaggcaacaataaaatgctccccatcaaaagaccatttaacaaagtgaccggattgtcctaaagtatcctttcctttcatttttagggttgatgccagcttggaactcatgaggttccacagtcttattgttttatcgttactgaccgagactgcaacttttccactagggtgaattgccaagtcatttaccgcagctttatgacccttcagcacagctactggctcccagtctttagttctccaaacgatgattgacccatcttcacttcctgaaagtagccatttaccatccgcatccctagctttagaactctctcggctgaacttcaagcaagttatcgaacctgtatgttgcagtaagcttccaatctcttttcttttttggagatcataaatctttatatgctcgtcgttagagccgctaaccaaataccgctttgcctgatctaacgctctgatgcttaaagaatgagcttcgaagtgaaaaataggctgaaaaataggtgtcttctcagaactcggttcgcaactgacagtaacactaagacatgatagtatgtgctcataagatccaactacgattcgaaaccgaacagaggtgctcttattactcttatttatatttaacgtctcccccatgttcgttatcgcagtgtgcagaattttcctaaactaattttttttggtattcgagatcgttgattattagcttacaatcaaacttccctcacctttttccttccatcacacatctatccacaattggcttggttgcatctgatagctagctggcggaaacatcagtcaaaaaacatgaagactactttctgagagacataagttaaagcagttgctgaaaaatcgtcgttatccaattgataacagaagcaactgaagaaataaaaaattgcgcatgcccggagtcgaaccgggggcccgacgatggcaacgtcgaattttaccgctaaactacatgcgcttttgccgagtgtcaacgttgtttttctcgtattaatacttatgggaaagcaaattcagatcagtatttggctgctatctacgaacctgaataaggttaaatacggctctgtttctgctacactttattaaaaagcgaaaatcgttcgtactaggctgagtattttttcagtctgttgatgtttttctttgaagttaggattaaacaagcaccaccattacttctgaacagtcctcttactgatacgccaaacttctatgcttagttctaagtgtatcatcaaaagagtcaaacgtaaatgcttcaaaatgttatccttcacacgcttgaagtagtataacccagaatactatcaagatataattctttcgaaggtgtcctgtgaacgacatctcccgtatacagagaatggctggttgctcaagttgggagcattttagacaactctttactcaatcataccataaaggtgctgaaactaatttaaataaaacaactcatctcagagataacgaaagaggtcgttagagtcgacatagattgctgtccgactccgactgtaacccctagttctgtgacatagtaccaggggtgttttcgagatttcttcggacttttgcttacctatctatcgcctttatgcctcatttgaactgtatagcggatatttgcttgatacccgtaagttttgtcttcattacagtaacaacaaagctaacagaatagattggaactgggtcgccctctgtttcaaatgaaattacaataatagaacgccatatcagaagcagtcatttaaggagcacacttcatagtgctggaacaaccataggtgagtaaacaaattacttcaattactttttgatgaacttgaactaacatccgatatttagaaggtccctgggacgaagtcatggttcttataggagaattgcacgaattgctccattcacttggtgtgcatagaatccagagtgatatcagagttgggacccgagatgacaaagcccaaacagctaaggataaagtagatgtagtcgaaaagaagctcgaggatatgccttgcgataaccggagttaataatatacaattctctactctatttcaaagctacaactatgatagagatcacacccgtgaaaacaacaccttgctagaagtgatttagttcagcacgtaccccctcagacgacatgctctaatatttctaaggtgaaaccaaaccaaacggtataggttttttttttgttgaaattggtggacctttgattgtaaattgtccgtgttgagggttaaagcacaccttcaatatgtgattggtaagacggtcatgattgacataagcattttgcaagatgcctgtatttcaatatgctggtcgcatgcggaaaggcatgtgatgtgtaagattttccttatcttgaattttttctagggtttacagacggtgtatgttcttttatttgcagcagacttccttgaagcaaatatatttttattatttgaagcaatgatctgactctggaaacaacgacagtcgctcactcttcagcctgtcagtcgttttattgctttcaaaaactcagggatagtaatcaagcaagatcatcgtagctttaattgcatcactggaaaggccacatagagtacatttagaattgagatggtcttgctaatgtgggacttttcaataccctgcaaccatatcaacgataatgtttacaattgacaccagcacttctgcgcaaatgagtgcgatgacgatggattcaaggtactcatctttggagtgacccagttgttccttaagcatttgcagaagatcagaaataatctctagccgctgatttagtagtgcagctcgctgctcaatttctaaataccctcttgtggcttgataaatgggctcaagttgcggttcagtccacataagttctggcgaatcgagtaccgatccatgtagatttatgttgattcttagaataaaaagctctccaatacttttcatgatttcttcacgagtcatcgcaacctcaccatcaacagctatctgttggggaatatcttgagtatcttctatggtgttactgactaattcctcaaaaagtgatatcttaaccgattgagatatggcatatgagatggaaagctttattacgtaattcccattatctctcaaagtgatgaagtcgttatagatcctgggctgataagattttgtgatatagtagttaaactcctctacttgtacgtcctcattggagagtttttcattctcaaacttagcaagatccaacaagaagcacttctcctctcttctagtaaagccccacataacgacgactccatactcaaatataaataaatcacttttctttctagctagatcaatttttccgccttcgtcatctagcatgatgaatttgtcgttgctattttctttctgttccttggtgtctataaccttattagcgtttcctcgccagtctcgataaacaaatggtgtgtatatacattcatcaaacagtttaggcatggtgctatgaatctttctgcgatctttcaaccacctgattaaatctctcatcttataagaccctgctgtacaataggcagtaacccgtggtaacattgaacggtgttttttacccaatctttctgcatcttttcgggccgttgagtcttttatttgcgtaatttgtgaatatacacctcttccactctctttatcgttgtaatcattttctggtaatagcttcagtttttgggttgtcttagatgatcgttgaggtgttatttttggccccagttcattcgaaatcgggcgattagattttcttttgagctgttccggatttctgtcagcagcattcgacatttccaggggcaacaagactgttctttcagagggttcttttggcatacaggggcagggcgaatgacgcttgaaagcattgtctctcgaaatgctgtctatcctacgaaggaagcttcacatttgtctcttaggtaaaccatccgtacaccatcatctcaaaatttttagccgcttttataaagtttattcctcttgattcaagcatactagacaacacatggcaaagaagaaaaataccaatgaatcgtctaggagatatcagttcaggtcctttagggatcatatagaatctataaagatagaacccaccctaaagctttcgaagaggtcctttgattatgctgatgtttcccatttcctatctgccctgaatcactggagagaattgaatgcaactagctcctttatcgatctcgttgacgaggttacaccaattagtcagactcttccgcagttattatatcataaagacgcaattttcaatgctttagaaagatctcttcaaaccaaccaggcgttaggattacggccagttcttgagatgactgctcaactatgtcacgacctaagcgaagacttcctagagtattatgagagaataatgaaagttcttagagatttgtctgtaaaacaaactgatgcagcttgcttagagtggattttcgactgtattgcatttattttcaagtatctagtcaaatacctctcgcagaatttgattccaacgttcaggtatttgacgcctttgttggagaatgacacaaaaagatacaacgtcgtattttcttctcaggctttgtcttttttgattaaaaaagctgcccccaatgctttaaaggacttgataaagttttcgtttgaggagccgaaaaagatgaagactttccacaaaacttattttgaggctttggtaattatgtactctgagtccatgaaaggagtttcaggttccttgcacagcaaatctgaccagattcttgccgctctagtttcttatgttgtcactgaacctgaacacgacatggccactactgtgttatgtgatacgttatccaatgttttacgtcatacaaacactagagagcaagcgagaggactgaatgaacttatattggttcaattgaatgaggtactagataagaacgagccccttgaatcatatgtctattgttctttcgtgaggatattaaccgttttggtatatacggacaacggctctaagataagtaactggacaaaaatcctccagactgcagaaagagtaatagaattttcttcaaacaatgaagagaagaggttttgtcaactctctttgaatttatatgcggttttactgaggaactgcgagatgtcagatatggctaaatattaccgccagttattcagcagagccctttccttcaaatgcagtttatttctccctttcattgagctgtgtttgagtttaaatgttcagaagactgtagctttgtcgaacgcatacctgcagcagttcatgacagaaaactggcgaacctcaaccaaagagataacatactttattcataagatctctgagatgaatttactctctatggcagcagacaatcatgggttcctgaatagtcgtttttccattactttttctcccgagttgcctcatcatctagttgctcaactatgtttagatgacgagtctgacgaggcgatctacgagaatctctggagactcaggttactgaatttaacaggttcaaaaattgatcccaaacttgtccacattgtaaggaaggtttttgatgcaagttttagatccaattcaactttgtctaaagagataattgggctcactttaaagacattatcgagagtagaccttgattcagaaactatgggtcatgttgtgaagaaattactcggatgtgcagattctcataaaactaacgtccactatctagaaggtgctaccgaatttttgagtggcttaagaaatgaggtacctttggaaatgttgaatgataaccagttatctctcattcagtccttttgcaccaactgctcactgccttatcacgaggttcgtaagagtactttaaagttgatcatagttattcttctcaaaataaatgacactgaacagacagtgtcattattgcgcaaatgcttgttgatagaagatattcccctctcttttgagtctagtcgagacatccagttgagactcaggaatttagcctcagattattcttcatcaccccctaattacctaagtgatattgtcgtgctgagattcttttttggccaactggcaaacaaattttcgccctcctggaaagttatttgggaagtattccccaaaatagctgcaaaaaattgcaagtatgtctgggaacttgcctattactttttgaaagatcctcaaaatcatactgctgaagtagaggcggatgatagttttgattttttagggcgacaagaggaagcttttagccatcacagtacaaatccttggtcgaccatttccgatacaagatttgccaaattttcaaatgcttcagctcaattcttttcatcttacgaaaacatttcattttcattactcaatactctggtctatactccggatgatttcaatggtatcttttcaatgagaagtcaagttttaaaaactttgattacttttccaagtcttcctcaagaacacagtatagatcttgtgccttttcttcttaacaagtttgaagaagattgtgaattaaaaatgggaaagtaccaggtattctctgccgctgataaggcgttgcttttagatctttttacagagtttccggaattgaaaagcattgagtacagtgatcggatctatcattatgctctcaacttattgaccagtagagacgacagacgccaaagattggctctgaaatgtatatttgcattcaaaaacaaacacattgaaaagtacagggataatttggaaaacttgattgatgacacttcattcaaagatgagattttcaggttagtgagcaagaatcaagacagtaacctgcttgaagaagaagatattgattatgttatacccctggtattaagaattttgtatggtaaacttcaaacagctaaagggagtgactcgaaagaaggaaaaaaaaatgctgttctctctattttgcccaatctgcaaaaacgtcacattatatattttctttcgttgggacatgaaaacattgatagtgaatcgtttttccgtgaccaaaaagtcaacacccataccgtttcagagaaatctttgaaacaacaagttggatttgttaacatgttgcaagcagtagcgtctactttgggagaaccttatacggaagcgttgggttactcagttaaacctctagtctattctttatcattggcacagactcttgtccagactaagaaagatgatgttaaagatgaatccgaagttcaaatagaaaagttggcgaagaccctgagacagtcggccatgaactgtttgagaaaattttttcttgttcttgaccctcaagttttctcatgggatgagtattttccactaatattcaaatttattttgaaggagcggttgcttaaaattttaccggaaaattcaagacaagcatcttctattttaaagattttatgcttgtggtcaggagataattattatcattacttatttaccgaagactttcttcctctcagagctgttctatctttattggatacagagtatttcaactgccaagttttgaagatggtgctcaattttgtcaaaacaatgatcagcagggttgtcccagatgacgtttacattgaagctatctctctgattgtggaagctgttttgaaggtattggctccactcttagaaaagatagaagagcctccaatactaactcttgggatcgatgtacttttgatcctggtagagaatgattacgtcaatgaccttcaaatcaaaactcagttgatagaagctgttactgcagtacttaataagcaaaaactacaaatagatcagcttgacagaattcgagtttatcagactttggcttctttggtggctaatattgcttcaactatcgaggaaattaatcctttatatcaagtcatttccaaggcctatgaaatcgaaactcaaaacgacattagactgatgattgggagtgtttttatgaaacttcaaggagagtatgaagagctttatccggttggtgatttggtaaactctttgaatgcacatggacctaattcagataaggacattgattacccaacgaggctaagagccttcagaagaataaacgaagacttgtttctgagtttgacacaactgcagtggctcccaatcctttacaattctctttatttcatcgatcatgccgaagagttatcgttgagatcaaattcctcctttaccctgagaagatttattgagtgttactcgttgaaggaaaccatcgaagctgcccaacctctaatacagattctaaaggctgtagtgctaccgcatttgaaagaaggacttttgaatgaaaatatactagttcgaactgaatatattggagtgttgagaagcatcgttagtgtatcgcatcactttgatgagttgaatgatttgaaggtactgatcgcccaaactgaagagagctcggtgttcaactctgtgcaatttgcggagctacacgaaagtgacgaggacaaagttgactttttcagtgacattgttaacattcaaacgtattgtcgtttttcggccctggaaaagcttagaaaacatcgtcaagatttgtatgttgataacctttatgaatatatccttccagtcattgaaacagtatgtttttccaaggatgagaagcacgagcaattggccattgaggcaattgatactatgggatatctgtcagttgtgctaaaatggagtcagtttaaactactaataagaaagcatcttgctcgcttgaagcgggaagttacagttgatggtttaagaaacaatataaatatagttgttgctctttccaagagcatgtttcaatctgttgaaaactataaaaaaggtgacaatttactgaccttcaaagaataccctacagatgcagaattagaattctttgtcaagaggaccttacttccctccatgataagtcgtctaggtgtttcttctatacaagaagatgaggaacagaacacggcatctatccgggttcctttgtcacttggaatggtttcggcagtgatgtgtttggatgagcaatcaatgattgctgaacttcctggagttttgacagggatttgtcaacaactgcggtgcaagatcgagtcggtccgtgatgctgttagagaatatcttggccgtattgctgtgcttctaggcgcgtcacactttaagtttattattaaggaacttaagggtgcgttgtcccgaggagctcatgttcatatccttagttacacgttatatcatctgatggtccatatgaccaagaatgatcatctcgcccatggtgatatggatgattgtgcccaactgatcattgatattattatggaagacacatttggagctgctggtcatgagaaagatgcagatgcttatatcagtaggacgaaggaggtaaaggaaaagatgagtttcgaaacggccgaaatcctagccagaaacatctctttgacatacttttctgctcttattcggccagtaaaacttcttctcaaagaacgactttcctcgaaggtgcgtactaaactcaaccagttaatgcatagattttcggtaggtttatcttacaatgatgaggcaaatacagcacaagttctaagactatgttatgaattatatcgtcaagcccagagctacgttgaagagaaagagactagtaagaagaagtcaaatcgaaatgttgatgactcgtctgcccattttttggtacaattagacagcaggcccttgaaaacaatgaatgaatactcacagagcgtgggcacacttgagaaattcgcattcgatattcttggaaatgttttagcagaacatcagaatctgttgacagtgggtaacttatccatgtttttgcccattctggagctatcgctttcacaaagtgatgatgatgaagttgttgcttccaacataagaattatgatccttctggttcagttgccatttcctgctgagaagaacccattttttcagcgttataccacccaagtgctaaaaatcctacgagagtgccctaatacaggttcagagctttgccaagcttgcctaaaatatctctctggagtattagagtttaagttccagattgagttaacaaaccaagacattaaacatatattattacaaattcaacctgatttagccgaacctcccaaacaggaactcgcttttgaatttctcaagtcattggtctctcagcacgtaatgcttccagagatatatgacattatgaatgaagtagctgagatcatgataacaaaccataacaaactgaccaggaagttgtcgctcgaagtttatcttcaatttttgatggagtacgaccaaagtcgaggacgattggaaaggcaatttatgatgctagttgataatttggattatcctgttgaaacaggtcgtcagtcggtgatggagctattgcaccacgttgttcagtcttcggatatcggtctgataagcaaattgtcttcgtcattttttgtatctttgatcaatgtatcaattgtggacgattcttcaaaatgcagggaaatggctagcctattgattagtcaaattttgaaaattctctatgagcattcatcttcagaaatattgttgaaaattattaaatatgggaaagcttggacgaatcatgaaaccacgatattgcaacgttgtggtcttcacacctacaaactgttaattcagcaaactggcgtgggctataattcagaatttgatgccttaatattacaaacttgtcacaaagtctttgcctctgctagtgctgcgtcaactgcaatcattgaatgggagctactgttttattgtttgaatacttttgcctgtatacttgaacatcgtggggaacttgagttgaatgatgcccgactgttaactatttggaaagatttgattggcatccttctatttcctcatagttggatacgactcttagcatcgcgcatcatcggttcccttatagagcacaccgctgtgttcatgactgtttttgaccaatacgatgcccaaactatagcttataggctactgcatcagctagatgctccacaagtgtcggagaaattgagtgagcaagttgtcagaaatctgagtagcttatcagtgcattggaattcatctaacgccaagtgtttgcaaaaagatgaaatggattgccaatataacactagcttggagtgggccctctctcgagtatgcgctatagtaaggcaggatagtagagcgtcgcaagcgaagaaagctggaattcaatactttgcagtcatcattcaattagtcaatcctgataaattacgtcaactatatgccaaacaaatcattctggctttgtacccattcattgaacgcgagtatcacgatggaggaaaaatggaattagaacagcttgcagaagagtgtgtatctatgttaaattcaaagctaggaactagtgtttttactgaattatttgtcgaagttcagactattgtccaccaaagaagggccgaaagaaaagcccattggaaagatattcaagacactaaacccgaggaggcacagaagctgagagctatcagacatgaaaagaaaaggaaaaggaccaaaagaaaatttgttgacgcaaccttgtcgaatgagttttaccgcgatgacaagcgaacccgtaaaaaatagtagatagataccgtccataatggtaggaaatttaaagttgtgtctgcattctgtacgatcctatgaaaaggaagattcattatccctgaattctgttgtgtctttttttgaaacatctcgtagggactcatcgcccttaacaactcgactcgaaccgacagtttgatcagttgatgaacttgcagttactgaaggagaccagtcatgcacactggcatctaccatatgaggataggtcgttgccttctttttaatgtcttcttgaaaattatcagccggtgcatccgttggtttagtgccaagaagcatataatttttatcagatggatcgaggatagagtcaatatcatgatcaatgtcagcgtcgacataaacgtcggtttcagcatctgcttccgcatcaatactcgctccgacttcgttatcaacatcaacatccactgcatttgaatccagttccatgctcaacggcaagggcaagcgctccactttttgcttcttagtaggtgactcttcttcaacttttttgcgctgatactcttttagctctctctggtaacgccgccgatcctcttcgtagagagcatagtagggtttacgactctcctcgtccaataacttccatgcatcacttaggccacgagaaagatctatgttgcccttgtgcacgccttcccctggttgagcaacatcacgatcatgttgcaaactctttcgaatcttatctttctccagatcgcaaaaaatcaaatatgcgttagttggccgttttggcaaatctggatctcgtggtttcttaggtggacgtttagctttctttgtagaaagcacaggtaaatgttgtggagactttgatgttcctttattaaccaacaccttggaaaggtcaacgtcttgaaaatagctttgtaagagagtcgctcttgagtctgaattggaactgaaatctgcttcattgagcatatgtaatagtaaagtgtactcaaaccgggagcgacgaactaggtaacggaggcgacctacagctaaagacgcgagctcactcgtaccttctagttgacctattctctgcttgagatctttgcatttgagcctgaggcggtctgcctccgtttcggctgaaggtatggtgggtttttgcttcatttatcttaattgtggggtcagaaatgacacttggtgaagctcaaaataaagtacacgaatcaggactgactactttagtcctaaaagcatctttcagttcttgtcgctgacagaagatccttcttcgcttcgcgaagggcgagagtgggaaattgattactaccggtgatgttcgacagtattcgctggacaaacaagtacttgcttggccatccacatgtctgtaacaggtcaagaaatttatgaattacacttgtttatacacatctctctatctaggtcatatatcttaagtccgaacctgtgctagccctgagtgaagtctaagccacatttctattatcctcgaactgcactccaatggataacagatgtatggagaattggccaaaaatgaatgaattacttcatattgcgttacgcagcggaatctattcagtttggacatacaatacaaaggaggatgcccttccgaagcccagaaattgtcaggattctttgagtggtgcaagactaacacaattctttgtggttatcagatacttactatcttcccttgggaaaaggtatgcctgacaacaaataaatagtattcatcatttatcgctattgaaaatctttcttcgaattcgtttaaataactgaatctcgtttacacaatcgcacttcccaaagtaatttatgaaactaagattgcaaaatgtaatgttcaaaacagacaacggcggatgaagctaaagaaatcgcagaagacttagctaagcttaactgcatcaaaaaagacgtgctgccttctggaaaaactctttgaaaagtcccaatttgtttgaatctgtttgcagagacttaatgggaatatgtctttcaatcgacccaccatcttcaggtggtgctccacatctctgcatcttattcttcaagttgcgatctccatctttgttttcatggcgaccatgataagaggatggctttcgatcgtgaagttgtttcatggttttctcagagtggtgagctgcaaggtagctgacatcctccttcgagtatccgtctatttcgtgatactggacgtggccaaccctgttgtgataatttccaaatactttttgtggggaactatgagatttgaaatttttgatatattctggagaatggttggggttattagctaccactttctcccaatttgaatgcatataataatccaacttttgcaaatactcttcctcatccaacaagggagcagataagtactcttgcaatggtatttttccaatataggccatgttaccaaatcctcccacaaaataaacggaatccacattaaacttccaccacttggaggaatgagctacctctttacctggtatccaaaacagggaatcgtggtgtctttcaacgaagcatttggtaaccgaaatattgtgcgaaacttgttcagttacgtcatgcaactccccggtgatagatactcgaggggaacctgcagttgatttgaaagtctcccctgggtacttcccattcactttcttatcagttaactgatgatcccccaccttgattgagagagagtagggtgaaccttcagcaatgttcttttgtgaagtggaaatgtcaaccagaagcatcagtggattaccatcgttgaagcaatctgtatagtattctacaaaggagacaggtactccctcgaggtcccctgattggtagattgagttcagttgagttaaactttctctgtgaactaaagtacgagcgacggaagcggcagttttcacgtcgtgatagcttctggatagtggtgatgcgccagcgttagatgctaacaaaaggcacaagactcctgtaagcaacattctttaaagctctgaacaaacgaccagtaaacttgtggtctcttactccctatatatgctatgtagggggtgggaaaataggtctcctgaataaatgctgatatcggaaatagaaatagatcgattgtcttgcagcctgtagtaggacacctaatttgtacaatgttgtggcctcacctcgagacaatgttaagtacactacatgttacctaatactgaactttgaattattgatctgtttctaatgatcagattttgattttgtgtaagagaatcattctgcattcttcatccgtctaaaatgtcagccaaagagatcaagaaactctcagtagcacctgaatgaaatttgtagaaataagtatagacaaattcgattgtcgtttactggctgcccaaaggttagcttctgagtgtcaactacaaatactgttgttaggttgaagtttattgcctagtatacaatctgcaccaagtaattgtgattatagaaaggttattctaccattcttttattgaggaataacagtcaggtgcccaccaataagggtagctaacatctcgtcatctccatttacgggcactcttgaatacagcaagttacataactctaatgaatcttactcattgaagaaaatgagaacctactttgaatactatctgagaagacggtgaccacttttcgcaaaatgggataatgctattagcgatagtattcatgtatatggctgatacatttctttctgtagctttaagaatcaaggaaaaatcaaatgctctcatttgagaaaccgagagtttcaacttagtttgaggggttcatttcaagcgaaaagttttgatatatgattagtccaacctttctctaggactgtattgggatcagttttgaagtacaaaacccattgaatgcacttcacttttaaaattattgctctttgttccatatgtttttatggcactctagtgatagactgtaggttgcattacaagcccggtcacatcacaaggaacataacagatacgccactttttggcagttgatcatggctattttttcactgtcgcgttggtctgctttggaaaagtcagcatttccttacactttggtgttccttcagaaacgatctgcttctcttcacatgatccagattcatctatggtggttcgagtagtgggtgtacattctggctagatgccttcttatcatttctttcgcttgaagatcgcagcaatcatgaatatttccaacccgatcagcatctacgatttccagttcttggtcttgcgagtccattttaaaagtcaggagtgaagcctcactaagaagcatcgcggaggatctgtcgaggggttatccacctacctacacttatcacttattttcctaatcgtttcaagtatgcaataagagctcactagattgaaaacaaaatattcgattgatataagggggagcattaagaagactaatgcaatcagtaatttcgcagtttacaagctgaaagtagattcttattttcaatcactgtgacctttgtagtgcgaatccaattcagagtcgccttcaggtgaaccatgcactgctgaaccaacaaatcctcctggggccccttgctgttgcgagctcaaatgtgaaactttttggtgatgaccattcccctgaaatccgttagaaggcgatgtgaactcaggtgcaccatgcgtacttttcccttgaaatccaccagggctgccagtttgattttcacccggcccacccctgtgatgaattccatcgtcctgaaaacctcctggtgcaccgtttactttgaagaaatgatcgtcttgtttcctacctagcaatttcttgaaaaaatccatgttcaacgtttcaaacagtcagatatgatttaccaatttttgaaactgtttgctgtaggaatctcggaaaccacgactcactcaacaatttcatattttcatattcgctaccgtcgaaaaacgagcaattctagtcgaggtgagcagagcagactcagcgctgaccatgtttaactttcaagaaatacgaactttttttggataacactgtccggaatggagaataccagcatagtgataatatgatgctctgaacttgtgtagaatatcgcctgcgctgaatgtgccacattgcttattaaaggaaaacaatttccaagctttcaaaagagtttaggtttttcgcttccactcatggatcgcgttgctgtcgcagtgtccttttcgtatcatgcatgttcagcaaatgtttagtgattgtaatatactactagatagagccatccagaattcagtggtttagcatggaggagagttgcatgtaagtccagttgttaacttgtaaacaattgatttaacatgattagtttcgttagtcttgactcaaagccctaatgtaattgcatgattacttggtccgtacaccacttgcacttgtaaaaacttctcaagatttcgcattctttacaatacatagcattctcagcaatctttggatgttagggaacaacaagatggcatatttgattgtacactaggtgatgataacatttacagacctgtgctgaagcagctttcaagaagcttcgttatgaggatgatcagtttctgatagtgtataattctgctacttaacatcgtagttttagtaacaaattcatttagatcatacttttaataaacaattatgataattgaatcctacgatttaaacatcaacgttacctattggaaaggtcgagcgaatttcatcaaagagtacttgatatcttaaatgcctatttcttagcagttaatctacgtaagtaaaaagctagttcctcgccctccaaaatatagccgtcgcatctaccagactggcccggtctagaagaaatacaggcgtaaagtttaccagaaaggaactggtggctcaaggcatcctccaaaacggattccgaagccctggaggcctgttcctttaataattcaggggatttctcagactcctcatcaacttcagcttgtgttcgcttacccaaagccttaccgtaatgggcttcataccattgtctaaagggggtaccatcaatttgtacaatagcagacttggtcaaagtgttggttctaacaagttcgttacttgatggatggtacacaacaccagcaattctagtctttctagagacaccctcggatgcccaagagaaattacctgtctccaatcttaaagccctaaactttttgttaccacctctggttctgacagtgtggattctctttggtccaatcttagtgttggcaccttgacgaccagactcaaacttccgcttctttctgaactgtgcacgcttagcaccagtagcggaacgtttatgacgtgaatcacgagaaatacccattctaataactgttagccgatgaagttgaatggagcaatgacttgatttcgcaagttctggtaatttacttactttacttgatgtttaaggaaagagaagtatgaaaagatttttagaagcgaagtcaagtgagccaaatcacatgaccaagttaattaccgattgaagatgttgtgacttttaagattattttaccctttatctactcacgtgattgttatttttctatctttttgtatgatcctttactttttatcggttctacatgaggaatctgtaagaagcatccagtgacatataggtgtactcaaaggttttaatactattcatggaaacaatttatgatcatatagaaatcgaagattttatttttgatcctattctacagattttccagtatccatgtccttgtggggataggtttcaaatctccttagatgatttaaaggacggggaagatgttgctatttgtccatcttgctctctaatggttcaagtagtttttgaagaagaagatttgcaacaatatgtcgatcaactaagttaacatattacatttaaaatatgcttatgaaatgaatcactgagattatggacgacagctcacaaaagggctgagacgaagtcaacaaagcaacgactatcaacactacgatcgggatgtactcaagagtttagcaatcagaggagaaaaaccagttttgggttctagctttctgaaataggccataaactttagccagttagccgcttttctttcatgaaagtttgactaaaggtcacattttaaaacaatcaatgaacataatacttgaatatggcacccagaaatataaaaaacaatatgtactgcaattttgaaaggattgatgcaggcgatttatcgttctggtctgctcgtttggattcattttctttccatatttggtatcgcactttatcttctggatcttctatttctccaatattgatagcaccttcagcagtatcagtgggacagtctagcttccgtacatcggcgatctctctcagcctgtcttcgtgtatttggtcaattgtttgcttggcaagtgctggaaattgaacctgaaatgctgaattttggcaagcattgtagaacttactggcctttgccaggtttaccttcacagcgtcactggtgcttatagatccggtggtggaatcggaacctgtcataaaactcagtaatcccacgagtatagttgtaaccgaccatccaggattccataagtccgggtggaaatcgctcatagagagacaaagtttggtattagtttggaagcgtccatttggtgtgcacatttttatcgaggggggtttgaatggatattctgatggaaacagtagaactccatgatattggccgttgttgtagggggtgtcaggaggaccatcaatgacataatgccattctaaaatatttgattcactaggatgggcggtaataaatggcggagaattatcttgtataagtttatattctttggtaagtcgtcgatgagcttgtttcgtagccataattgtgtttaataggaacaataatcgaaaagtgttcttttcgggatagtcgattagtggtccataccatgacccgcgaaagatttgtattatagggtattaagagatcaaaaaagttctgaggatcttctcaggattcaggatagtgaaaagtttgtcggtcaagccggcttcctccaaagcaaaataaataacactgtacaaattttaatgttgttggatcaataaagagtgatttactatttccttctctgcatttagctggagactattgaaatgacaaactttagaataagactaaaactgatttctcttatactactggaaccgcacaggtaagaaagcgcacctcagccaacgataagtggtatggccctctgccaaatcaattaatgctccagtaaacaatgtctcgattttttttctttttcttgcacttactaaaattgtaagcatcataacgtattagtctccatagatatagacccgacaagtttcaatgactgttacaaaaagaaaaacagcatcaaacttctgtgcggaaactctcatccagacttaggtgagcagatagcgaggaggttagggattgaagttagcaatgtcaaggcatatcaatactccaatatggaaacagctgttagcattggcgaatcactcagagacgaggatgtatacatccttcaaagtggatgcggagaaactgcaataaatgatttcctaatggaattattgatcatgatccatgcgtgcaagagtgcctctgctcgacggattactgctgtaattcctagttttccttatgctcgtcaagataggaaagataagagccgtgctccaataactgcaaaactgatagctaaccttctcaccactgctggctgcaaccacgtaatcacgatggatctgcatgcttcgcagattcaggggttcttcaatattccagtagataatctttatgctgaacccagtgtccttcgttatattcgagaaagaataattgattggaaagaagctatcatcgtaagtcctgatgccggaggagctaaaagagccgctgcgttagcggatgaattagatctcaacttcgcgttgatacacaaagaacgagcaagggctaatgaagtatctcgtatggttttggttggagacgttacagataaagtttgtattctcgttgatgacatagctgatacttgtagtacattggtgaaggccgcggacacattgttgaatagcggagctcgccgcgtggtatcaatagtgacacatggtatcctcagcgacagcgctattgagagaataaactccggaatttctttagattctctagcttgtactaactccatgccgcaggtctccaacaggaggcaaagcagcaagattgatgtcattgatattagtggcactctagccgaagccattcgaaggctccacaatggtgaaagcgttagctatttgttcaagaatgcgcctttataatacaaaaagacttttcagtttgttcttcggtcaatttatcgactggaagttgaaagtcgtgtgtttgggtttggtcttaccaccagtttcactttgtcaaggcgagataactgaattgatcactaggcttgtgttatgagaatgtttggatgggtgttccgagttatttctgtcctgctacccaccatgaacagcctcattgggatgatcaccgtagagagagaagtttatgtagcttttttcttgtaattcttggtagaacaatacatatgctgtggccaagccgacaccatcaccgaagaacctcaacacgtagtcttcattgattgcttcaacagtctcgtcatcaaatagcagccatccaaaaaagggggtttttataagcgaaacataatgaccatgataaggccctccacctatgtgaacgataactgcgtatagttcatacaatttgtccagctcaacagagtcttcagtagtgttgaaaactcttaatgtttttgtataagcgattcgatggaatagcttaacattccgttgtagggcttcttcgtacttaaacctcttcaggtgcagtgctaacacttttggcaacttctttaaattcactgttcgggcagcttcctgcagcgaatgacatgtgtcacagtagaatttattgctaccattgagcatttccatttgggaaaaattcttcaaacaattggttattgaagaatctttagtcaaatcaattgaaagatctagaaacttttcatcccgagaacttattgtctcgcaagcgaggcatttagtctcactagtaagtaagccttcgaatataccttgaaaggtagaaccttcttccgtttctgtaatactgtttatgacaaagttaagaaattcatgagcgtcttgatgcattgatgatcgaaaaagttcattttctttcttcaatatttcaatcagtttgactggagacacaactccgtagctgctagtgttctctgccatacactcaaacaagtctttcatgacggtaaaaagggagagcctcaatccgtattcctcatgaaaactttgatcaagatgtataatgggaccattcactaaggcctgtttcttgcgctgatctgaatttgctgaaatatctgacaccgcaccgacaacggtaatattattttgctggtttacaatgtctgggataaatttgatattcttgaaattgggatacttgaccagcagtccgttgttctcctggtgaaatacgtcagttgaattagaagagttgccactgtgttgcgattcttgcaactgaatttggctagattgatcatcaacaacagtggattccctcttcagaccaaaaattgatgtccgacgtgatgatgacttagtcttagaagatgatgaaccattatcactggacgacgtctgagatgcagcattcgcattctgggcactttgggtttgattattcaaatatgctatgaagctgtgtgtcttacttcctagtattttactttttctctttctggaagttaacttgggattcttgtgtggataggcaagcattttttctttaaaatcggaggtgtagtagaggcattgaagaatactattacaataacacgtgtttccaaaattctccataccaaaaattttgtcattcccatctccaaatggatgattaggattcgaaaattcatcagcgtattcacttcttgtatcctcttcggcggggggctgaaattgatgagtaggggtgcctctaatggttgctctatcttcagtcagggctatatcagaaggagagtgtagagtgtctcgtctacattttgtcgaaatgccacttttctttgacttatctccagtaagaaactttttgaacatgtttaagaatcttaactataggatgctgagtttcaatagagcattctcactcgattaagtaaccaaaaatttaagtcgaggggagaaaattcataccgctcgcttcaaaatctttcttgggttactctgaacacaaatgaatttcgaaagtcttatcatgattttggaaacatggcacaaaaatagaacaagaccacgcggatggcttcgagttcatataggaaaaaatcacattcttggcttgttgtaattgggttcttagtcaaaacagtgtggaaagacttaacactgttgtgatccgagagtcttggagctaatacatcgcaactgcaactgaggagaatacgtacaacatttggcgatcataattaggaaaaatctagtttacaattccattggacaatgtttgtttatagtaaattaagattctattcggttataagccattctagtatagtggttagtacacgtcgttgtggccgacgaaaccttggttcgattccagggaatggcattctttttgtatattccagtgctatcccatagtggtctttgaatcagtcctattcattcaataatttggcatatatccgaacctcaaattgaggcgtctcgttttctcactatcaggtgatctgctgcctaccattacgatcgtgcaccacttgaatttactaactattctagtaggtcgtggtttcattcgaaatcaggaaccacttctcgattggaggaggttatcacccaatttagatattttgatgcatgctacttccagtcatatgcatccttgtacagtaatctagaactggataagttatccgaaattttgtcttaaaacggaatccgacaaagtggccgctaggttagtgggcattatagtaaggaagatctacatttctagtatcacttcaaagaagagtaacatttttttgacattttctttggattggctggtatataaaatagtttcgtcgttagaattgaatttagtatggccacctgctcagtttataattacgccaatcaaaatatactgtctcaagtcggatgcatgcatatgtaggaagaatgcaggttgtcacaatcaaaatggcaaagcgtcttgggtcggtgttatacttaagtcaaatgatcggcaagactcttcgaaggctgaaagacaaatcctatatatatataacacggatacagattttccattagacatggattacatgttgcttgaggtagttcctaggactaagggcacagccacagaggtcatggacacgtcttcatcttcatcatctgccttagcagctggtggaggatcgataggaataccgactattccaggagaagaattgattgaactgttccctttgcaagatggtgttagttttccatcgattttttattctgaggacaccggagattttggaacagatgcaatgacgttggttggacatacagaaacaaacaatgatacaactggcgcaagttctcacacaagccacaatcattcttctctaggtccaatgtcatttgattattccacagacgaagctggaaatgtttacaatgagaatggagaagtgaggaaaaagtcaccatgtcgaacaacttcagtttccttgaaatcacttagaacctcacctcctgcttcactacctccagatgtttccacttttgcagacgagcacgctttagattttgttcatgccccaaactctcggattcaccagtatcgcaattatcagtatgaaataatccagggtatcgcagatgagcccattacatgtacaatgtacgacacatccctggatcctttagataactccaaacctttacctgaatcagcctatgggtccagcttctcatatccacatctgcctcaaaccatctcaccagttatatttaaaaagcaaagttcaagtgtttcatcgtctgtaggcaatacgtcagttaatgggtcaacacaaagaaaggttgacgaatattcgggtgatattgcctacttgggtcagtcatgcgaacctactctttctcttgttgaacagctcaaaaagaatccggtttttgcgtctaaacttcttgaaacaaaaaagggatcctataaatgctcccactgtgcgcagtatttttcgaatctaatgctatttgccgctcacattgacaaatttcagctggagcgacggtatcggtgtacttacgacacttgcgtatggtccgtcattggcttaccaagactggcggagttcaaacgtcattactactctcagcattcaggaacaaaaattgaagttgctcgcagtaaggaaaagaagtttcagtgccagcaaagtaactgcaacaagtactttgcccggaaggattcactcctcaggcatcaaaaactggttcatgataatattaacagtcgcttcaacaaaagaataagagcaggccgaccgggacgaccaggacgtgattgaatgacgagcgaatccagccattaaccaagataatgttgattaattagtattcaaaggtgactattatcagagcatttgaggtttaagcacaaaatcatcagaaacactagaaagaagacagtagtagactagacgaatgaagagaatgtcttcttcatgcaggcatatgcatgaatcttgtcaacaataatgcaaccatgtttccgattgtcggtcagcgcttcctaaccacggcgggtccgtagtaacaggtggaacgacagtaaatattaactgcagcaacatatcgagtttgactttagctccgtgccaaggcaacaagcatactctaaatgtggcgtggcaccaattacaacacgggagaatgttgtaagaggagattggtttttaggtgaggagaatgtagggccatgtgcttccataaaaatgaaacagtccaacagtaagcaggagtcgattttacgactaccacaaaggtctacaaatcaatcgactgtgagttgttgttacgatagactataactagtgtgttgatattttgttttgttgtgtagttatgtatgattagccctgaatcagacaaagaaaacaccacactgataggcaaagacaaatagtgtacgaataagtaaataattaggagacagttcttcgttgctctatgtgaagtagactaggattgacttatggttggattgaactcgtaccataaatgaaggttagagagtgatttccaggtagacaccgaatatacggtgaagttcttttctttttagtcgacaagtaagagaaatggattctacgcaatctgaaaagcctttcagtctaatcattcatccttccacttccaatgtgtgaccaacgcccaaagcgttcaaagactaatgtggactactcgaattcagaccttcacccttggtccagagcatcaaaaattaaaagccataagatcaaaccaagtatgatacgttagttgataccaaatcaacatgttaattacactcactatctacgaaaacttcatttggaaggatccaatggagtaagtctcaagtaaggtttaatcacacgaaactgtggaaacagactttttgcttcctcattagttactgatggatgaacgataacgtcgtcaccaggaacccaattaataggggtggttacacggtttctatctccagtctgtaatgagtcaatgactctaagaacttcagcagtgttacgaccagtagaggcaggataagacaggatcaacctgaccttcttttttggatcaataatgaagacggaacgaatagtgaattgtactcctttatcatccacattagaggcatcttgaaaatcaatcatgtcatacgccaaagcgatcttgcgctctggatcggcaataatgggaaaagtcagatgtgagccagttacttcatcaatatccttgatccacgcttgatgagaatcagtagtattggcagacaagccaatcagtttcacgccccgcttctcaaactctggttgcagtttagcgaaagctcccagttctgttgtgcagacaggggtaaaatcatcaggatgtgagaacaacactacccaggaatctccaatgaagtcatggaaagagattggtccacgagaggtttcggccttgaaatcaggagctgtagaacccaatctgagtgtagaaccttctggttttggaattgacattgcaagttacgattaaaaacttacggacaatggtgggagaaccagacagttatatacctgaaaaggtcaaatagagatggtacactttcacgtgacctgatggaaacagatatctttttgacgacaaattcagtccccgggttacacagtacatcagattgtattgtgacaaatccctgcgccagcagcgcaagatggttatcgaagaagaacccaatctactagtttcatactcttgccacctcacacactctacaggtcaaaaatttgttacccagtctattcacaagacataggtctcattatgctttctacatagatacacagtatctctcttgtcccttctgtggacagttaacttatggcattaatcaaacaagccggttaactcagttgttttctggacgtagtttgcggacttcctttccaaccttccaaatctccatattacggataatttccagttctttttcaagtttctccctataatcaggttgtgaattgaagtcaagagaacgttgagtttccttacctgtctttactgaattgtaaagatcttcgaacactggcttgagggcatccttgaaaattggataccagtctaacgcacctctacgagcagtagtggagcaggcatcatacatgtaatccataccatactttccaaccaagggatacaaagactgagtagcctcttcgacggtttcgttgaaagcttctgatggcgtatgtccattctctcttagaacctcgtattgtgccaaaaacataccatggatacctcccattaaacaacctctctcaccgtacaagtcggagttaacttcacgctcaaatgtggtctgataaacgtatccagatccgactgctacagccaaagcaatggctttttcttcagcttttccggtgacgtcgttccaaacagcataggaagagttgattccacgtccctctttaaaaagggaacgaacagttctacctgaacctttaggagcagctaaaataacgtcaatgttggaaggtggctctacatgggtaaggtttgagaaaactggagaaaatccgtgagaaaagtataaagttttaccttcagtcaataagggtttgacggtagaccaagtctcagattgggcggcgtcagacaaaagattcatgatgatagaacccttttttatagcttcagtgacatcaaaaaggttttcaccaggaacccagccatcctcaatagcagccttccaagaagcgccgttctttcggacaccaataataacattgagaccattatctcttagatttaatccttgaccataaccctgagatccgtagccaattaaagctaaagtgtcattcttgaaatactctagcagtttctctcttggccaatcagatctctcgtggacaacttcttcgacaccaccaaaattaatggttttcacaccacgactaaaagtcaactgcgaacgagcgactccagtggcagaattcagtgtcgttggtcttaatgaggcttgagaagcaattctgaccaaagttctcttagcaatagcagcacggcttaaacgaaaagtggcatttcttacggacattttgtggagacgatatttggaagagaagggaagaaaattttttcggataattttttaaagcgagaaagtcacccagcggatatgaacgcttattgtgtgccgcacatcatattggcgtttgaagtcgcggtttcgagattatctcttaatttgttcgcattttactttcaagcgcaacacaatgaagtgctctaatattacaaagattgttggaactggctcacttggaattgcaacaggcgtccttgggtatgcatgcttacgcggaatcgacaaccttgtcacgttgatcgataacaacaaactggaccaacgaatgcgaaggttagtaggacgcgttcttagatccacacggtacattgttgccatatgcatgactactggatcttatctgctagtagaaactttcagaagatcacctgccagtgctcgacacttatacctgatttatgccagtcttggtcttcctacgcttgcactttactacgggtggaatgtttggcctctggaaacaactattctaaagaaactttcacgaagtcaaaatggctcaccactgcaacaaaagaaacaagacattactgaaagatcttctttagatgggtcagcctatgtttctgtagaaggagaattgatggaagataatgtcgaagatgaagtggagtgggcgattgaacggaatcaagttcgaaatagcctaacaaagctaggtaaattatatgctaagggaactttgctttctggcctaagtttttgtttagctcttgtcgggattctaggggaagtactgtaagagaataaacctaagagggtgacagattccgcgtagattagaattgcaaaaggaggaagacattttgtaactcgttctaaacttattacccagttttttgtgtgctgtttgataggagatgatgatctgcacaaccaagggggctgtcgttgtcttttagtttaggtacattgtaacgaggtggatgcgtcatgattatctggaaatatgcagcccggcttttttaagaaagtgatccgtagtttgaaacatagggcagggtcaagagcagcatcacaatctaaatcgcatgtttttttggtgtatttttcagagcaaatgctgaacgaagttagattgcttatattcaacctatgcttcgttttcatctgatccgaatatggcattacggtggccagcgaataataggattgattatcttcctttttaaattgtgaggtagttcatattggatttcaagtatttagaaatgaactcatgaatcaatgactgactactcaacaacatgattttgtctgatgtaaagcgacagggtattactgtcttaacttttgttattatatagtaaaaattaggcctcgtcgtttatggtgcgaaggcgaacgtacgtacatcattataatttttgacccgtttatccacttgacagaaaagacttactgtaaaagacatgatagcgctgcaaacaatgtttgtcttattagttggttgattctagatacatccatctattaccagttacgatttcatattcttactttctttaatacctcatatatcgagagatttgcgaagcaaaccaatttacggaagactttattcttccattaattggatttggttgcacattagcggttagacacactagttgcatgattgacgaattggacagatgtaagtatgagatttgcaactgatatgctctttactaattttcaactctcccctctattaaacaaagaaatatcagtctccgctttaacgtctataccacagccattaatacgtgatcgctcatttttagctcttacctgttctaactccttgagataatgatcttcctctccagttacataaactccggtgaatacacccacctcaaatccattaatcttcggaggtggttgggtgaatgcaatcctagttgagggtaactcggatgggagttcgggctcctgaacacaacaggatttcaaatcatcaagtgactggtaaattacatcgtcagcacctatcaagtcagatacctccctttctgatcgaccaaatcccaccaaagcacgtgaatctgcgaggtcaatgccatatatatgattgtatcgtatgactggagagcatgatgcaaagtatactttgttagcgccagcttctcttgccatgttaacgatttccttggacgtggttcctcttacgatcgagtcgtcaattaacaaaacgttacgaccagcaaactcagaagacatagcgtttaatttacgtcgcacagacgaagttctttccttctggttcggcataatgaaggtacggcccacataacgatttttgacaaaaccttctctgaatggtatgccaagcgtcacggcacattccagagctgaaggtcgagatgtatctggaacaggtatcaccacatcaatttctctaactacgtttaaggactgactggtaaaacgagaggtgattttctgggctagtttgcgccccattgccaaacggcttcggtagacagatattccatccataatcgaatcaggtctagcaaaataaacgtattcaaaaatatccggagtgtaggctttcgcaggaacaatttgacaaaactccggaggccctctctttgtgataataacagcttcacctggtaaaatatccctaaagttgtgaaatccatgagcctttaaaactacactctcagaggcaagcatataatcgcattgcaagtgagtgtcaccgggagtttgggacactctcacacgttctccgacgactaaaggtctgataccatgaggatcacgaaatccaataataccatagccggccaacatactgacacaagcataagctccacgacattctctgtagacaccaacgagggccttgaaaatgtcttctgagttaactcttttcttgtcgtactgagccaactcagcagcaaaaatgttcaacagtaactcgctatcactatctgtatttatatggcgatgaagaacatcatctaatttctggcggagattacgtccattcacaagattaccattatgagaaagtgcaattccgtatggactgttaacataaaacggctgcgcttcgctcatggcactagaaccagcagtcggatatcttagctgcgcaattcccatattacctaccagccctttcatacgttgctccgtaagtacgtccttggccattccattacctttgcattgataaaaacgtcctcctgcacaggtcacaatacctgcggcatcttgtcccctatgttgcaaaaacatggctccatctaacaattcagctgcaacatcttctgactgatcagccaatacaattccaagaatcccacacattatctgtgtttatattgttcaatgaatcaagtaccaagtgaagaatcaattcatgcagaatttttttcttactaccttgtcgcgcctgaaccaaaactttttcgattaatgaataaataacatttggctacgctgtggtggtctggtctacgatcagtttaaagaaaagactatacacaacttgtgatcgtgtaggccagttgattaacttttattttttctaagaaacatcaaaaaaagaactttatattctagtcaagaaatcaggcgcaatcggaggtggaacataaaagcatttgccctcgtacaaaatttaaatttgcctgatagctcgctgaaattcagtttggaatcgtcgccggtcttgagtcattcattattcttaggcttaccatcaatcgtggtactgttctcagactcctacctagcacgtgcccaagccagtttatagaatcgcaacttaatgcaggttatcgcatcagtaatacttctacggcatgattagttggacattgactgagaccgtaacccacaaatccattccaagccattagtatttagcattgttagctgctgcctccaatcaatcttttgaagcaatctatttcatacaatgtttcttcgaggccgctatcttttctttttattctgatttggttcttgctaaaaaatctcatgcagtgttcagcgacccactcttggcatcctaaccagtcgaactcctatgtggacctggtgtctcaacagttcacagctagtaataatttggagcaagcttctaatacgaagagggtaaagaaatcatttgctggtactctagacgcgtagactaatagacattgtcagctttcataagctgacagaacagccgcactaccagcttatctgctgaactttgcgctccaaagagctgcttcttttggccgcaggtaatgccgagacaagacccttcgcgctaaggttgattattataaatacccttcaacctccatcatagaagaaccaaagccacactatgtctatggagaatcaaagattggataattctagtgatgaaaaggagaagtcacactccgaatatgtgaactcggtacattcggcttcaatctcagattctgactttgagccttacaaaatgactgcggatcaagtagtacagtattttcaaactgatattaatcatggacttagctctgctgttgccaaagagcatctggccaagtatggccctaatacactaggtgaagggactaagatttcgattaccaagattgttgctcatcagacttgtaatgctatgattctcgtcctaattatctcaatgattattgctctagctattcaggattggatttctgggggtgttataggtttcgttgttctgttaaacgtagttgttggttccatccaagagtttaaagcggaacagaccatgggatcattgcgatctttaagctctccaacggctagagtgataagagatgggaatgaccaaacaataccttccgaagaggttgttcccggagatattgttattgtaaaagttggtgacaccattccagcagacatgcgattgttcaacgccatgaattttgaaactgatgaagctcttcttactggggaggctatgcccgtagtcaaaagtcctcatgatgtttacaagcaagtggtaccagtaggtgaccgtctaaacttagcgtatagtagctcaaacgtcaccaaaggtagagcccagggtattgttgtattcacggctcttgaaactgaaatagggaagattgcaaagtcgttgagcaataagacttctaaggtgcgaacggttagcaaggacgatcagggaaatgccaacgcttttgcttatctcagagccggattcggtactataaaggacaatgtgctttcattcttgggtctaactgtgggaactcccttacaaaagagattgtcaaagctagcaattttcctattctgtattgcggtcgtatttgctatcgttgttatggcttcccagtcttttgaagtaaacaaacaagttgctatctatgccatctgtgtggctttatccatgataccttcctcgttggtcgttgtcctaactattactatggctgtgggagcaaagattatgattagtagaaatgtgatcgtaagaaaactagattcactggaagctttgggtgctgttaatgatatttgctctgacaaaactggaactttgactcaaggacgaatgattgccaagaatgtttgggtgccggctgtgggtacttttgctgttgtcgactccactgatcctttcaatccgaccttgggaaaagttgagtttattcccaaatccccggtacaaattttagaagatgatgagaatttatttcaagtgtacgataaatttgaagacggctcggttcagaaagagttatttcacaaatggttattcactgcaacactggctaacattgctaaagtttttgaggaaaaaaatgacaatggtgaagtagtctggaaatctcatggtgatcctaccgagatcgctatacaagtttttaccacgaggttaggatatagcagggatgacttgtcgtatgattctccggattctccgtacgagcatcttgcagaatttccattcgattcgtcgatcaagcgaatgactgcaatctattctgaaaggaaatcaggcaagcacaccatttatacaaaaggtgcggtggagagagttctcgggtgctgtaataagatttaccaaacagacggaacgactcgaccgctcactgatgaagaccataagaatattgaggagcagatgaatgcgttttccagtcaaggattgcgagttctttcttttgcccagagacatcctgagccagaagatcattggaataatgttgatagagctgtggtcgaatcagacctcacttttttggggcttattggtatttatgacccaccaagacaggaaaccgctccttctgtgaagatgtgccacaaggctggtatcaacgttagaatggctactggtgaccatccctccactgcccgtgctattgctcaagaagtaggtattttaccccataatttgtatcactacgcacctgaagttgttaaagtcatggttatgactgcgacggagtttgatgccttaacagacgatgaagttgacgctttaccagtcttaccactggtcatagctcgttgtgctccacagacgaaagttcgtcttattgatgcacttcatagaagaaagaagttttgtgctatgactggagatggtgtcaacgattcaccttcgttgaagaagtctgacgttggtattgctatgggtatgaatggttcagatgtcgcaaaagatgcatctgatattgtgctttcagatgataactttgcttccatcctaaatgcagttgaagaaggccgtagaatgggggataatattcaaaaatttgtactgcaattactggctgttaatgttgctcaagccctatatttgatggtgggtcttgttttcatggatgaagctggattctccgtttttccgttaactcctgttgaagttttgtgggttattgtggtcacatcatgtttccctgctatgggtttaggtatggagaaggcttctgttgatattatggagaagccacctaaagaccccaaggataatgtttttacctgggaaattctttgtgatatgttggtgtatgggataattatggctatttgttgtatgggtccgttccttatcgttgtttacggagatggtaatgctagcggtgaacctcgtttaggtgtggactgtaatgatgcatatagttcctcctgtgatgcagtattcagggccaggtcttcctgttttgctgtgatgacatggtgtgcccttattctggcttgggaagtgattgatctacgccgatcactgtttcgtatgcatcctgactcggagactccatatacccagtttttcaaagatgtatgggacaatcagttgttattctggtcagtttgtcttggatttatcacactcattccaacgatctatattcccgtcattaatacaaaggtattcttgcacaaaggtatttcttgggaatggggtgtttctattggatttgcgctcgtattttggataggtgctgaaggttggaagtgggtgaaacgtatttattaccgccgaaaggacgagaaggccagaaatccggaatatgatttggaaaggaatgatccgttcgcacaatatgcatcattttctagaacaaacaccatggacaaccaaaagaagttattcggttaataagaggagaagaagagaatagtaacacattttattgtatacacttactgtaagactgtagttcaaaccaattttcatctgtggtcagagacatacctacatgtcttgactactctgttagattaccttaaatcctgatccttcacgattttcaaggtggtacccaaatgcagtgtgtctccaaataactgtatggtcccttgtcttgtgattttatttacatctataattgtaatgcttgtgttatatggtaccctcagctgttcttctcttatgcttgggtttagacagtagcctagatcggagtaaagatggttgatgaagttggtaatgactcccccatgggtacatatcagaaagtttttgtaatcacgggagattcctagttcttgaatacgcttccattcctcgacaagtctttcaagcagcttttctctagactctcctagatcacggaattttggaccaaactgctttaaggcttccgataaaggtagcccttctgcttttcccatatttctttctcttaaagcactagttgatggaatgttcccccatgtgctattttgaagccgcaagatttcttgcgttgtttgtaggcatcgcttaagatcgcttgaaagaattccatctagcggaatagatgctaatctttttccaactttttgagcttgataaatcccttcggaattgagttgcgtgtccaaatgtccttgcatgatcttgagcctgttgtgatcagtttgaccgtgtcgaacgataaatattcgcagtactgatgcttcttggttagtgaggttatctagggtcatagggtaacgacaaaatttgttatctgccttgcgtagctaaactggcaaaccttcggtgagtacggtcggaaaatattgttgcaggagcgagcactaccgagattagatcagattacactattaaaacactcttggctttgaagtattaacttttgtactactcacttttaacttggatgcatctacagttggtaaacaatgtttccattctgtcatgaactctattggtctcgctggtgcagaaagtagtttcttactagtataacttagtataacaatgattcataagcttgtcgtacactcaccaataattgtagatttttttaaattctcgttattctttgaccaagcgttcatcacagctgtaataaaatgtcgaccactgcaaggcgttactttagagtcacagtaccaaaaggatcgttattagacttcttcaaaagaggatctaatcccacagaggtagtgaaaccacgccacaagaagtcaactgagcaactaattgaaaagattgaagagaaccaaggggaaccatcatcaagctcaaagtctacctttatacctatcattggaaaggacagtctttccggtagtaaatcgggtaaggaacttaatgactttcaaatacatcgctggattcctcgtcgctcgatttattctaagaagctagcagctagcttccaataccaaacggctatcaacgttgttttggattccacttacactcacgttacaaggcgctctattgatgaggcagcagaattaagtgatatccaagaacgtttcaagctaatcaaaaaggtacaaatcaactttggtttgattatctccgacgttgagctcactcgtgtccatactttaggacaactcagaaatctattgtttgagaagttggatccctctttgaaggttgtggatgaacaactgccaaatgccatctatgtggactctactgcttatacgagtacaaatgtttcggtcggagaatttttgggatccaaacagaagcaggtaaagttcaatgaactactgaagagagttaagaaagttgaaaaggggactaaggtgggtggaacgtgaaatgtgtaaacaagataatgatgtatatagtttgaacagctgaactcccaatctactctatttatttcttgctaacgtaaaaatggcaacgatggatgctgcaagagcaaaaattgcacctggaagtaatatttcattgggaacacctttcacaaattcagcagtatactcagtttttgttctcggcagaccgtttagcaatgtatcaggtgtatcatcaggtttgtgtataagcagatctactttttctttgtgatcaagtttggacatgtagacacaatccaaaagatcttgatccgttgtgacacttatcaggtcgccttcatcgtcgatatacgagattgcaaatgcatcctcagctattagtagctgccgttcaatattgttgaatttggaagaaattatggaacgaagctgacaaattccttccattggcttcaaactaacccgatgagttcttccgacaggcgttcgaagcttgaaagaaaatggagaattgtaatctacattaagtgttcgagagtgagagttacctgaaaatgaaactgagtcacttggttggatttcatgatccagcggaaactgttgcatctccgagctggttacctcaaatggagattgtgtatcagagtttaacgaatggagagattccgagtcttcttgatccagagaagtccaaaacttattccacgcgggcccttgagtttcatcaggagaatcaaacccagattttacagtttcaactgaacttgaagttcctatttgagtctgcattgttttaatttgagacaacgtaacgtgggtcagtttcagtacttctacaatgccaatgatctcggttgaaagtggatcaataataggtaagtttaaatatcgtccttcaaacattttccgtagtgcttcatgtactgatagttcagaagtagcataatctggtttcggtgtcatcacacgaattacagagcaattttttggattaagatccgcagctattacccgtaatacgacgtccttagaagtaaaaatcccagtaacctcgttatcgttattcgaatcctgaaccaagacagcagtagtcctgttatctctcataagacttgcagcctcctgcaccgttgactttacatccacataaactggcaacgtggtatcgtcgagaaccgtgctcaggttagggccatcaatcattcttttgagattttcaaaatactgaatgacttctaaaggttgctgagcctgcaattccgaattcacaccttccaatgcgtcgtaaagttttttcgaactctcatacatacgctccaattttgacatggcctcgttgtagcacttcgttatatctagtatccctacaatttggttcgtatcgtccacgataggtaaatgtctaaatcccttagttaccatcagattcaatgcttctgaggctttggttgtagtcttgcaacaaagtggactaggggtcataatcgcatctactgttgtggagtttgcacgaagaccagaaccaactatccgaaacgcaagatccttggcggtaaaaattccactaagttcatcattctcatcaactactaggatgcagttctcttttttgaagcccatcagctgagcagcttcatggactgtataattcggcttgcatatgatgggttcagagggcttcagggccataacagttccgggctcatgcttattgcgagaaatagtcttatttctctttatcggagatgaaagaatcccattcacatttcgggtgggggatgtcgatccagtcggacgagacgttcttttcttgaatccctgttcaattcttcgtctaatggcgtcatcctttttgcattgccggcttctagaatcaccggcaaaagtttcagagttaccagaggaattgctcaaggaggagttaactctcgtactatttttgagagacatattatacggatgataggcaacggttgaaaatgatagttattgattgatcaacaggttgaggaaacaagataaagtagtgtattaccctattctagtaatttgtatctttagttattgttcgcaactagcttactgatttgaacgaaatgaagcagacagctagctactcagtcttgagaaaatcgacactcgaatagctcaggacgattataaagtttactgtcgtccatgttccgagatagataagatacttagaggttaattttatcgtcgttcgctctgatttcctttcatgttaaatcttgaatctattagagcatgcatatattgccacctgaacattaaaggaatgcttgcgccattaactcaaagaaattactatttctagaaccatctccgctcacaagtccttcagtagatccacaaatgtttgaaatgtttccaaaattctttactaaccaatttcctttggtaacttatataaacgggttgatagaagatagtatcataaacgtagtaaaaacgggacctgtacctcagcatatagcgttggtgatggatggtaaccggcgatatgctaaggtgaatggaattcagctaaggagcgggcacgatgctggggcagatgccctagtagacgttttgggttgctgttaccgtgttggcgtcaaggccgtgacgatttacgcattctccattgaaaacttcaacagaagtcaagcagaaataaatacgctactcgagctgctcaaacagaagctcctatatctcagcgataccagccactacgctgaaaggtacaatgtgcgtatcaacattgttgggaataaagacatgattccggatgagtttcggtcagacctagacaaagtcgaagaactgacacggtatcatacgaaaagaactctcaatgtatgtttccctttcactagcagagatgacattacatcttccatagccaatgttgcgaatagagtgctttctaaggagttagctgtggcggacatcaacttgcaacaagttagcaattctgtaatagaccgaacatccccaccgctggatattctgatccgaacctcagggcatacaagattaagcgacttcctaacctggcagctgtcacagaatcctaccagcacggttgtctttacgaatacactttggccaaacttcaaattctggcagatgatgtggattctgcttacatggagctattatcaagcgatcaacgctggagaaatttgcattatgaccactaatgactgaagcttattgtatttcagctgataactgtgcttctgagcactcttttgatttcttttttcttcttttccttgaactttgcttcgtttattttttgcaaatagctattatagactactacttctgccaccaaaactaaaagtgctaacagtagtgtcaaagttgttcgaaaaacattgttgtttacgtacttagagtgctctgaccagtaccaagcaacgaatgctacagagagtacactcacaataatattgaatatagtagtcgtttggtgctttatagctttatgcatctcgctaatcgattgttctggatgatctgaatatgaggtattgctcactagcagggcatactcctgttccaattgcttcactcgcaaccctttcatggtttctaagaacatatctgttttaggaaggcgctgcagtatcttattatggtatcctattttacataggtctatcatatacgagcctttcaacatgtctaaaagtggttcagagtcctgactatgttgataaagctgaatcagatcagcatgaagaatgtaatccctgttggccaaattattcttgatactaatgtcaattgcggagctctcaattatcttacgagtagcgcctttagttagcttgtacaatgtcatctgaaaaaaatggagtgaattgtgctttgctgttagtccatagactaggacccgcagaagacaaggaaacctaagcttaccaaagattgaaggaccagttgtagtgcactttcaaagtttctgtgcggtctacaactacaagttctacttaaaatattgtgttcttgtgaatttcatttatcgagcatattcctcaagtattagtgactacaaaatctcttgttcaataacaggtttgtattgtagccgttattgaccagaaaaagaataattgtcctaaccttaaaatagaaaaggttcctttggacaatcgcaaacgaaactctataggtcggcggtgatatctttttccactgattgcgaatctcctgcttttatgcatgattttctgttttaggtcaacaaaaaatgataccacttttttccctcatccttttaatccttgcaaggatacagcaacagatgtagactaaactaatacacttttcttggcttacaactgccgtgacagattcgatacacagccatgatatcagccatttccactaacatggatcagaacactaaaagagaatctatttaccttcctcccataaatgtccctgtagtcacacctgtcagtaacaggacgtcatccagagagtcacaatttccttgcttcaatacagtgctcctttcaggtattaagggccatgatagttcagttgattatagccctaggacatcggtggcatatacggacacagctaattccttggcgaccttagcacaatcttcaactcgataccctagccgcaacgataacaagagtccaaaccagaatcagattcttcatcaaaacaatcataatcacaaggtacactggaacaataagttggaagaaagctttatatcaattgtactggagaaaatgccccaaactgcagggtacacgaacactattaaggcatggcaagaggttttagatgagtttaaccaacaaaatggattgagtatcaaacaatacagaacacttcagctcaaattcgacagtttatataaagagtatctggcgaaaaaatctcttgattccggagacgagcaacttcatgctattgagttggagaaaaccagttctttcattgaatctcgcctggatcagattcaagagaaaatcaacgctaaaagattgttcaaactacaagagagtaaattgaagaagggcaaacgaaaggctagcgacgttgatgaaaactgtcattttcacaccagcgataaaagaacgaagtcttccgatgatattgattattatttgcatacttcaaatgcagactcccccagatcttctacgtcgtcaataactcttcagcacactcttggagacttgttcagggatttagagtcaaggttagtgacacggattgacaccttctgctcagtattagagaaaaagatggataccaattttgaatgtataatgcaacgcgtcgatcaaattgctgagaaggtggaacgataggactagaattgttcagtttagtttgattaattagtcttaggaatatattagggtcacaaccatttccagtagctacaaggcgtaacaaaaagatgcgcatgcccggagtcgaaccgggggcccgacgatggcaacgtcgaattttaccgctaaactacatgcgctttgattcatttggaactgagagtcaataggtattaacggttattataggtcaatttttttttcgccaattaacccacgttgttgtgtgcttgcaaacattattgcgtttttacgatactttgtcaattgcaatttttgtacttgacagaatgaagctctagccttgtttttttttcatgatttagttaatagcatttagagtaaagatctaacccgcagtggagagaaatttagaggtgacaggtagttgataaaacagatgggacgtgaatcccaatgaattggtttaatattatcttgtcttgattttatacttgtttcaacttgttactttctatcgtctcaattcctcgtcaagcactaaggaatttagcaaaggtaacttatcttcccttcggcatccatcaacctgaaattcgagcacttttcaaacacagctagaagtttcttcttgtgttggttaggacatatgtttgtacgaaaattcagaaatggaactagtatctctttgatccgcagatttctgcacttcgacccacctaaaccccctgcaacacccaagaccttagatatcgattggaaaccaattacatctaacaaatccttgaagagagatggaaacaagcaccgcactgggcggagtgttgtatttggccttctttgcctaactccagtagtaactttggggctcggattttggcagttacagcgattgaaatggaaaaattccctagtagctgagtgtgaagacagattgacatacaagccacttcctcttcccaagaacttcagggaagaggatgtcgagaacttcgagtatcgcaaggtgctcataactggtagatttgactacgaaaaggaactgttagtaggtccccgattgcacgatgacagaaagggctatatccttgtcactcctttcacaagatctaatggaggtggaagaattttagtggaaagaggctggatatctgaagggaaagtgaaccaaggaaaaagaaggctaaaaaacttatctatgccagagggtacaataactttagaatgtcttttgaaagtaccaccatcgaaaggaatgtttcacattgaacataagccagggacaaatatgttcagatatgtcgatttggagcgaatgtgcaaggagactaattgcaagccaatatatgcccaagtggtacaagatttcaaggatcatcctgaatggcttaaggatagggccagcgaaatcgggcatgaatcatcaggaggtttatggaacttgtggaggtggcggtggcaaagtgaaagtgataacaacgatgatcaatcacagctggaaacatttcgggctcccatggttggggaggcaaaggtttctgcttatcaagactcatcgctggaattcagcccattacagttcgtaaatgctggagtacctattggcaaagtaccaaaagttgattacacaaacaaccatttaaattatctcgtaacctggtgggggttgtctcttgcttcaacagttttgctgcttttggtattgaaaagtaagaaattcgttaatccttccgatgaaaaattgcgacatgctcgtaaatatatgtaaatagaagagattatatctacctgtaaatttggttacacagaatataatatgggcggaactctgataatgcaaccatatccatattcaaggtttaggtattttgagacttttggaggtcatcaaacatccttgaatgacaaaaaagagtgaaatcaaatgaaattcaaaaaattttcctttccataataatggaccaggaaggccatcctcatactcataccatcctttataaacacaaaatgccatactaaatactagccacaaggtcgaagggatcggtaatccttcgaaatagtgagctttacccttgatatcttttggtatgttggccactgttacgttgaacctagctaatctggtgagtccacacagaaccagaaatgttaggcataggacgtctaatgtagtttgtaaacctagggaaaatgcaatagaggcgggagcaaccccaaatgaaatcagatcggctaaagagtccaactcctgaccaatcaatgatgctttgttgcgcaatctggcaactttaccgtcaaaaaagtcaaaaaaaagacccaaaattatgaagaagtgtgccctttgtacgtagtgagtttgcttagtcaaggtgaaacgaagacaagaaacaatagaataaaacccggaaaaaccattcattaacgttatgaaatctgccatatgaagatttcgaagcaaagagaaatgtctgtcgtcagatgtaaacgcaataaaatctttttcgtccggaggtggtaaaggttcggctgagcttaatgaactcaaagaaaacaggctagatcgtctttttgacaatctcggatgcccattgtcttcaaaatcggaggagtctgataaggcatagttatttgaatctgattcccctcgaactgaggtcctcttagaagccattaggagctttgggggggtttagaacaggaatattcaagtcctagggttatatgagatggcaagtgaaaccaaaaatcaataggggcgccaacattcaaggcaatatggtgtaaggatggagtcaagttagcttagtttgcacaacaaaaaattgtgcatgtgaaaatgagaatcatgccaacctgtggtgtgggagggaccatctatgggctcaattcatttcttaagcaatggaggaattcattgtgaacaaccactccaggtgtagtaccattagagagaacacctataattagtgttaatcgtgtagaaatttcaatatttacattttcagataaataaattggttgcggcaataaaggttcaattctgttcggttcggacaacgtttttcatttccttattgacgaatcgttagatttcttttcttcgaaaaattacacctacatgccatcttgggggttccataatcagattcatgctacctacagcgataaatcggtggcactcaagctgaagtctggcaagaacgactttgcacctttgaatgtcattcctttttctacatttattaagactttagtacctgaactcagcgatggctacaaattcaaccttcacccttttctgttcaatggcgctctccagactttatacgcgtccaaagctgactatagtaaagaatttcaaatatactatggaagatgcatggttcgatatcctgaggcaaatcatgagtatccacatttacatcttggtcaagcgactgcggattttgtagttgatccaccaacagaaatcgatgaatggaattatttatacaatcagactttacctgaaggatggcctcgattgcatccgcggactagattcctaacagtgcaagaagaacaagacctggaagctgactgggcctcaaactctggatcaattgttgtaattattcacggattggccggtggctcgcacgaaccgggaatacgagatgtgagccagcatcttcatcaagctggttttaatgttgtgacactcaactctcgtggatgttgtcgctctaaattgtcaacaggaagactttactcggccgtcgaaacagatgatctccgttactttattgatgagctacataagaaaatacccaacaagcctatctatcttttgggattttctttagggtctgcactggttctcaattatcttggcgaggaaggaaagaagagcttcatcaaaagtgcggtcactatcggagcacctgtagacctcctggactcccattatcatttgaaccacagttactctggaaagtatctattcgatcctgcagtggcttcattcttgtcaaatttggtaaaagttaacttcccaattctaaaccgtgataaaccggaagtattctcatacgaaaagaagtccaaagattacttggtacggagaatcgtcgactttgatcgaaaatatactgccccagcgtatggatttgcaagtccaaaatattactatcaagctggatctcccttaaccaagctagtaaatatttacactccaacagtactgctgaactccttagatgatccggtagtatcgtgtaatttaccagtggatgaagttaaagcaaacccatatctatatctagcggcctcagatttaggtggtcatttggcttatattcagtgggatggtggattctggtttagcgaagccgtgtctgcatacttcatggcatttgaatcggaactgtcaaacgaacctgcacaaagtgattacgagcctcagctaagtgaatacagctataaaactggaatttgagttatacatttaatcagattaattgaaaatagagatcgtgacgtcgagtcaaactttatacgattggtgcattcatactagttcggagttgctgcatgaggcataaacaatggtttgacaaccaagtaactgtttgtagagtctgcaattccagcatacatattgtaaaaaccaagtatacttccaacaaacgatacagctccaccagccttgatagtaccagctgagctggtgtagtatccaatcgtcagtactaagaacaataggaacaccacgaaaaccagggcggtcagtggccaagtggatttccaggtacaactccaaaggatgaaagtcagtacggtccatggacataaaaacattgccacagcattattgaagtcttcaactgtatcgtaggccgcagcaagtcccaatccgggggtcacgatgcatccataagctatccaaaaagaaccgtatcccaagaaaactacactggcccaagtattctccacgacaatgcaccatatacctgcaataatttccacaagccctgcaacaaataaaaacaatcccacaagtatcgttggatctgtcacacctctggcctgcagaaggataagccctagtgaaaatgtacccaaagaaaaagccgccaaaccagcagggacaggattaccaaaactacgatgcacagattgacgaccagtagtcaatgtacccccaaaagcgtacatgaactcttcttttgggatagcagtatcgttgatgtagatattttgatcatcgtgacggaaagttgatgtggttggtatttgttcgattgggttgcccttttcgacatctggggcaagatctgaaattgattgagattgagacattagaacaaggaacaaaacttcaaactgctgatataaaactctctgtaggtggtaaacgagaaatgaaatatggctaagggaagaaatcgtttcaatatatattgcaaggaaaatggtcactaacctacgaaaatgaactgaaaactatcatggggtgctgcaagctgaggaggggtttagagggacatctaaaatagggtgtcaggggtgttaggagtccgagaaaacgtaattcctccttaccattttcgtataactgagggtgcggaggagggggtggctgacttgttaagtccttcatgtgcggggggagatcatatgtgggatggggtttcacaccgggggtgcggctccataaggagtccgaagaaaaaaaaaaccacgttaactgttaactaagttgttggatttcctcaagtaaataaactacttaactagctggcttggctgcattaggcatgaatagaggatggacaacaacataactgttggttggattagccaaacctgcatacatgttgtaaaatcccaagagactacccacgaaacaaaagactcctccagctttaattgttggcaccgagctaacaaaatacccaattgtcaatactagaaatatcataaaaatgcagaagactaaggcggtgagcggccaggtcgatttccaagtacaactccagagaataaaactgaagactgcccaagggcataggtacattccaacggcattgttgaaatcttcagctgtttcataggcagcagcaacaccaaatgccggagttacaattgcagcatatccaagccagaaagaaccatagcccagaaatactacactggcccaggtattttccaccacgatacaccaaataccagcaattatttcaactactcctgaaacaaaaaggaacattccaatgagaatgctaacgtccgttacgcctctggcctgaagaagaattagacccagggcaaaagttcctaaggagaatcctgcaagtccagcgggtacagggttgccaaagctgcgatgcacagactgacgaccagtggttaaggtacccccaaaagcgtacatgaactcttcttttggaatggcagtatcgttgatatagatattctgatcatcgtgacgaaacgttgaattggtgaatgtcggctgggctggagcgccctgggcttcaacatcgcccttctcaacgtcttggttgaagcttgagtttgagttctggtttgtatttattgaattctgagtggccctgtctgtcatgtgtcttattctttctccaattcctacggatccttcttccaacgatctctttaaatagagctaatttaatccgattaagtttaagcatttgttctagaaagcaccaattccagccgtagccggcctgggacccctcagttacaccgaatagtgaaaaatgtgtggggcgagtgttaactcattcgttaggttaaccgagacgaggcaacacgcgaaatctgtttatacttcatgggtttttgaaacattaagtctaggttggcaatcaatatcgtctgtatctggcaaactcttctctagttcaatgatataagaatattcagacgaggttacaggagttacacttaatctggaacgacgcaccaggaccatatgttgtagattcttgtctgctttcaagcttcgaagtgtcaccttagcacgaaagcggcgcttaaatttgacatccacacaccaccagtggggattggatctcgttgacttgctagcgaaatacggactggcacggtcaaactgagattcgtcaggatgggcatagcagaccacttcagctaacccaacaatcccaggtgtgggacaatttgaatgatagaataagcaaacgtctcctggagacatgtcaagcatgtttctttttgcttcatggttccttactccatcccaaggctctgagtctacgagtgataaatcttcgagagagaacttgagatctctccctgtacgaccatcaatccgactatgaggctcagattttatgagccaatagcgcgtttcgcttcctgataaatgctcctcatctctagtatgtcttcttgaaggccctttgtttcgtttattcttcctcacttttcggcctgaagacattttcagaaatttgacaatttcctttctattttggtaggtaccattttcatggcgtctttgactgatcacgtgagagttacatatttcaattatagctcgttaccagaaaaagtgagcttagcaaagggatttgacactgtcgtagtcaccggattcgtgggggtaattttgttcgatgacttgggaatttgagtgttcttacaaagaatcgacaactgcttctttaccaattgagccagccttgcctgatccttattattcagcccgaggttgcagactcttccccaagcgactcggagtggaactctatcaattacaatcaagctagggccttcaggaagtttgccagctagtatagattctgcaacggcctctgcagaattacgactctcgaatacaacaaatccacaccgagcacggtgatttaaaattgttgcctctaatgtggaattaaattgttctttgaagtattcttgcactctaaaattagacagttcatctgttattccaaacagaaacatagactttatatcaggatcatctgggatagtcaaatctccgttaaaaggaagcttatttaaaagcttcaacaattctttcgtcgacagatgttttctgtcattactcttgctggtagatgaaagcgctttttgagagacatttgaactagtcaaccttagaacagtctcttcagctgtttcaagtatttgtggaacctttggttctggtgaaatatgtctcggcagatttccagaatcttcatcctgaaaattccgttccagctggttagctttatagatttttgaaattttgctattgttagctgctatagtggaaggcgaaaattccattaggtgtttgttagttccaagaatctcatccctcatgtcaggattgatttcgaatttcaagtctagtaaacaagattggcaggcatttcgggctcttgcacaagttaaacagatatcagttcgcctgaaaattgaagtgccaatcttcgggtaccaaagaaaactggtaaaggctcgagtacatattttgcattcacgaccatctttttcctggatcatttcgatgtagggattctcacccaagcaattattgcaggttgctggtaaatctgacatgctacttgaggtaactgtgtcgctagcttataaatcttttatcaggaaaaatccctcgattcagttcaattatcttttagcgatttatgatgagaacaaaaaccgaatacaggcaaatcattcatttctatcctcgaacttggatactaactattatggaaaatgaacaagtatcaaaacacgacttttgatatcaagtaaggatggcagaagtacaggcaagaatcgttgcacatatgaacaaagatcataaaattgccctcgaagactatttatctgtttacggaaacattgcaattgatgataagatcgctaatattactatgaaagacattgagttggacaatataactctaagttttaaccattttgacattgagtttcccataataaaaccaattccaatcgatcctccgatgaaggatctcagtgaggcaagaattagattaaccgagatggccaagtattgcgcctccaagagaggattttctcactttcaagtagcggagattggatacccagcatcattgggcgatttcactatcttaggggttctactcattctgttaacgggatttttcattccaactacactatttcatggtattttacctgctctacattgtccaactgcactcgtttcgttcttagctgccagcactaaatccattttgatttgcacaattttgatccatttacttgaaattcagttagtattgaaccccttgctgaaaaagtaccgagtgtcgttcgactacaaattagaatggtggttcctgactttcattgacgggtatttcacaattcgtcgattcaagaagattgtagctaaatacgaagaacactaggccagcacttggatccgtgctaggtttggtggcagggtaagtagtagcgaacttttttgtgatatttttttttgcgatgcccagaaggaattaagtatagactcctttaccgcaataccaatgcctcgcaataagactcaagctgctaaaaagaagaatccggaaaattttagaagatctgttgaatcagatgtctttactgactccgaagctcgtaatcggctagcgtctcaaccaaaaaaaactgcgaaatcaaaggttcacaaacagagtcacttggaagttaagaaagaacaaagatcggtacggttgtatggaaaaaaaaaaccacttagagaatataccgaaaaagaacttcatattcctgtattaaacagagccatagttcctggtgttgttccgaaagctcgaggtaaaaagggaaagaagtttgtggacgatcacgattctgtcgttttaaccagacttgtcaaacaaatcaacgacaaaaaggacttgctgaacgagagtaaattagagaaatcacaacgtattgaagagatccgtgagttaaagaaacaagaaattgaaaaaaaagaggagcttaagaagcaaaaattggacgataagaaacaacagattaaatcgaaggccaatactgcaagagctattcgaagaaggaacgccagagagcttgccagaaaggcgaaggaaaacgctgatgaaaaactaactactcggaacattaaaaaacctatcaaatctgtgtcatttgcttaagagcttgacaccaagcgaaatggatcactaactgtatactaatttttttttcgcctatcgaagactattctgtatcatacatatattaatcataatgcccgtttcatttgtctaatactgtgcactcgtaatccttttatggcgggatttataagttgtacctgtagtacacaaacatggtttacctgcagttctcgtcgccgacaatagtaaagcccctattcagagattcaatatccatcggggttgtgactggttgattttaatcactccaatatggctagattcaaagccgatcgcaatactgaatcatggtagcggccttgcgactcataacattctataatcccagcaatgcttggctttggtattcgaagacatgtcgatctccaaacctagaagacctccaattctcgtcttgataaaactgtgtcgtactaaatcttcaaaaaggcttcgggtgaccagcaactgaagcaaaaatttctgcaggtggagcaaacaactaagctaggttttcaatagcaacatactcacaatttggaatggttttatcaggaaagacctagttaataagggaggtaccagcatgagcctcaagcatataaaactgtcaatccggtgaaaatcactaaagcaggtactaatataacctaaaagaggcaaaaagtctaaatgtggtgccggtgctacatattcatgttcacagagtaacaaggatgatagttagccgtaaacaataaaagtagaagtatgtcctcttgattgttatcctgtaaagtgatattgcgttttcatatttatcacatgcacagcttgatggacgcaaagcatactcatagtactctgctcagtaaaattggttatgttagcaaagtggtagcgtatattgtggtgagaaacctgggctacctgccactatttcagctttcgtcatcaatcaggtccaaatttatccaacttgaaactgcgtatcctaaggttttacctccagccatcctgaaagtgaacggacaaggactggcataatagcatacaagtagtttatccatgccgctaaaatagatcggttgggattggggatttgcctttatttcaaaagaaaccaagcgctccaaacgtacaacaaaacgctcacaagaattatttctcaaactcgtatactatcaaattgttggcaagtggaggctactattctgaaattccgatctgtttcaaaacaattcagagggagtaatctcagacaaccccaaacctagttactccaagacgaactgtacgattgatttttttgttttggtttgatgagaagatacattgggtcatctaggtaatttatggagtttctttgtttgtgcaccttaatctactgactctccgtggttcctaactcttcttgctttctaagctgttgcggacaatattcgccaaattgagtactttacataatcctgcacaactttcataggagcattacttagtgtatgtgtggtctttttcccatgcaatctgtgattttccagatagaccagtagtgtgtctagaatcttttgagtgcctatagcatctcccgctaagtcattcttattactccgaagagaagtgttagtgaaccttactagaggctgcaaatcacctataatcgtgtctaccagcagggaagatttttcggaagcatagctagcgtaaaatctattgatcccaatgtcaaaataagtatgttgaattttcttctcttttctaaggttacaaacctgatttagagagaaccaggccccttccttcaaccttggtgttgcaaatctagtcagttgtgaaaggtaaaaatgtgggaccacttcgttgttaccgctctcaactttcggacctgaatagattaccgagttctctctttgggatgaggaaacacttacatcctgctcataagataaatagggattcagaggattagagggcgccgaaaatctggcctcgttaaggtttaaatctgactctataattggttgaatcggagatgagttaagatcagtttgagagtttatattactaaaatctggcataccaaggttgggatacgaactagaaaacccaagcacaaaaggcacaaaagacacaaagaataagatggtaagctgttctgcgtgatggttcaaaaccaccacaatagctgcaagtatgattacccggtcgcgcgtctttgatcgtctagcagccagcattcaagttacttcgatgagtatcgttctatatcattctttgctttcatatgagattatcatcgttgacagcttcaatatgcctgatagcaatttgtcaggggtttttaaacactgccccaatgatgatagaaatcgttaatcctacgtcagagttgttaccggatggttcctatttaacggagtatgaatcattgagagtaaaagtagaaaaattgacggagaagtggtgcagcgtccgatctcaagaaagattggccattgtgcaagtacctgggcttagtaagaggcttttaagccaggaaatttcattcaaccatcaagaaagtttgataaatcgtatttacagaagctccaagagttttgtctcacctcatgtgtattatcctactagcgagctagagcagctttattctgccaaatgtcttgaagagggccgtatgtctgaagttagaataccaaagtgggaggacacttcattcgcttatgaatctttcctcaaggatttgcactccaacgttttctttttgcagttgccatcacaagggaccttgactgatgaggattatttgaaggctctcagaaatgctttagaccacttgaaatgttcaatgaagaaagtatccgagaacaatataagcttcatcatccaaggactaccgtctgaacctcagaatagctttagatctagagaacttcccacttccaacagcactatcggatcaggcagcgcaatggacaaatatacattcttcacgccaggaatttggatgaccactattgtttctttatttttggcatgggtcttttcggtagccctcaactgggtttcatcattgcagataagttacaaggcatttgagaaacaggtaaaccctcaaaagaaaactcagtagtaatttatattgttacaatatctaagttttgacgtccattagtacacataaggtataattttgtaaggtacttctttttggtacatcgtccaatacttgccatactttcgttgacatttatcctcgtctctagtttgtctatggaccaacaataccccaaaatatatcacataatagtatggcagaactgagttaaaccctgtcggtagacaccaactccatgcgattaaccagtctcctagatagttgatatgctgagaacgcctccaccaaccgtctactagcagtttagacccagtttcggtttcaattgatttcatggatggaagtaagccttgacgaaacttcgacttttgactattagctgaatgaaaaatataatagcctgtgaaagcaaggatacatatcaggatcatattgaataaccctaaatggactggcttcaaaaccaaatatcgagactgcagtgaataagtaaaggggaccaaagtaagatcaccaaaagccaacataaatccgaatccgtctgtggctatgtccatcatagttaaaagaccttcttcattcaacactccatcaattatatagaacatctgtaagaagttaactaacaaaagagagtcgaatatttttccttccttcaaatactgttggtgcaaacatgacaagttaatcagcaaccaaagtaacattccaggccttagttcgcagaaaagtttaatatcccaagatcctattcttgggttcaattccctaccaataaaccagtcaaaaattgggtttttagtgttgcctccaaccgcaaggatccttgaccttgtattgactccatttggtctccttaaaggaatgaacgaaaatagatagcaagctgttgctaagataaatgaaaactcgattgtcacaatggaaaagttgaggatgttgttgtaaagaaattgtagctcaggcattgatccattagtttgaaaccaccttgccactaaaatggaggctagaaggccggccataggtaggccgttgatatggtacttcaactgagttccatctcttaatattacacctttcaacagtttccctggcaggaccaaatctaaacatattaaaccaccaaaccaacccaagtaaattttccaacaggtggagtttgcaaaagttgaataaaattcttctacgaaatgcttgttacagacctcgatcaccttaccaaagtctatgtagaatccatccactacataatctggattgctaagcagatatagtagaacaacaacaattggcaggcctagcgatatggatattgctcctggtactccgaggaagtctttgtgtgcagtgatttcgttgagaggaaccattcttgtttttgaaggaagaaagtgataattgatagatgaatagtggtcgttcgtataatatatacgagattttcagaatcgtacagtctaaacgagagaggaaaaaccaattacagataaatgaatggggaacgaacgagacatcgggacatgctttcataaaatctttgaaataccgcgaccggatagatgaacggagttctgatactacacatatttaccaggtctttttttctctttttgaattcgaacaatatggctgaagtgtccaagtaagtctaaatactgtctctttatttagggatatactaactatggaaggcaggtgatcaacaagctggttttttttaccgcaatgatgatcagtgctcctttgatatgtttcttcgtggcagattatattttcagtaagtgtcaggtttatttttttctacaaagactcatacggtctgaagttcattattaactttttaaggcaattctctagtttcgggcgggcttgccgctttggtcgcaaatatcgtcttaattggttatgttattgtcgcttttactgaagaaattcccgttgagctcaagaaagatgattaagtgtgctccataggagtcaattatgaaaagattattggtatggttgtattatatttctttatattatgttttggtgatcttttgtactacaaataagggttcgccaaaactttgatcggatcgtgacattcagtatgttgtggtagcgaaatacgaaagtttttttctcctttagtttttctcttttttctttcctctttgaacacaacgtcaaggatctctgaaatggatcatcagtttcttagtacattgcaggagacactgcagaaaactactattccagattctgcagtcattaaagcggctactaaaagattgcagaccgaattttataccaacccgctagctctaccagctttgatccacactttacaaaatcataatgataagcaaataagacagctagccgctgtagaaggccgcaagttggtacatattcaatggggtaaagttgaagagtctctgaaacaacaggttcgtgactcaatagttgcaagcactttccacgagaaagataaaaacattaggcattcgtcggctcgagtcattgcatctattgcttcgtttgattttgctgaaaacaagtggactgacctacttgctaaactggtttcagtagctaatagcagtgacgaatctcaaaaggttattgcactatttatcttgtattgtatcctggagttaaatattcccgagctagccccaagtacaaaagacttcttaaatttgttccaagacaatattggtcctcacaattcagttgaagttagggttatctcactgctagctcttgactgtattggtctttacttggacgaatctgacagcattgatgcccaggcagccgctcaattcaaatcggtatttccagctatggttgaagtcctgaaatctgtgttagaaattaatgacatagaaaacgccaaaaaggtttttgatgtgattaatgatttcatacttttggacgattccctttttggagataatgtctactatgcaatcgatatggctagagagattgcctccaacatccatattgacgaggaagttagagtttatgctctgtctactcttagctctgtattgtcacacaggaagtccaaagtgtcttcaaagaagcttggtacagatctcaccattatgtgcttgcaaattgcgtccgaagaaatagatgaagaagaggaacttgacaacgaagatctcgaaaatgagaatgaagagagcagcccgaatactgtagctcttagcctgatctccatgttatcccaagagatgcctccgagccaaattattgctccattgttggaagctctgtcacaaggccttgcatctcctaacaagtttgaaagaagaggtgttatcctatcattgggaattgctagtcccggtgctccagactatatcttaacacatttaactaaaatactagaaggaattgtctcttcattgcaggacccggagttgattgttcaggctgctgcattaaaggttttagactcgttaacttcagagcttcatgagcacgtagctgagcactatgagaaactgcttccacttatcatatccattattgactcagccacaaaactttccgtttacaaatatgctaccggtgctttggacagactgatagaatacatggaacatgacgccattgcgaagtatttagaccctttgatgaataaactattccacatgcttgattctgctactacaatttcattgaaatccgcaattgtttcagctattggttctgctgcttttgcctcaggaaagagtttcataccctactttgacagctcaattcgttacttggaaaagtacttatctcaaaatgtcaaagtcgaggagatgtctgctcaagaaattgaactaaaagcattaacgtttgaaaacatttcaacaatggccagggctgtagggtcagaacctttttcaaagtatgcgaagccacttattgatgcttcataccagtcacttagcacacaaagcgagcgtttgagagagtctggattcgcatttatttctaatatggcaaaagtatatggtgctgagttttccgggtttctagatactatagttcctgagatattcaagtcgttgcagcaggaagagtttcagttcaatattgaagaggatgatgagggactaatagacgatgatattgatttggagagcaagtttaatattcacagtggtatcaccattgaaaaagagattgcagctattgcactcgcacaattggccgagggaaccaagaagaactttgccccttacgttaaaccatcgttagagattctcgtcgagcagattgaagccagttatggaatgagagaaactgctgtaagtagtttatggagaattgtcattgcaatgtatcaaaccagcgaccatatggagtatcagataggtgttccagcttcttcctatgtttctgaagaagttctttcaatcatcaagaccgctcgagatgcttcaattactcaattggttaccgaatttgagctgaatatggtgatctccatacttgattgttttagcgaagctttggaaaaagcaggcccagtagtgatcattgataatggtaattcctcagacttggagaagctatgcatagagctaatgaaacttctgaagtcagagcacaactgtcaattagatggtctcgaagagacggctgaagaggaagtagatgggtccgagtctgaaaatcttatatttgattctgctttggaggtcttagtgagcttgtctaaaactttaggtgcagattttttgaagatactctcctccttcaaagataccattatacagaactgttcgtcccagtcccgattccgaaggatcagtgccataggtgctttggctgatatctcttccaatttgaaggcagctaacccttacacggaggagtttttaaacacttttactgaaaaacttcaaaacgacaagtccttagaagttcgtgggaatgcagcttatggtattggttccgtcatcgagagttctgcattagatctttcggacgcctacccccatttgctttctctgttgaaccaactgctggacaaggccgatagaaggtctctgaaaactgaggaaggtgacgatgaaactagggacgttatcagaagagcctttgctaacgcttgcggctgtgtatctcgtatgggtttgaaatcaccggacaatttgcctttggaaaagattctgcccgtcttattggatcatttacctcttactactgcgtttgaggaaaacgtcccaatttttaactttatcatgttcttgtttcaacaaaataatcagctagtacttcgacaaataccaaaaattgttgaagtgtttgaatttgcttttgtcaaggaggttgagcgaaccaagcttatagaagaggcgacacttggtagaaatgaggacattgatagatccaaacagtttcatcaagaagggttgaaagaaaatgtcatcggattcttaaaacaattggaatcttcctatcccagctctgtgtcctcaagcgacgttttgaagaatgtgatttcttgaagcgtatatattttcttcctttcccagtctttttcacccatctgcttcctatgggaatagaagtatactgtatatttatcattcgaacattcgcgcatcatcccgtctactacttactaccttggattttcatctataccccatatggccataaaaactatcgcaattgtgggcgggggaccttcggccgtaggtgcagccaaggctcttttaaaagaaaactgtttttataaaattcacatatatgagaggcgatgtacgactggaggtttatggaattatagtaaccaggcaccacttttcgaaatacctaatgtgaactcaaatttgcagatttctccagagaaggtcgacatcatcaaggaagatggatcaggtaatcaggggcccaatcataggtttggtgctcagtatatttggccatctcccgtttatgatttgctggatacgaatgtcccgaaagatattatggagtacaaaggtttcaaatggccagatgacacaccgctgtttccgctgagagaagaagtactttgttacttacaggcatactcgagggaagtggagccatacatcaagtttggccactttgtttatgatgttagtcaattgcagaacaaccaatggaaagtcagctatcgagtagttaacgaaagcacaggcggtggcgtcactagtgatcagagattcgaatcatcagaagtttatgatgctgttatcttggctgttggaaactatgatgttcctttcttacccgatttgccttatctaaaaacctggaatgaaaagtttccaggttcaatcatacatgcaaagtcttttcgacacccaaaacaatttgtcaacgaaagtgacattttagtggttggaaattcagcatcggcaaatgatatctgttacgaattagcgaccactttgaagtgcaatatttacaaatccaaacggtctgagaataatctcccgtccccaccaaatgagggtgttattgtagtcccagaaattgcacgatttataccagaatcccaggaaattgagtttatagatcaatccagagttggtaatgtttctatgattatttttgccacggggtatttaaagtcattcccgtttatgaaaagaataaactcgtctagtaaaccattggtgaaagataatggcacaagagttgcaggactgtatagacagatcatctcgtatgaacacccaggattggctgtgataggacttcctagatttgtgcttcctacaaggctatccgaaacccagggtgcttggcttgctagagtatttagtgggcgtattaacttacctgagaagcaaacaagggcgaaatgggaggagaaccgactgaatgtgacaggacctgggaaggcatttcatgatttgaagtttccgtgtgacgtactatattcccatgaactaaacagagaaatttggaaaggcggtttggaccacgggctaatcccgatatcctggaatcaggaccaaaccaaaatacgtggtggcattaaggagatcaaagaatcttatattaagtacaagagagaaagaggaaaaaaggcaaccactatcaagcaactggaagagaacgctggattagtacttccgcccctcgaagctggtatttttgacttctcattcattgcaggtgaacacgcaatgtgacaatgttcaattcatactcataaaaatcataaatatcataaaaattacacagatcagtcaataggaatggacctcatatcgacaactacagttggatcgttgggactacactcgacatcaacttcgactgtccatttccggtcaagaccttcaaatccatgatctgattcgtctttgtagcgccagattagtcggccatctggtaacttctcttcctcccgtttgaatttgtactcgattccaaccatgtcattaatttgctttaacagatgtttgtcaacgtgatgatgcaagtttctcacaaacttcttggacttattgttcattgttggtttaatcttttccggatcgtcatgaatttcattacgaataaatggaggataataatccaaacgagcgtggaggaaatcaaaatcgttatcccaagattcacccttcaagtaagtttcaaacatttctagatcatcaaactttttgaatggaggttcattggaatctcgacgaggccttttcttaattgagtcggtactaattttaattggttcaagatttctctctgcagcagcttgtgactttcttctacccattttattttggcgtgtatttcgttcgctatattatcatagcccaggagggaaaagcggcatccaatctgcgctttatatagtacataaaggaaaacctaaaatctcgtgatcgcttgcagagcaatcttaccacctccctaatatctgatgctttttattttactttttttaatttttgggaaattgatcctgggatcatcataccattctcagtagaatccattttgcagcgttggctataccgattgcgacactgagtgtagtcatatttgttgtaatgctacaacttagatagggacgacccccttttctgcatgctttttcgcgactatctgatgactgtgataagaatagattgtggggatcaataacgaaatgaaattacgaccttaaactctgttcgtattttgtaccaagtgaaacctaatcttgtttgtgctgtgcatctaattcggagaacttagaactcaagtaaacgttaatatatctcatggcctactagttagaagtgatgagaatgcgatactatccaacctgaaactgttttagaagaaatatatagagtttattttgcagttaagaggtctttttttctgggttgggacgatacttttagtattcgaaaagcaagagagtcgctccttacttgtgagcattaattgctttaaaacatcctagtttatctattgagttctgaaattatgaagccacttcaactacgaggaagaataacattctcaacgtatttatatggtcggtcactgatgaactgcccgtcaaattgaaagacagcaaaaaatttcagttcattttccaatcgctatatcattccggcaaattatctgttggtctagattactacgcctatgtgcccaagaaataaatgaagtcaagcgaagtgggagagttgctagaagtaaaattatactctttcaagaataaaacaacatccttctttttctctatatttacaattccagctttgaagcgcatcggataagctcccaggaaaagtaggaaacaaaaatggccccttcaatcgaattacatacaacctcaactattcgaacaatggaaaccgtatatcaataagttatatgaaatcttataagctaacgtggtgtgtaatttcaaaaccagaatgtgaaattcgattggggagtaccatgaatagtgggttctatatgaacaaagaaggatgtttaactttgcaacacctggttgtttttcagatgctcataccaaaggtcaatgctgggtataaccaagcataagcctctggtggcttttgcttgaattcaaacggattttaatgcgcttgtagacaccgtttacgtgagtattttaacggccgcctcattgttcttccggaccaagttttgaatactaatttcaggaatagtgagtcgtttccccttaaacaacttgcattggcttcgcgattgttcgattgtgagatcttaggggaacatcacagcttgtaaacctcagattttagcactcactcattgataaatcctagcacccaaatgttattgctgctatgaatgacgaaactcaagaatcctgtgatcgtgttttgcattctgataacagttgccgagggactgaaaagtctccagtttcttatagacaatccaaggaccctcaaaaacgagctaaacttattaagcaggcactcaaggagatctttatcaatcctattcctagaacaatcactcaagtttctaaaagatatgacattccttacaatacactgaaaaccagagtgaagaagagcgacaaagttgtgattagcaattacaaactgagacatattttcaccgatcaatatgagtctcttttatgtgattatctcacccttatgtatagatgtggagttttagtttcctacagggaggttttaagcttagttaatgacacagttgccattcactgcaaacgatcaaacattgagaatcctttgaatagggctactggaacaagattgggccgaagatggtggaaagagttttaccaacggatgatcgattcctgtccagtccttcaaactgtgcaagaaaatgcttactcatctcacacattattcggtccacaaagaaaaattctcaacaagcatcaatggctcaaatcgtacacagactcagttactaattctgaacaaaagcactcacttatatttcatgcccatgaaatgcggttcaaactaggtgagttggaaaacaaggagaaagtttggacatctgaacttgaagatttagagaataatggccataatttcaagttttctaaaagtgaaaattttgctatacttgaaactataaacaccgaaggaaacataagaatttccccttttgtaatcacagaacaatctggactacaaaaaaatttggatatatctttaggccaatcgaaatttgacgaagaagatcaagcaatggatagtataaattcctggcaatttcattatgcgaagaatgggtgccttacacccgaactgttccttaagtatttggcttattttcattctcagttgaaactatcttcaaacaatatgattgatgaaagctacgttaagactttggttgttaatattgatagcagtctgattacgttggacacggtttttcttttaaacgaattcaacattcaactcatgatcttacctagagatatggtgcatttaaagttgtcaattgacgaggggatatttggacctttaatgcgtatcatggacggtgaaatgactagacttttggacacggagcatacaaaccgtattactattacagatttcttcctttattttgtcaaggtcaagttcagattaacgacctcttttaaagttcgtcaagcttttcagaatcttggactggatcctccaaactacgaagagttcattaatagcatagatgatatgcactcgtctcacagggaattgattaagagtgaaagcggtcttagccggcctgcaagacgtaaagtgatggatacttctcgtgtgttatcaaacacagaaaataattcagagtataccgaaagcttactatcggagagtggaacgccaattcaaaatatccccgttacagcaaatgatcggaacaaacaggataaacaggaagcggcagatgatgaagatgattccagtgacattagctatttcgaagaattggaggaggaatctgaggatttcgagtcagatagtgagaactacacacaacggttcctgaacgccgaccccgaagttaaacttgacgaatttgatgatacgaacactgatattatagagcagattcatgagctaagaaaaaacaagaacaagctgacggaaattattcttcagcattctggtgtagcctccatcattacaaatattaacaccctagattcgctgctacaacgacatttttctcagatggatgtcctacttcagaactatcgacttaaaatagaacagcagcttttaaatcccaggggtgattccagaaaacgtgctagaaggacataattctgctaacagttttcaaatgacagctttattatacgctctagggttgaaaatgttttataggctgaaacgtgatcacaactgcacgagatttcgcgcagtagatcaaatagagtgtcaccaggttcactagtccgcaaccagaattgcttcataacaaactaacaaaagtaagtttctatgagttgtttatcccatcttatcgctagcgtatgttttttgttatgcatagtagaagctcatttaagcacacgttttctcgcattttttagcaaaggggaagagacaccggaaagtaaagttcttagtgtgcgagaaactttgaaaggtaagaccggctgccgaattgtttacgaatatgagttgacattgaagggatttgcatttgatctcgatcatgatgactccacactttctgttctggaaacattgcggaatgagtttaacgataacgagtggcccctaactattgaagtggatagcgagatccatgtatattagataattggaaagtttttaatggagtagcgattttaaattatcctagcggctagagtaattaagcgtagaagttaagttatcggaagctcaagtctgaatagatttcctttatcgcaaaaggcaaaagggggactaccctagggattctgaggattaggaagtaggttcaactttatttatactttatttcattcctactaacatataccttttgagggagagctacaacatataacgaataataggtagataggaagggctatgcgaataacgccactagtttggcacatcagacagcaacgagaatatttgctcctgctcctttcgagcactcataattgagctcggttttagccccacctgtaccaagtactaaagttaacatcaatcatcagtaatggaactagtaagtaaactcattaagtgaaaattaaattgaaaaagttccttgtttctctaaccaatatttagctccccgagggacaaacgaataagacagaggtttcatgggaggaccaacaaagaatcaatgagttttcaaaacttatcaatcgaaaagatcagtttgaagtggaactagctgaattatctcacgagaaagactatttggacgacctttccttggagattgagctactggatgatgacgaaaaagttaattacaaactaggagacacttttgtgttattgagacacagttctgtagtgacacgattagaaaacgacaacctcgtgctggctaacaaaatgacggcactagaaaatagtatagaggttacccaggagagaatgaacgaactgaagaaccaactttacgctaaatttggccaatcaattaatttagataggtaggaataggattttcacttcttggttttcccggtatcatgcttatataataattatctaatgtctattgcaaagaaaacggaactgagaactgctgattttttttttttgccagaggaggaaccccatccgtaagaaagctttctgagaacaagttcactgtatgtgcgcagtcataatggggcttaagacacatttcacttacagagaaccgggaaacgtttattccttgttgagcaacttagtattcatgactgtttgcttgagaggaattctggaggtattacatcttgaattaccccctgaattgaaacatgcgggccacaaacagtttctaactaatatctcagctgttgctactattgcagtacaatcgctgtcaattatttgtcacttgactggttcttggactctttttcggctgaaaaattatctgcattccattgcaacttcattggaatttgtagtcagtgtgatttattggccgttgagactatttttcacacacatgattctttctaaagaatctttcataccattgagtactgatctctccattcatcttgtaccagtggtaagccttttgttcgatttttactttttcatgcctaattggacagtgacaatccctcaggcatttcttatcactacactgttagatttgttgtattggaaatggcttgattatgtcatggatggttccagtaagtttccatatccatttttgaatgtttcagagaaggaaagaatggtaatatttggagctgtgatcttaattgtatttgggagtttcttggttcaaaaacgacttcatagcagagtgtgccctcccattgatgatactattgacacaaaaaaagagtaactaatggcctagatctagatagagagaacatctcgtcgtggttaccgtacttactgtacctgatcccgaatttttcagaaaacgaaaactcaatctttcttagaaagctataataatctaagtttatctggtgatctggagaaaaggcttataaataatgaacagcttgaaaatagtgggaaaacactgagtaggcgattagccatctatcctaaataaatccatatatacaaagtttaataaattaactcaccagtggtgttaatatttgatatttcttctgacggttcctcttcatcgaagattttactaagcttttttctgacttccttactaatattgctatgatcgactgagaatacttcggaagtttcgctgtcgggaaaggagagaggccggactaaacgtactgtgttgctagttttattaattccctccaactgcatgtccttttggttcatgccataagagcttggagaagtttctgtgaataaacctctactatgatatccttccgtgattccatggtcgtaattattatcaaaatcttcgaaatgataaaaatttccttgattatgattaaacttgtacttgacagcagaatcaagggataaagagtcgtcagaatctggtgaggtctgctgagtcgttgacgtcggcattttgtcatcacttataaccctaatgaggttgaatgataatcccgaactgctccgtttttcatgggagtaatgaagactgttgaatgttgatgcttgatgaatgacccctgtagacgctgcagtaactatgggggatgagatactagagatattcaatggtttagctttgttcttgatccaagtttcaaattcgtcatccttcttctcaggagactgaggagggttatgggtgtcatatgttgcattttgcaggattgagtctaacatatcaaaaaactcgggcaaattagtaaatctaacatccgaaagagaatcaatgattgctgtgtgctcactaggagctgagttttttagcaagattagtttcgacgaaagtttattcaacttggcaatcagttgatcgtatggtgattgttgttgatctttcaaagctccagaaacgaaattcgtttgaaaatcgggcaaaatgtggttattctggcttttatgaatagagatgtgtgtgtttaagaagttacccgaaaaaacaaataatgagatttgactccagagcaccgtactaagaattctttgtttctgtaaaaatggtaagcccttcaaagaatggccgagcctttgacttgataaagacaagattagccatttgtgagacactcgggtgtttaaattcgacttcttctcatcattatctaagcaagaatacatactcagcagacagcataaaaatattttccgaatttgattattaacacctaacaagttggacaaattggattcttcccatgttagcggtatattagactcatctgttgattttatcaatgacatactgttgtatggcgaattaagatggtcataaatttcgaaattatcagtgcaaaagcagccaaaaactttataaatttgacgatccgtatcaaaaatttggtagatttccaagtaactcataaataagtcaatattcaaaaatgggagcaaattgtgaatagctgtagctctatggactattagcaatctcagttggtcagataccaatgtattcaatttcttgcaagtctctgggatagccttgaacatattattatcgatgtatttctctgattcaaacattctttctaaaaggcaaaggttgttcatattgtacaatttggtcatgaggtagaagagtttgaaataagagttcattaatgccaatatgagcagaaagagaagtcttttgctagggaaactaatgcctgaaccaaatctctgcgaaaaatggatcagtctgaaaaccaaaattaagatggctgggccatatagctgaggcgaacatgatgaaatcaatcggaggttgaaactgacttcgcattgagcccgttgcctccttctccacacaggtttcttccaattgcgagattgattagaaaatttccgaccaatgagtccaaacatcatgccattcatgtagttctcattcaagtaaacagaagacactagtctgtagttaaaagtttcctgataaacttctaactcattcctaccaatttgccttcttcctattatggagtctaatactattttgaacgaacgggggataccaggtttgttctgttcggaggacttcgaagtgcgccaatcttgttgcagcataagtatcaaatgctcttacagctccgaataagaacggcggcaacttttattgttgattcagttgtggtctcttggatagtgtgggtcagtcctggtcgtcctggtcgtccctcatataggctaaaccccccaaacaaatgtctcgaaaaataatatgaaagaaaaaggtttaagtggcatatgctttgcatattatattgaaccgataatacctacaaattacattcccagtcgctatcatataaatatggtcgactatttgcttttcaaaatctttttccttcctttggagaatatccccttaccaatatctcccactttttcaagtttcctattggaagtttttaaaatcttcggtgtgtggtatccatttaatattgacggcttacgtgcaagatcgctcaattgatgatgttggtggtaatttccttggtcaacgtcttcataagctttacgagcatgtggtcctagttggtcgttttggtgctggtaattattatctgaagatgaactactaagcataaaagtcaaccattcgtccaaaccagttttgacctgatattcgatatttctagctttggacaattcttccactttcatccgaccattggtcatggtcattatctttgtgtaatcgtaactttgttgtggaaccctgtcctgttcgctcacaggtcttggtccactaatagtgcttatgaactcacctttaccagagtcctctgaacctcgggtttcaatcagaagattctcgtgtttaagggcattcaaatcttcaggatctttcacctcaatcctatcgttactgtcatctaattctttaaaataagaatcttccacctcttttacttcagcttggctatccaacaacgaagctccgggcaaactgctcgttaccgtcgaaatattatcgatatcgatattgcttggtaatttgctcactctatccggctcaaagtcttcaatttcttctggttgttcaaaaattgtgtgtctatcagcgagatcctgattcttgataaagttatctctaaagttagatgtatcaggtctccaatgcccaaaattgatggagttgcctcgctcttgtggtgattctaacgaggatgtaggatccaaatgctcttcgttatcgtttgatattctctcttcgtcttgtgaatgtctgtccgtttcctgatcttggaatctgttatgatcaatgtcttcatctgacaagtcatacctattctcatgctcaatatctaacgcgtctaacttgttacttaacgtaaaagagttgctgtcaccacgatcaatttcatgtagattcccctcatcttcactgttagagctctttaaggtggacgaatgtctattcaacgcctttgaattctcaacgagtagtttatcgccagccgatttatgaaaactggcaactgaccaagaacctgttgacaacgaaccggatgaatgtgatctaatgggttgaggaacctgtactggttcgtgaagttcgcttgattcctcgttttccaagtcttcagctgtatattccggttcccacattcgaacgtgatcaggttctaacttttgtttgcttcgctcaacttttgaatcatgctcctgttcattgtagctgtaagattcataagattttgtgggatttatttggttctgttggtcatttccttctgattcgttttcgtcagccaaagtctttggtaggtcgatttgttcagatttttcggtaagctgttgttgaagaacattcatttttttccaaagacccggggtctcttcttcgtcatcgctgtcttcgctcttatcgatccaatcgtggtttccataccttaggtcaggtagtaaatttggtgcgtttggaatgggaggcctttccgaaatatcaacgttgttgtccacagcagggccttctgcacaccttttgtcataattgtcactcgttgaattaatatcctcattcgtatgccggagactggtttggggaacaacagttcgtgcagcttcctgtagcgtattcagtttcggcgactgtctattctccgacacaaacgaatcattaaccggttgctcaattgcattatcacagctcagtgtttcgtcaaaaattgaactccgcttcggtatatcttcgaattgttgttgagttgtgttatcatgcgaaagagattcatcggaagatcgagtcttaccattcccaccaaaatcatctatcttcagcacaacattactcttccagtgaccagcttcggttccaatatcttcctcctcctcactttcttcgatccaagatttcctacgctcctcttgatttggcgaattggcccctttgtcacctattatcgccgaagggatctccagtttaggaagactgggaattgccggattatccgactcagagccggaaaaattgtcatcataaccccaactatctccatagtccgccgtgtgttcgatattggcccatctttgggacttctgcctgtttatcttctcctgatccatgttggtatgctttcttttctttgcgttcctttctactgactacgaattcatatatggtgttcggatgaagaatcaaggataatggaataaaataccacattgaggtgaaagaaactggtcacttcacggttttcttttgtttcaaaatgtcgaatgtctcagatgaagaagttaaagtatttgaaaagttttacaagtttgacttcacaaattccaagaaataccaagatggacttttagcggtttatgaacaatacttagtaatgaagtttcaaaatgatccgcatattgagcagaaactaaggggagaggagaagcgggacgtggaaaaactggcaaatactctcttgcagccttcagaaatatcccagttacaaagtcaagccaaggtttactacttttgtagtgaaactggggacattatgtcattagatgattatcagaaatgggaagctcagttcacagaaacaaaaagattccaagaaatcagctcagaaagagcaccgcattcgtcaaaatatgaagaattggttgatttgattgtacagggaaaaccaataccagatatcaaaacagtaccagatatggtgtatgacactacaaagatatcccaatctagtctagaactcaggaagaagccgtgggaaacatgaattctatgaaggctaagcaagttctttagtggacatgcattagtctcatagcaaactcaaaagctgccagagcagatgcattagcggggaatgaacgtaacatggtgggtatgtatcctctaaaaaaccccttcattccccctctttcagtataaatgtaacgcaccgcttgggagtacgtcctgaaccgaggtttagccacgttatctgtcattatggtctgctttatcacatcagctggataggcaaacgtccaaaatactgaggcccccaagcctccagcccagaagttaaccgcaggtttagagagagttgtgtaacggtctaatgcatcagttatcaggtcgtatgaaccccaccagaacacgaaattggttctgaagatcattgtgggaatcaatcctctgtataaagtttttaatccatcatatctcaataattttatcaaacaatcagttgggccatcgaaaacttttgatttagcgtcatattgtatttgtagacgcgctttgatagtctccactggtgctgctacaaaggatacagtccatccagatccaactgcggccactagcaatcccggcatgggtaattttttctcttcaggataaaacctatccttgatcaactgcttatagagatgtagagaccctaacatgacagagtccatgatcaaccagccatacataggagctaatgcacctttaaaaaagccaaagagaccttcatttttcaatgtcataacacaacaattcaagggccctgaaaacctaccaggttcagccgtctgtagtctgaccttaaccgtgtcaaacgggtgtccgacgaagttcttggtgataccactaaaacacccggcgacaaacccaatatacttggattctcttttttccgggtccaagtggtcttgactcattaaagaaaggagttttcagatcgataatggaactaatcctgcactctttttacggagatgaaatatttccaacctccaatagcttaggtaatctatagcccatatcccacactggttagttgaaaagaacctatggggatttgctcgcagtataacttaggacggggcgcgactgacttcttagtttggtgacttgagaaaacatggtaagacgcaaaggtagaccgcgtcttaacgaagaacgattccacagtagaattgaccacgcccccacggaaagagggactagcaagagcgttgggacatataaacatcacatggccttagataattataccagcgcgctagaaaaactggccttacagtttacagtatcttccgatgatgataaggatgagagtagtagtcaccactcagcttcttctgaagacactttggccatgaatgacaatgatattcagttcttgaatgaaaaatacaacatgattaatcaatgggatgttattgatcaattggtcaaaaattcgactaatgaaattggagaaagatacacagaaaataccaccacagcagactctgaacaagaaacaaaattcaaaccacagatagaacagcctctggagcagagagaaaaacccatatccccctcaaaagtgagcagcaagggtaatcttatcatcttcgcaacaattgtcctattggcagtatcgtcgactataatatggctcgtacttcacgccaacatatcttttcaactgccttggcagagccgctctgtaactacttaccttcctgctagttctcttagcaccatcaactctaaatttagagatttggaattgaaagtcacacaactggaatttaataataagaatgtacatcaatcactagaaaaagttgattcgaaagttcatgctttagagaatacccacaagaagttcgaatcggatttgaataatcatgtttcattggtggatagccaacttgatcggttaagggatatacacaacttgccagattacatcctggataatatatggaagcaacttcctcaacacctaccaattatcgtgcagtcgaatggagacatcgaactcactcctgaactatataattatctgatttcattaatcaatgaaaacgtccctcaacaaacctgggaggagtttgtggaactgaatagagatcctatcaaggatattttagtttctaacgttcaaagtttaggaatcgttgataagcaactgttgagatcagaaatcgaagaatcattaagaaagtctgaaacatcaatcgataacaaaatccaagcgctgaaggaagatttgatacgtcaataccttgacacttctcgtaactctgaaccaaaattacctgatttggatgagaaagatccagctctcttgacatcatttcaatcacttctcaaccaggttcttagtaattcgggaccattaaatgagcatgaaatgcccaagaattttgcagagtattcgcttgggtcgtcaataattccaaagtatacatccaagacattcaagcaacgtcaagagaaaaaacggaagcacccaatagaaagagcacttttaggttggctagatttcttgtaccgaaattacaaatataccaaaagctacctatcagacaacgaaaactatacagatggtctaggaagggttattacgtcacctgcaaatattttgaagccaggaaaaaatctatattgggagaccccaattgaaccacgggcaagtatcggaataagaacaccagaatctttctatcttaccgggctactgctttcttatcccacacagcttgcagatctcgagttggccattaaagagtttactgtatatgtcaaaccatatcatgctcaagattacgagagattgttcaacgcattgttgttgctatatgagcaagagcccttcatcaaaggatttgttcaaatcaaaaaggacacattcatggtcaaagagcttccaaatgatcaagatcaagaatttgaatttcctcaactatttgtggaccttgcgattcccatcagagaaatagtattagtggttaactcaaactggggcgatccattacgaacaagaatatatcctttgcaattatttgggttcgatgagcaacatttgaaaaatgccaagaaagttttacgtcttcctgccaactttccaaataccaagcttattgaaagacttagggaatactaatagagtcctatttcgtacgtaaactgataatggactacctgtaatttattatagtttgttagagaatctattcaattcttcagagctctcagcgggtgaaatccctccgattcccctaacggcacgattcaagtttcgtcgttcgacaagtaaaaactgtaattgttgtctcaaactgttgatcgccactcgttgggcattgatctcctcacgataatgtgaagagttgttagctaaattggttagaatttgttgctgctgttgaaaatcggcaacaataggacgaacgcgttcaaaatctgttctcagtctctcaaactccattacaaggtgtagataatcttcatctagtaagcttttatcgttcttcttgttttggcgctgagctccaacttcttcaacgttcaaggtataaccgacatttgtaattttgccttgtacaactgagtctaagactgttgatagctgcttgctgagggttcgattttctctcctaagcccttccatttccctttcctgtgtttcaaagtaagatgacaacttgtaaaagacacaacgattggcatgaatagtatcaagcagatcctttgagcccttccaatcacatccgtaagcttttgctggacatttaacgtgaattttctcacaatagcgttcatgattttcaaagtttgtaatcggaaaatcaagcaaacaaccattgcattgctttaaattccttttacattcttcattgagatgatactcctttgaagaaaaagaaataatcttcccacatttctcgcaaggctcaggttgatgagggcatatacgttcgcctttatcattctctaatagatgacgacgttctgtccattctttgcatatccgatactgcggtttgatatcgtcttgtcttttttgtctatcattgtcatcttgatctactattgcaggctcctcaatagtgcaattacattcaaactgggtatatttgcactcttgtacaatatgcttttttatttgccaacgaggtccaacccagtcacatcctcgttccagattcatgcatttaaccttgaggtcatcagttatgttagaaataataataggagcaggataaacatcgtcattgttctgtatgtctagcggtgtgcgatccaatggacatctactacctaaaggagactttagtgcttcctccaaacaagtgtagcagtatgtgtggccacaaatagttgtatatgggtctatgaatggcaattggcatatgggacaattgagatgctctagtggttctaaataaataagggttcttaaatcgatcttggaatcttcatcagaaagataattaaacccagcttttgaaaatttcatttccatcggagaagacggtggaagaccagcttgttctagcagtagctcaggtaaatcttcaacggccaaattcaaagacaaacttggacctgacaaatttgtctcaggtaatacctgcagtcctgcctgtggtgcagaatcccgagacggttccatcaattggttttctaattggacaaacctgtgtgagggttgcttgagttatgaaagaagataagaaagttagctgactgaaaagactatgcttgccattttgatatgtggagagcagacttagggcagttcgcgaagcaagaatgtggggggcgtgaaggagcgagcattcattacataacaatagaatagggtgagaaatcaaattaagactgcaaactaaaaccctaacaaaagctgaaactcggtgggccggttattaataaatctaagctctggtagacgtagctctacgagaaagagagttcttggaatgcttggattcgcgcgtttgttgtctttcaatagtaatttgctccaactcagcttcagatgcttcttcattcttgactctattattggactttggcactctgcaaagccaatagaagaaaacagtgaagaacatattgatagcaatataacatatgaaaataccccagtttctccatctttctgaatacttcgattggactgaggagagaaaagtgtttgtagaagatgcagggcagaaacggcaatcagaagtagcattttgatcttcatccacgatgtaaccagctgtggtcaactcgatataagggtcgagatattcagaacaagtcatttcattgggtggctgtatcagcagtaactcaacattggagcattccaaatccgaattagctaaaccaacagcaagcacaccttgaacccaataagtgaagggtgaaactcggtacataaaaatccaaaatccagtaggaattttcaaaacaccacaaaagttcaaagacatggtatataacaaagttgacaaatttgcagcattatcatatacttgcatacccgcaacacaggcttgaccaagagtagacgtgtaaatatagaaagccgtaacatacaaccacattaacgcacctctttcatgaatgtctgcagatgtggcattattctggaaaccaacagtataataccaacaaaagaaaccaatagttccgacacccaattgccatggaacctcaacagtaatttgtgccaagatgaaagccagccaagagaatgttttggaaggtctttctctagcttcatatagatctctctgagctgtgtaatggggtaacatttgttgaatcatagtcaataatataatcgtaaacatgaatatcgaaaacatttgattctgcagaccttgaagagagttactggctttgaagaatgagaacccgttaaaaagagctgaaataattgtcagaagaatcttcgaccaaagataagatggagttctccaatactgctgaaaaaccctcgccagaacaatgaaatactggcttaagagtggggcagcgaactccattctggcctcaggtgagtcgtccttaggaatttttactaactctctttccataatagctagctcttcacgaacagcggctctctcagcagattctaaccaaacttgatgataatccttatcagcaacagatccaggcgcagctccgataacacttaacatccactctgctgggttagcctcaggtggacatttgggagaaccatgactttcaaagtattgtataagtgaggtgcaattcttacctaagtttccaaaatagacagtttgaccacctttttgcaaaaacaataatctatcaaattcttgaagtaagatggccgaaggttggtggatagtacaaagaacagcttggccattatcggcaagttttctcatcaatttacaaatagaccaagcagtttgagagtctagacctgaagtgggctcatctaaaaacagtaacaattgaggtttagctgctagttcaacaccgatggtcaatctttttctctgctccacattcagtccttcaccagcaacaccaacaacagcatcggaatacttagacatttctaaaatcttaatgacattctcgacataggcgtctttctcagcttttgatacagattttggctgccgcaagtatgcggagaatcttaaagcttccctgacagttgaagtttctagatgtaaatcctgttgttgaacatatccagtcgatctttgaaatgaagaatctctcaaacgaccattgacaaacatattaccagtaacaacacccatcgtaacacggtttgccaaaacatcgagcagagtggtcttaccagcaccagatgcacccataagtgcagtcagtgtaccaggtttaacccacccatcaacgtgatctaagattcttctattaatttgtttgatgtcataacagacatcacgccaatgaaatatatccttcccagcctgcagtgcagcgacaccttcgccctcatcagatgcatcctgctccgtaattattttttcgtttgaatcacttgattcaacgtcagatactctatttttgttctgctttttgattttccttagcgttgaagcctgaaataagacaatctcacccttctgcatagcacctttctgtaactcgcataaactcatgtaaacaatcaagaaaaacacggtgaaaccaacgataattccaaaatttttccatttccagccgttatcgtaattgaaagattcgaccagataacgagatccggaaacaaatgagtcacctggtaggcctccgacagtagagcaaactttgttctccagaccataattttcaaagcctggaccatcaggtacaaattgtgagcattcaaagtctcttccatggaactcattacacattagtgattcgaaaacataaccaattggatttatatagttaatccaacgggaccaaccaagcatgttcggggttggaataacaaaaccagtgtaaataaccatagccagtagcataagggcagcgggggtcatggcctcggacaatgtcttggtggcagcacctaaggttcgaaagatgtgagacatgaaaagtgttgcaaaattcgatatcagaaagtaaaaaaagaatcggcctggctctcttctaaagttcaccataaaataatagattaagttgaaggcaatggatgtcaaaatcttgggcgggagttcagtaatgatagacgccaaagcatcagcagaaggatggtaaagggcatatttcttatgcttctccacaattggacgggactcgaacaatgccataatttccaacatggaagaaaaggcattaaagagcactgcgaaaaataatgccgcagtacgggtataaaaagaacctgtggtagctggtaggttgtagaacaatgacgataaaattaaacccataattgagttggcaatgacagagaataaggtaatagaaggatccgctttagttctaagaaagtttctacccatcacatatcttatctgcatccagaatgatagagtgaaaggcgagcttgggcgggatgagcttgcctgtttggcaacatgggcatcatggaacgcctgtgcaccatggccatctttgttctcttgaatgtaggcgtcaacacgtcttgccagctcagcatactccggggaagctctccaatattgagaaaactcttcaggagtctttggaactttaccttcaaaacctttgcgtacaattctttcagcaggattggtaagagatgtcaagaaatctgccgtcgtttgtctggctggacaatcgtagcccatttcaacgaagaaattcttagcagagtccgcagtaccaaagaaaatctggtaaccttcatacaataaaacgacattatcaaacaagtcataggcatcctgtgaacattgataaatagcaatcaatgcggtagtatccaaaatggaagtttgagtcttcaatgccttgataaactccaaggcagttgcagcatctaaccctctagtggcattgtcccaacattgcaattgagctccgcaaagagaaacctctgcaatggagacacgctttctttcaccgccagatacacctctcacaagatcattaccgaccctcgtacctcttgtgtgactgagaccgtaagtagccatataaacgtccgctaaatgattggcataggcttccctactaattccttcaggacgattctgcggagttctcatacgagcagcaaatttcaaggtatcaccaacagttaactgagggaaatgtacatcggtttcagcagagtagacgacctctcctctgtagttgctgataatttgtttgggactgagaccatcatatgatatctcagactctggagcaacctcaaaaccataggtatgagctgcgatcgtcttcagcaaagttgaacaacctgcaccaggtctacctaagacaactgtcactgtgcccggcagcattaagccatccatcgtcttcaaaatatcaaaacggccttcctcactggtattatttcttaggagagaccggatactttgcatatatttcaagggcaaattagaaactgttgcctgaaaatcagcatcagatgcagcacctgttgctctcaaattcctgtatccgatacctaacgaggagtgcttgtaataatctggattggtatccatcgtttttctaaagttcttgatccaaaaagaaccgttgaactgtggagagctggggtccagtctaggatcaatatcaccttcaaaagattgtactccaggaacttgcgaaaaagaagttaatgttctaattagatcttgacttgattccgtagcatttgcagctgattggttagttaatttacgagcgagctccctgacttgttcctcagcatggtcatcgtaaccttcatatggcgccaattcggaatcagacccattcaccgaaatgttctctatctcgtgttcaagacttcgattgctcatcttcagaagaagtcttcaaatgaggaattgaagagttatcaagttaagtggcaagaatagaaactttaaaattaagggtttccagttgtgcatttatagggatataagaaatgaaaacaaaacattttcggaatcggaaactctttcttccgaatttccgtttccgaagacataacattgattctccaggtctaaatttaggaaaaatgccaaaaaaaagcgactgagcatctgcatcgatcggagtagacaactggttagttgccgtgcctctcagaaccaaagttgagctggttaacgtctgacttgacagcggaacttggaatcttcggaagactctaggatgcctaaattttcgatgcctccaaaatctcaatgtggcttacgggaatctacggctcaccttacaacgaaattgggacaatcagcaagcagtctatcgatcgttgtttacaaaatatttcgctaccaagaagagacaccccgtttgttggggagtacggattgttgattaccaatcgccaatttccggggcttaccatgattatgcataacttctcggaattaggtcttgaactgaaattactcatgctcagtgcatacacttatccctagccgcattgactctgtgagcttccggagtgttagtagttccgaccgttagataatcgtgctttctttcttttttagtgttgttgtattattaatacgatgctggtggcttagaaatagcgatcgtgactgcgatgtctagtcgcctgatgagttgacttcttcctccctccggtttcacccactactaggcttagcagttcttggcttttctgtccccctcgcggaaatgttctcacgtcttccgcctaacagattgttctggcggttttagtcgtctagctattgatgcattcccatcattcccatagtggaagttacgtttctcatgcaacggatacactggatgaaatcgtagacaaagctattgagctccatttccaaacatattgtctcactgaacatatgcccagatataaggatgaagatctctatcctgaagaaattgaaaagaggtttacctataagtgtctggtcgaacaatttgaccagttttataagcatgcaaaagttataaaagagacaaggaacattgatccccagtgtgatacaagatttcttatagggtttgaaactgaaggaggtcttggtgattatcaactggatcaatgtttgaaattacgcctgacatatcctgttgacttgattgttggatcgatacaccatttagactccattcctattgatatcgatagggcaaactggctaaaagccaaagatgcaacaacttcgaatggttcgatcagagacttctattttctctacttcaaaactcaacaattaatgattcaaaaactaaggccagaagtgatcgggcattttgacctcataagattttacaacgaagatggcgaccaattatttcaatggccagaggtagtagcgttaattgaagagaatatagacttgataaattcgtatgatggattaattgagctcaattcagctgctattaggaaaggttggccgtctccatacccaaaatctgatgtcatcaattttatttttagtagaggaggaaaattttgctttagcgatgacgcccatagtgtgggacaagttggcttaaactacatgaaaatgctagagtttgttgaacaatcgacagaaattgacaagatctggtactatgatttgagcaacactgataaacttattcaaaagagtattccagtttctagattaagggaccatgtattctggaattcaggctaaataaatctaatcacgtattataggcgagagtatcaattttatcccagacgttgttataatgagttagcatttcttcgaatcccactaagttataagttctaagtgttttccatctattgttcacttggccttcatccaaagaaaacaacttttgcaatccgagtttaacatcttttttagcctttgctttatttattggtactccatatttgatggagatatcttcaaccagaaactgaaaggggagccaaggtttgtactcttgatcttcataccctttaaaaccccttctgataaatgctgatatagttttctcgttaaaaataactctcagtggatgattacaattccgtatttcaagaactggatgttgcacgtcagttctttggatctgaggtattaaccatttcaataaagtcttcacctcctcaagtggtctgttgtatagcatacaaagaatcaaggacctccaggtttcaggttttaccgatttttggtctaccttcaacgctgtgaacatgacctttatagcattaatctgataaatggccattttttggcttgagcgttgctcgattttgtccatatgagtccaaaatttggacagacattccatcagtgcttgcgttatagaaggactaatactgacacttctatcatggggtaatccttgtatgtgtgcaagtataatcttcaaatgtgtcaatccttgctctaaatgattcagtttaaacatcgcataagggaaaagcaaggatatattcacaactagttgagtttcataggatgtgaacttgatcaattctttaaagtttgatattataggcatcactttacaagtaatgcgaaatactttttcaactaacttcatttttgttatgaatgtcaaagtttcagactccagcactccagtgatgaacccctttatcaagaaatggttgtctattagtctactgactcgttgtgaggcgcgtaaatttcgtgtatcaacaatcttgatatgcgtccttagcagctttaacgactcattaaacagaaagtcatttttcaaagaaggagatgaatagctatcatgcttcagcattacttcaataaatttactgagaactgggatatgtataatttcgttgtagtcaactaacttcgcaaatgatttgataaattcaccttcctcttttatatgcagacactcttcaaattgtagtttcaatggtgcaacgctgatatgcagctctcttttgcgtttgagataatcaaaactgatcttctctttgtcagtatatttcattaacaggatccagcgattcgcagatttcaaatttgggtccgtttttaaaatgttaaggaatttatccaaagttttttgaggttcatgggtcaaattaatgcatttgatgaacatgacaaaagtttgagtgtccatccaccgattggaaaccaaacgagacacgttggcgtttgccatgacagacattagtttctccaccgcttgaatatttttatgcttgtacaacagggaaagaactttagtgaaatgtggggacgacttggatggaaggtctccatttttaactaatgctttattccattggaaaagagacttagagttgattggaagctttgaaagatatggtatgatgaattcatagaacgaatctctttttaaatcaagctctttgtgtaactccatcaaaactttcaaagatttattgccatcttctttcgaagcattcagtagagctatctggattatagggagccaattgataattgaaccatttgaacatacaagcgggtacaactgtctatgataatataaaacatggtggtagattttgtaggagaacagtgacgaaataaaattctgatagatgaatgccatgttcatcttttttctgggtatgggagatatgtcttggagaaatcttaacactaccttttggtagaagggtagttcagagatccctaatctgttagtgtaaagccaaaaaagagtcatttggccagtatttgtttgactaaagtaattaagtagccgcttttgatcgtatgactgcttgtattgaccccagtgagcttttatttcacctaagatcattttgtcgacagtaggaagcttgattacttctctattgatgttgaaaggcaagtctttcctggaatgtaaatcctctaccaaaacctgtgtattctcaatccatggaaagagttcgttggaagataccccctcatattgtcttgaataaactcttgattggatacttgattgcaggaacatacctgatcgataacaattgaacaacttaaactgaaatcgaaatgggcggtgacggttattcatggcattttctcaaactcgtttcaaaattgaaggtgttgggcaaagagaaggaagaagggacactgctgttataaacgccctgttagatgaagatactaacaaaaaagtcttgaattttgtttctttctaagacttaaaatattatataattatagtttaccgcatggcttatataatcatatcgaagtacagatgtgcctgaatctatccaatctttgtgagagcgttcccactgtttcagtgataagctaaactaggcgaccagtacccattttggcatgacagagaggttttctgtagacgttccggtaacaaaccttgatgcccatttggaggaggatgatgtgatacttgatcccatagttacgaacctgcaagactatcagaaaccatcattcttgagctccatctggtccaaactgtttaacaaatcctctgacgatgaattttttctggaggatattgaactagaagggggagatttagcagtttcatcgtcatttagtttcaatcgggataagagagtcaaaatgaaacgatcccaaattgctctattggtaggtttcattggcgtagttgcactccttggtggctggcttgtcaggggagtcttcaattctgatcttgacaaatttcaggatgtgaacattccggttgaacaaagtaaggtttccgatagaaaattactgctcaacaacggtacaactccgtatcacgccacaaccatagtgatttctttggatgggtttcatcctcattatatttcccccgacttgacaccatttatgcatgaattactttcagaaggttatggagccccttatatggttccatcgtttccttcttctacctttcccaatcattggactatgataactggcctttttccatcggagcacggtattgttggaaacacttttttcgatccagattcaaaccgtcagtttgttaataccaatccgagactgagtcttgatccagagtggtggggaggagagcctatttggaaaactttggactctaacaatatcacaacctctgttcatatgtggccaggaagtgaagttcctttcgaaacaggccaaccgttacaagttgacccgtacaatggctccgaaagcttagattctaaaaagtctaccattttaaactggctagataaagatatctctgaaagacctgaactgattctgtcctatgttcctattatagactcgttaggtcataaatttggcacccatggagaaaaactaacagaaggattgaagtcagtcgattttttccttgatagcgtgtatcagggtataactgaaagaaatctcacggatattgtgaattacattgtcgtttcggatcatgggatggcacctacgtccaaccaaagacttatctaccttgatgatatagttgatatggattcaattgaccatatcgatggatggccattatttgggattaggccaagaatccctgtagctaaatttttcaaagagctagaaaaaaactgggaacatcatctacttaaagaacatttcagtgtttatctgaaagagaatctcccagaggaatggcactttgggaccaacacaaatcagtactctaatcgaattgctcccatttgggttgttcccaaggttggctggtccatcaccacccatgaagacatggaaaataaaatggagttcgactacaaacctaagggggttcatggttacaataatacggaagttctcatgcgagcaatattcctgggagttggtccttacttcacagagacgctacaaggcagtttgaaagtcaatccattccccaatattgaactttacaacattatatgtaatactttcaacatcaatcctgcacccaacaatggatctttggatattatcagccttaaaaacctgctacctaatgattggcatgacagcctgaactatccagggatccagattgatgatgaaccatttatggtgataaactcatcatatgatcaaatatggcgagtttcttaccctgaaaatcccaaggttgaattgacggaaacaaggacactagcaactagaactgcgacttcaaattctctatctaacccttcaacctctgcttccactgaaaacaaaatcagtgaactcattattgatgtaattgatgatattgaagaggcaatagaggatgccgtagaagatgcttccgatttggtggatgaggtcagcgaagatatatcagaagctattggagactggaaaaaatgaaagcttctcacattttgggcaccaaattcacatttagggttggttctgaaagtgactcgatttgaatgtctatcacgatggaccttttcctcgtcaagtaggcttgaatgcctagttttagagacgtttccagatctttggttgttgtagctgaaaatccatctatagtcagagattgacaaagtaaatcatagcgacatgatttagtttcattgaatattatgcagatcactggaagatcattcgatatggaagttattaaatccgttacattaaaagttaacggggcattttctttaaagaagaatactgccaaccgtgtcctttctattgctttcaatgacatggcgtaaagcagtccattacccggtactggaagtgaggtaacatctatcaactgtttaggcaaaaacacaggatataacaaagaagagaattcatttgaaagatcgaatccctccaccacattatatacatcgtcctgatagtcttgaaatgattctcttatcgacctaaaggcataaaacagattcatggaattttcaggtgaccttgctgtctcaagttgtgtaaagattcttaacttctgatctctaagttctgacaagtatgtaagaggagatcttgcaacgtaatcgaaagcttgtaacttttcatttagggcctctaatatgtcgtataaatcaccaaccaaagcaagttcatatacggtatcgatggagggaatgtagtcatcttcaatttcttctggaacattgtctatttgaataacttttaccctcttgtttttcttgttaaagctattaaaattattctgcgagagctctttcagcgaagtaccgaccaaaattaagaaatctgagttctcaatgctttcgttagctataacggtgaaactgtgctgactaaaatctgggactgttcctcttgccattgtggtggtgacgaatggaagatgaaagttttggactaatgatcttaattgaatgtgtgcattgtaagatgaagcggcagcttttccaacgacaatcaagggataacgagctttcgtcaataaaaagacgatgtcatcgagtttgttgcttgctggacgaagactgaattttgtgtaaggatttttggttgtcaactgtttcagattgtcctctacaggagcagtcaatacggaagaatcaaaatggatatgagttggacctgacctaccatttatggaggacttgaaggcctgagtcaaaaccttttgaattctatcaggagcagaacacctttgataaaattttacaaacgaagtgcacagatggctgaagtcttcctcatcagttgaaacggtgataacgattaaaggccaccgctggtattgagcattcgaaattccagaaagtccatctagaaattgactacttcctggaagcaataggattgctggtgatgatttgatataaccatgcatagtggaagcaaaagaagcaaatttttggctgggggccttaatcacatcaatctttgttaattcaaaccactttaataaaggattagtggtggaatcatctattccaaaaactgtgtcaatacccagaactgaaacagcttttgcaattaactcagccccatcagacatcggtaagtataatagaagaagatagagaatgggcaacgactacttggaggatttatgtttagtggcgggtattattaccaattttgcatcttttcgtggggaaagaatgggatgaactttgttgtgattctttctgcaatctccttctgcaagcaccttcaaagaagaattctttttactctgtgagagaagaagcatgtacttttgattcatcgatgtcataaactaagaactgattgatttcaaaataaaaaccttttgtattcacctcttcgcctcacttcttgaggacatcttagtggcaccaattcctggtcgaactcatactctctagcaataaactcaaacaaccgcaggacgtcaattgaaaccgacataagacccatggtgactatataaatctgtaaagcctctttgaggctacatcggcgtcgctgtataaatgcaaccctctatgcagtttcggtagtagtatgcttcacttctgcatcaggtttcccacagccaacatttcacacaattagcgaagggtgatctaaaaatacccccttacattaatcaagattcacgtataaatccacctgtaaggtagctagaccctcaaacgcatggactacaatagcagcagtagagctcctctaaggaccaatccagactacaatggttacaacgaagatgatgacgacaacgacagatattcgttttaccaaggttattccaacatcaataataatattcctccaaacgatgatcacaatgattcgtacttacaccctgatataagaccaatagaaaactcatacgtcccagaatacaatcgaccttattcgtatgacggcagtgaagttggtgacaaccactacagaaattatcaagagtatcaaaacacgagtcgtctggagccagggccaatttccttccatcaagatcaacctcctggatatgaccaggaatcttttgagctgaacgaattgagaagaccagctatccctgttcctggaacatttgacgttttccaagaaagaccggaatacggtggggaagatgaagagagatttattgagaataattttcaagccttcccagagggtgaagattataagatcaatacatatgctgatgaagaaattgatggcgaactacaagaactaaacacaattgattcatacaaagagggcgatgattccgaggaagaagattccactgggaagatcaaaagatctcccacaacaactaggttaatcaaacttatccatggtaatctgattttagattgtccagttgcttctagtttattggagaagtatcgaaacgttaacttaacagctcgtgagttccagtttatgagataccaggccgtcacttgcgatccaaagttcttttctcaaaataatttcacattaagacaagaatgttatcaacagcctagaacaactgaaatcatgattgttgtaacaatgtacaatgagaatgatattcttttggccaggactttgaagggtgtttttagaaacatcaagtacatggagaaaatgaagcatcacggtatttggggagaagattcttggaaaaaaattgtagttaccattgtcagcgatggtagacagaaaattaacgaaagagcaagatcactaatagcattgttgggttgttatcaagatggatttgctaagaacatggtcaacaacaaagaagttgtgtctcatgtttacgaatataccacaaagattgatatttctgaagtcactgaagacagggttaaattaacttcagaagacgttgttcccgtccagttaatattttgcctgaaggaaaagaatcaaaaaaaaatcaactcccatcgctggtgttttgacgcattctgtccaattttaaaacctaacgttatcgttttattggatgccggtacccaaccatcttctaattcaatatataaactatggaaagagtttcacgatgacccaagagtagctggagcatgtggcgaaattcgggctaaccttggtaaacacaagaaattactaataaatccactggttgctgctcagaattttgaatataaaacgtcaaacattctggataagcccatggaatctgtctttggatttgtttctgtcctaccaggtgctttttctgcttatagatatgtggctttgcttaatgaccaaaatggtattggtcctttagaaaaatatttcaaaggagaagacttgcatagcacagatgctggcatctttagtgccaacatgtacttggcagaagatcgtattttgtgttttgagcttgttgccaaaaaggaatgtgcttggttattaaggtacgtgaattctgcacatgcttcaacagatgttccggaaaagcttgacgagtttatatctcagagaagacgttggttaaatggttcattctttgcagctatttattctgtgtttcatttctacaaattatggggttcaggacattctctgggaagaaaaattgcccttcatttggagtttgtatatcaatttttaagtcttctggtctcttggttttcaatggcgtcatactttttagtgttcagaatcctaacatctgctttaggagagcctggaatgaatgtgaaacctggtaaggttttgggtgttgtttttttgtggctttacttgatgtcaatcgtgactacttttgtcctggcatttggtaatcgtcctaaaggaactcagaagttctacattgtcattgtttgtttttttgcaattatgatggtttacatgatatttgctgccgtactgatggcagttaaagctgttacagacatcttacaagaacatgccaacgatttccagttttacatgatctttacagaaaggcgctttagggatttgatcgttgccacagcttccacatatgctttatatctcattggggctctgctatttttggatccatggcatatgttcacctcgtttgctcaatacattttactaagcccttcttacgtgaatgtgttgaacatttatgctttttgtaatattcatgatatctcttggggtactaagggtgaggagatgaaattggatctgggcgtactgaatgtatcttctggtgaatctgaagtcaacttgcctatatacaaagttgatattgaggatgcttacagcgaacaaatgaaagttctaagtcaaccgtacgaagaaccacagttcaaaccgtcagaagaagaaaaggaaaaagattttttcgcatttatcaggtctatgacagtccttatatggatgtttaccaactttgtcattatcgcattagtattggaaaccggaggagtgagtgaactgggaataatttcagaaaagtctaataagtccgagatcttccttacagtcatcctatggatcgttgcatttatggcccttttcaggtttcttggttgtactacatatttggtcaccaagtatatcagaaagttcaaagtgaaagtccgccaatgaaaggtaggactgttgtcattatctatcgtctaaatatgtacatgtaaaaaaatattgttggcaagaaggagaccatatcaacagacacaatcacgggagcttcgtggaaaggggattacatcacggatgttttcaacacatcccaaataacataatagtcgttcaaagcccattccaaaccctccatgagaaacggatccacttgatcgtaaggataagtaccattcaatatcatcagtcttcatatttctttgcttgatttcatccagcaagagatcaatattgtgttctctcatcgaccctccaattatttctccaacatctggtactagaagatcaaaacatgccacagtttttccatcagggtttctagtcatgtaaaatggttttgattctttgggataatttaatacgaagaccggagatttgaaatattcgcctgttagccatttttcgtgttccgattgaagcggttctccccacgcaggcttaaattggaaggagatatttcccttggaactctctgcactcagtatatctatagcttcagtgtaagtaatagtcttccatttaccattcaatagttgatcccatcgttcaatcattttgtggacgaattcctggtcacgccttgagttaatcaagttggaaccttgaccttccaaatcttgatgcaaagagttcacgacatgttttatcattctttcacaaaacgtagtgagctgtctgacatccgaaataaaggcaatttctgcttctagcatccagaattcactaagatgtctatgggtatcactttcttcagctctgaagcaaggagttaaggtccacactctgctaagagccatacaaagtacttctaagtgcaattgagtactgacagttaaataactatctttaccaaaaaacttgttttctatgtcagctctagaggcactttcaattttgaataattctccagcaccttcacaatcagacgatgttattaaagggggatgagttctagtaaattgttcctgggtgaaaaattccatcaacttcatttccacatgagatctaaatcgtaatatcgaagatagaaattgagttttccatctcaagtggggaatcgttctcaagaactggggagaatgaaatttttttgcaacggataagaatctaaaactggacctaataccttgacactatcaggatcagttgttttgagctcgatagattgacttttaccgttactttccttaatctcaccagtgacttgaacgctgacaccagtcctcaactcctttgcctggtctggtggaactacgcacatcagattttgaaatgatgtcccatcactgatatctataaatgcgattctcttttgaactcgcacaccttttacccaaccgttcaccgtggtctgagatttaaaagggggatctttgaagatttcattaatgcatttcgatagggcgtatgaagattgcagcctcttgaactgaaaaacgaatcctggaggttttatcaacattttgcagagagtttactaagggaattgactaaatctctacctacccaagagaaacgcttcactggcgcgcacacagtgagtttttaaaaatgcctccagaaacggattaagtattatgaatgttctatgacaactacagatctataattataaactttaagctgaaaggtaagcgctgaaggttgatgaaaaataaagaatgacatggtgaactgaaaaggggaatgaaaacaaaaaaaaaagaagtcatcagaaaaggtatcactggcaatgcctcaagtcataaaatgatgtcctctattgtactatccattcgacccccatgcgactcaactcaacttcttgattaataagaacgcccaaacatacagtaatggatagcaggtctgtcacatttgacacacttttgaccagcctttagttcaggctgttcgaaaggaatacacaacgacttggcacccatacttggagccttttcgtcttcttcctcgtcatcatcgtcatcttttttagctgaggagtcctttatatcgtcttcacagtctgcatctccacaccatggggacaacaaaacattctttctgttaagcgcagggacaaagtcttcccatttgtcaatgattatacgatgagaatcaaacttagctctggctctagctaacatttcagcctgcatggtctccaacaaatctgaaatttctttctcaaaagtgtctaaggaaatggtggttttggtgaagtcatcacgacggacggccactactgtattcttctgcaaatcccttgggccaacttcaattctcaaaggaatacccttcaattcagcattagaaaacttccatcctggggagtagttggttctgtaatcggatgtaactctcaaatcattttgacgcagtttaccctcaatcttgttacaggtggctagaattttctgttcttcctccttggtggtcttagaagtgattccgacaggaataacaatgacctggtactgagaaactctgggtggaataactaaacccttgttatcggagtgaaccataaccatgacaccaataacacgggtagacaaaccccaagagttctgccatgcaaaaagttttggtttgtcggctccgtcaggattctcaacgctgatgttgaacatcttggaaaaattttgtcctaagcaatgtgaagtggcaccttggatgcctctaccagtggttggaatgtaaccttcgcaggtagtggtgaaaagacctccagcaaacttttcattctcggtcttcttgcccttcacaacgggaacggccaagagctcttcatagatgccaacgtaataatccaaaatctgtaaaacttctttattggcctcctcaaaagtcaaatgagcagtgtgaccctcttgccaaagaaattctctggttctgaggaacggctgtggatgcttgaactcccatcttaccactgaattccattggttcaatttcaatggcaaatctcggtgagaacgaatccatttagcgtagtaaggatacatgacagtttcggatgttggcctaatagcaatgggctcttctaattcagaagaacccgctctagtaacccaagctacttctggagcaaatccttcaatatgatctttctctttttcgaggaccttagaagaaacaaacatagggaagtaggcattttgaactcccaatctcttgatcttcttatcgaaatattcctggatacgctcccaaatagcataagatgctggacggaggatgtaacatccagaaacatcatagtagtccatcatctcacctttggtgaggatctgctggtaccaacccgggaaatccaaattcttgtcaacagtgacgccaatcagtttggcatcatctaatctagcaacactcttatccttctttggaacagctggcttctgagcaggtttcttttcagccaaggcaaagaaatttgcaacaaggatgttgtttgacaaagagcacaagaaatcttttaaagtctttgcagatatagtcagcttagaatcattatctttcaactcgtaaaccttgtcatctgaagcgttttcaatgttgatatccaaaacaagtttacatttagaagcattatcagggttgagatgacccaatccaaattggacagctgtagtggcgaaaaaaagttgtgtcaaatcatctttagccaatcgtggatccttaacctcagcaatgtctgcaatcacagatgaaggggtctgagtagtagcctcggctataacgatgatcgggacaggatcctgagatttggcagtctttggtttgaaaacaagagcctttacagggactcctccttcactctgtaacagagacagggcagccagagacgatactagggccattttattgcgataaacaaatgctgatcaagagtaggagagagagaaaaaaattgaagcgataatcactgttttggttgtctcacagatggaaatgaaatatgataaatcgtgactttcgaaaccaaaaattcagaacgacgtttcaaaatagaatagttgaacccttgaacgaagaggttctacacgttgatttagaggcgacgatagttggacaatacttatcaatatggataatcgacaatcctcaaaaagcgtctctaccccaagaaatagtcgtgtgacactcatagggctttaatcaaataatagtcaaacttgaagaaaaaaatttgcaggctttctttcccgtttgggtcggcagttgcaagcgactcgtaaagtgcacgactattttttttcaacatttctaaaggacattgtgctcaaacagattactaaagataaggtccatagtaatgtctgccacctattacatcaatgaactgtccggtagtgatgagactagctctggatccaaggagcaaccttttaaaactgctgcatatgccttttataggactgcggatgccaagttatttgttttcaagacactagatgatggtacccaagattttgttgagatctccgcttctgccctaaaaaaagcaaagaagggtgctgaggggttgaagaagaagttacaaaaggctaatttggctgctgagaaggacgccgctaagaaggcagctgaagcggctagtcaattggaagctatgaaaattaccattaaagaagatgagtcattaccggaagctagaactatcaagttgcgagctttgcaagataacttgggaactcgtgttcgggtgcatggttggattcatcgtcttcgtgctcaaaagggtcttgtttttatcgttctaagagatggtactggtttcttgcagtgcttgttgtcgggtgatttggctaacgcttatcaaacttccactttaactttggaaagcaccgtgactttgaaaggaattgttgagaaacttccggcagggaaacaggctcccggaggagtcgagttgaaagttgattattacgaaattataggtttagcacctgctggtgatgactgtttctcgaacaagattcaagagggggccgacccatcattgttgttggaccagcgccatttagccattcgtggtgaaaccttaagtgctgtattgaaagtaagagctagtttattgcaggctattagaagggtttacgatgaggaaggtgtcattgaggtgactcccccatgtatggttcaaactcaagtggaaggaggttccacactgttcaagcttcaatattacggtgaggaggcatatttgacgcagtcctcccagctataccttgagaccgctttacctgctcttggagacgtttactgtattcaagaatcattcagagctgaaaaatctcacaccagaaggcatttatctgagtacacccatattgaggccgaattggccttcttgacttttgaagacctcttgtcccacattgagagagttatcacgaaaactgtcaaatatgtagttaatgaccctgttgccggtcccttggtcaaacaattgaacccaggttttgcagcaccagaactcccgttcaagagaatggagtacgtagaagcactgaaatggcttaatgatcacagtattccaaacgaagaaggacaacctttcaaatttggtgacgacattgccgaggctgctgagagaaagatgaccgatactattggtgttccaattcttttgactcgtttcccacttgaaattaagtcattttacatgaaacgttgcgccgacgatccaagagttactgaatctgtagatgtgctgatgccaactgttggagaaatcaccggtggctctatgaggatcgactctctcaatgaactcctggaaggttttgaacgtgaaaagcttgacaaaagtgcgtactactggttcattgatcaacgaaaatatggtacctgccctcacggtggttacggtctaggaacggaacgtatcttagcatggttgtgcgacagattcactgtgaaagactgttcattatacccacgtttcactgggagatgtaagccttaggtgttttaccctgattagataatacaataaccaacagaaatacgagaatctaaactaatttcgatgattcatttttctttttaccgcgctgcctcttttggcaattctttcacctatattctaccttctctttccttttgttctaaacttattaccagctatctatgtcgaatcaagaagaaggacttaaactgtggggtggcaggtttactggggctactgaccccttgatggatttgtataacgcttccttaccttacgacaagaaaatgtacaaggtggatttagaaggaacaaaagtttacactgagggcctggagaaaattaatttgctaactaaagacgaactaagtgagattcatcgtggtctcaaattgattgaagcagagtgggcagaagggaagtttgttgagaagccaggggatgaggatattcacactgctaatgaacgtcgcttgggtgagttgattggtcgtggaatctctggtaaggttcataccggaaggtctagaaatgatcaagttgccactgatatgcggttgtatgtcagagacaatctaactcagttggctgactatctgaagcagttcattcaagtaatcatcaagagagctgaacaggaaatagacgtcttgatgcccggttatactcacttgcaaagagctcaaccaatcagatggtctcactggttgagcatgtatgctacctatttcactgaagattatgagagactgaatcaaatcgttaaaaggttgaacaaatccccattgggagctggagctttggctggtcatccttatggaattgatcgtgaatacattgctgagagattagggtttgattctgttattggtaattctttggccgctgtttcagacagagattttgtagtcgaaaccatgttctggtcttcgttgtttatgaatcatatttctcgattctcagaagatttgatcatttactccactggagagtttggatttatcaagttggcagatgcttattctactggatcttctctgatgcctcaaaaaaaaaaacccagactctttggagttattgaggggtaaatctggtagatgttttggggccttggctggtttcctcatgtctattaagtccattccgtcaacctataacaaagatatgcaagaggataaggagcctttatttgatactctaatcactgtagagcactcgattttgatagcatccggtgtagtttctaccttgaacattgatgccgaacgaatgaagaatgctctaactatggatatgctggctacagatcttgccgactatttagttagaaggggagttccattcagagaaactcaccacatttctggtgaatgtgtcagacaagccgaggagttgaacctttctggtattgatcagttgtccctcgaacaattgaaatccattgactcccgttttgaggctgatgtggcttcaacgtttgactttgaagccagtgttgaaaaaagaactgccaccggaggaacttctaagactgctgttttaaagcaattggatgcactgaatgaaaagctagagtcttgaaggttttatactgagtttgttaatgatacaataaactgttatagtacatacaattgaaactctcttatctatactgggggaccttctcgcagaatggtataaatatctactaactgactgtcgtacggcctaggggtctcttcttcgattatttgcaggtcggaacatccttcgtctgatgcggatctcctgagacaaagttcacgggtatctagtattctatcagcataaatggaggacctttctaaactaaactttgaatcgtctccagcagcatcctcgcataatccttttgtcatttcctctatgtctattgtcactgtggttggcgcatcaagagtcgtccttctgtaaaccggtacagaattcctaccactagaagcttgaaatggggagggtttcagctttgtatcccgatactgtgctttaaaaagggagtccaaactgaaatctttttcggaatcattggatgatacctctgtattagatctcctatgtatcggtttcctcgggtagatagaactgtcgacagagtctctagcaaattgagaattggctttagacttcggagaagtaggtgacgatgtggtagatatatcagcagatgaaaagactgaattttttctctctggtgatgagttgattccctcttggtgttgatatcttgaaccgggctcatgttgaacctttgaattcaaaaaggtagcttgaagttgctcattgacagcatctgccacgtcgtatcttgcaacatctttgggaaactgatacgaagtgttcaacatctttgttgcggtatgacaagagcacttcgttgtacttttatcagagaaaagaaacacctcaattatggtatttaggtttatatattacgcaaattctattagaaaacccgctctgacgttttgttccgaatgaattgcttttttcttcgatttgcagtgcatagcgtatcaggtcaggtctattgttttggtatgcatggtcctattcttaagtgcgtagctttcttccttggtcccaagatagagtttaggacgctgaaataggagagtctcggtctattctgttaataccgttctagattcgagcaactgtcacattattgctggaagcatttacttcaatattcgagattaacatcattgttgcgacttattgtttctttttgaatgcctgattcagtaacgaaaatctaattgcttttccatctgctctttggggaaactctgaccatttgtacatcctctataagtgcacatacactggcatttacatctcaaacacaggaccaaatcctgctgacttccatgctctcatatcaacgttccagtttcgccattgcacgagacgctccttaacatcaagagagtccacgtaatcactggaaacattgtaagtgttgaaccgctgaaaactagagctggatttcagttgcgaacgcgtggaatcgagactgttctttgggatgttatcaagtaagtcatcttcaattttgatactggattccacggcttctttctcagtcaaaaattgttcctcgatattcttggcatccgcatttttggtgtcttcctccacatcatcacctgcaatgacattagagtctaattctggagcggggtctttagagtttctcaaattttctcctgaatcactgcttaaagtcacgggatctccaaacttcttcaagcgtaattcttgaagctctaagagaagggatgcattctcttcatttaaacggctattctcgacctgaagggaatgatgcagttcttctgccgattgtaaatcagcttcgagtctctggacttttaatctcaacttgtctattgcttcactttcaaacctaggttctcttgaaactattacagagcttggtctttcatggttgctagtattctcgacttggcctattagactgccatcattgttaccagtggtttcttcaagtttggcatgaaagagggaattcttgacagcagtttgatccttactttcaaaatgtgggttgctagttactctcggtacggaatcactacccgcatgcaagtcatggtccgtaaaactggtgtcacgctcagacgaaccgtcttggtgaatatgtggtcggacttgtgcatcaaatgtaaggttatcctgtatcatttgcttcgtattcaaagttaattccgcactgtggtttgaaatagattgggaagtgaaagaagtaacagaagtgacaatatccttggcagtgggtttgttattcttgaggaaagaatactcattcttgctaatctctgggttgaatgttattagttcgtcagatatggagtggaggctttccctttcatctttgatgtccaactctgttggtttatggtcgagcagtgaggtggatagttcctgctcaataattggtgatgacaatgaaacatcactgccatccaaaagtgactcatagggtttatcaatgtgctcgcagttgaaaggatcataagtttcatgaatttcggtacttgatagagtcttttcttccattgtttttgtacttaactgctcatgtccattcttacaagccaaattgaataattcttgcccattttgggattctgaactaaacgggtcatacgtttcgtttgactttggctggaatggatcatagacttctccagtaattcttttagtggaaagatcgttattgatactatcgcactcctggttagcagtgctggtatcagcttctgcatgattttctggaaagctgtgcgttgtaatgtcatccttaatttctaagaccggaattgttgtctctgtctgatttttctgttttccgacttttttattagattcaatggcttcagcttcaagctgttcagtccctctaaagtcctcagataaactcaagttccccatcaagccgggggctcgagtggtttcatttttcttttgatccgaatgaaccgaaaactcgttcggcttagatacatcaatggccgcttcgtgccccataattctttcgatttcaaattggtcatcattttctgaaatgctattggcaaaggggtcgtaaccttgattagcagtttctaacgagaacgatgccttttgactggaataagtgtcaacaatactattagatattgttgctggaactccacctgacgcttgttggtctttagactgttcgtcaaaatcattgattactagatccattggagtttcactggatggtaattctgccaatgaaccatccccacctaccatttcaaccccggattcgttttcactcagtggttctttactgactttttcaatcttgggggcgaactcggcgctctcaactagctcagaatttaactcctcttctgcaagcgacttatcaaaagcttcttcttccactggtttggattcttgctcatctagcaattcttcatcatcatcactaaacacactttctaacatcatttctatctttttcttctctaattccttctcaatttgttcagtcttttcatatgatccatcagaatgggtgtgcgaatgtctcctcttgtacttcgacttctttttcagttcttcaaactttcgtttggcagcttcaagtttctccaatctagaactatcaaaactcatttccggaaaaacgtttcaggagtttggaattggatgccaatagtctgtgcgaatgctttatcgctgtcactaaagtctgtctttcttccagcggcgtctcccacgaaaaacgagctagagaggtcaatattttttgcatcttttgggctcgaacaaggaacttggacacgctccaggaaataattccacatcccaatttcaggttttcgatatttgggtggttcttccaagttgacttttggagcggctatcatgaatatgcgatcttgaaagttactatccaattcttccaattgcctccgaatttcgttccatttagtaacgaattgtaagaatctcttactagtagatttcacaggaaatcctccttggttactgaagactacgattaggtaatcttgagatgcaagctcttgaagttttctaatggtattggtatcgaaccatttccagtccctttcgtgttttggaaatgtgctgcctgatttagtgagtatcaaggtgccatccaaatcaaatccagctactttaaaactttcctgatcattttgaatctttggtggcatatcactaatgcaatccaaactaatgtcccatcctttcaattcttcaactaaagttgcccctgccttacccaatatcgaagctggagttttagtttttgaactgagtgcggagtgtcttttcatgcaaacatttttacccattagtgacagaatatccttagacattgcaatgcagaaccgagagagaggaaaaaaaaggaaacagcttctgaaaacgaaaagcgccgaactactagtcatttactctacaaccttagtttcatacaccctctttaatgaaagaaattcgtaatccttatcatccctaataatctatctacagtaaagaaaaaaaataagttcttatctagcacgacaaagaacttcccctccaacgtatctatcagcagcttcctgcaactcgataagctccttactacgaggaagtttcacaaacataacttctccaggttgtaatggatcgatgatacgcaccttcagcccactagctagagccttgatttcctgcttggtaagtactagtcttctgttgggtttggacactaaagatagcttagaaagaactggtttgctgtttttatattttaggttcagccaaagtcttctggtagcaatgttgtccggagttacttcggtaggaaccaagtcaggtccagcaattgaacccttttgaatacccttgataaatccatgtttatataaaccagtggctacttggaggtgtaatcgggtgaagggaacagcagccatgttgaaatgcacccgcgtacagttctgaagatgtgcacagacgtttgccagttgtaccaatgacatttcaatgtaattagttgattttggctgatcctacctactgcactcgatgtcgaggggaaactttttggagttgggaattagcatgggttacccggtcaaggagaaagtaggaaattgggctgaaagagaattaaaacactgaaatagacgatggtataagggatgaaaacagtctcatttaactagtttccctgtgtatataacaattttgtaagcaataaattatttcatttccaggaaagagtgtgagctagagatttcatctgacaaattcgatggaccaagatgctgttggatgtaatcagttttgtcgttccagttttccaaaagctggagagaactcttaatctgtccggtacatcaataacaccatgttcagacaaacccttaggttgggaactagaatgaggcatagtcccaaattcttgggcacttcccagatggtggaacagtttccttccattgctgcgagaaagtattctaaccatccatcgtcatcgttcaataacgatggtggccccaaagtcaggcatttcctttttgtaggacttgtaggtactatgcttttcgttttggtcgtcaataaaatcaacgagcaagatcctaagacttcattggccaagaaaaagaatacctattcagagcaagaatgggaaagttatgtcgccggtcttaaacgtaagaagcaaaggtttgattcttcatcgaacaaagaattttatgccgttccatttgctaataaaaaccccaaacagattgaaaacctgaagcgtaaagtctctaagtcctcttcccaggaagatgttggtgtggttgatataaatgaactcattgccaaacaaatgaacaattcagaatcagcctacggtcttttattgaagacaactcttgtggagaatgacccaagttcccaatcctgtacatattctttcaattggaatttggctaaaggtatcttctccaagcttgtttgtgatgagttgactagaatgatcaatgaatctcctcaattggaccgatttctgttgttgaattttccaaataacttgccagaggcaattaaattcgaacaagatgttgctaacatcactgagttaatcgtcttcaatgaagagcaaaaagaggacgttgttgtcaagtattttgacactgttgataaggtctcaatcagcaaataatgatgtgcctggtgctgtataacaatttaagacattctaggtttgttttgtgcttttgaagccaaaaacatgttctacttcttgggcctttttctgccttttgatacgacgcctttctttttttctcttggtctcctcttcttccaaggcctttctcttagcaatcatttctctaacattcaattgaacatcttcagattcaaacatattctcactccttttgatattgagctgttctattctctgctttatcatttccaaggtgatttcttttgaagaattattattggtaccaaagccagccttgaccaggtgaggtttactgttcagatgatcaatgaactggagattatccttgtaagtaaggttacagtattcacagtagaatccggcatttttcccccgtttactgactgttgcttgatccgcggatattagacttattctgttcaaagtatctgcctttagtaggatttcctttctttcttttatgtaatcatcaatgtcacgatccttaggaggatttaattttgcttccttcagcttcctcttcctgtctagtgctgctttagcatattcctctttattccaagatctccgaccatattggttcagcgttggttctgccatttgttatgtagcgggaatgagtcttgaggaggtctgatgtcaagataaagagatagctcgcgatctccgagatgagcttctgtgcttatgtaaattataaactcgttaaattaatagactgggaaagttcacagacctcaagatgctcagaacggttagagaaagacactgtataaaatataccatcgaactaagtgcagcttcaatagtaatagtagtattcccattgcggaatatatgaataaactacatctctacaactccatgtcatctattagttatacatctattcgtcttggacaatggttcctttctcggagacgtagataccgtccaagaatttacgaatatccttgtttctaacacggcaaatctgttggacatcggcacaagtttgggagacgttctcaatggagttaccctcaaagattagctcatccttcaaagcagaagagttggatgcagtgacaccctcgtaaactttgacctctctgactctcttctcacccaagaagtttctgatctcaacgtactgattaccgtctctctcgaggaagttgacattaattgggaaatgcgcataaaccaatctcatcttgtacttgtaacccttggtgacaccagtgatcatgttagaaattaatgacttgacagttctcaaagcagcaacgtgctttctgttaccgtgatgcacaatgatcttaatctcgttgtcgccagatttctcaaaagcaacgtttatgtgcttcagatccttggtcagttcacctcttggtccagtcaccttgataattctggccttaatagacacagacacatcttctgggactgtaaggacttgctcagataaaacgtatttcatctcgtattgattggtactgtttctaaatttttcacactctaacgggcctgaagcgatagaaagcgaatttttcagttgaatacacgactttgttaatagtgtgtaaaaacaggaaatcgcagtcacagtgtagttttcttttccttgccactactagcgaagttgctgcgaaacgaaagtcccctgatggaaacgtacatatgtacaacaaagtttgagatcttgaagaagcttacctgtcttggcaaaggagtacacctttattattatcactgtaattcccgaagactactcgcagggatgtctatccagatcaatcaactgtactccaagaatcactaagaattgtatgtagttgaatgtcagcaattggggtcctgttgacgagtactgcccaagactctactgcctttaacgcgcatgtcgggagggtacccaaatgtaaagattacctgtgctccatcttttatatgcgcaattgggagggggggtaaaatcgaacgaggcatgtttacaccctttggtgtttgtttggccaacatttttttgcaatacctctggttcaactttgaaaagtttctatgcaatcctagagacattccctagacggagtatgggaagtaaagaccacattggttgacagaaacccaaatttcaatgcttcccatttttcgtttagctttcctgtttgtaaagacccgtgtggacttgtagctcaggaaattattaccatgaggtgactactctaacctgtaaagagcttggcataaatagcgtatgcacacctgcagtaagttgtacatagaagattctcaaagcaatagctctttgtaaatgcacgttctgcaggaactaccttccataaacaatcaacaggggtaacggtagtcaacagcacaaagcatgaacaagaactactagaatatgttctagtgatatgcacacgactcacatggttcacaagacttagctgaaaagactgaaacagacgcgtaagcattttcatcacttaaacaacctacaatcacgcctttaccctatctttttactcttactataaccaatataaacaaaagtttaaacccaaaaagaatgaaaacgacccttcaacaaaagccactcagtcttccaatattttactctcgaggaacggatccaaaacactaacattttgcatcgcagagatcagtcgcagctaataataataattgcgcgccacatacctcgcgtaaaatcaatggaagtatagatggtaacctattcctggaagaatacaaagtcatttaaatcaaatgcattagcggtaaatggtgctgcagaccacgaaacttaagtttgctgttatctttttcgtttgttcttttgttgcaaattgattcatcttaaattaactacgcgtctcgaacaagggcgattgtttcatctcaattcaagagttaaagtagagtagtaggtacgccgaaaacggttgacttggcataccagttaacaagagcaatcacctgatcgctatgcatgtcaactgatatgtgccaactgaactgcgcctccctgctacagaactttccccccccccaatcaaagagaaaaagccgatggagcctgctgtaatgtgtaaagatgaatccgtcatcactgctggatgatgcaaccgattcgactcgctaatgtcataagaattaaaaaaatcattgatggaacctgatggagctgtagtaatgtagtcggtgtcattttcgtgttttatttgtaaagtatttgaactcaacaagaagttctcatcggactctatttttaagttacctgggttaataaaatcaactgaatcctccggaagactcaaaggagtagaaacataattgtctactggttgttgttgttgctgttgcaactttaaatgtgtgagagttgacttttcttcatctacgtctgaaaaatcggatgacaaaggagatggaagttcattcaacttctcctgcttgatagatgtgctcttgtttttgtcgtttaagactttcattttcctgggtaactcttcgtcctcttcttcgtcgtcatattcagcgacgtcatcttcgtccagatcctcagtcaaagatctgcgagtggatgtagatgctttctccgatttcgaagaagttgagagatcagacatgggttccaaatcagaagatttgggaaaatcgacttccggaactgttaaatccaaatctgagacggtaccacctaaggcttccaaccttgaaacaatgatatcttgtatttctttcaacttgttagtggctttggctgattcttgaagtgcagattccaggtcgacgacgtggttttccagaaattcaacgtgtcttcgtttcttctctctggaagcatgggccgctctcctattacgtaggatacgttccactcgacgctgctccttttcttcttccgtctttgctcttttacgaggtggaagtgggctagctgtcttatgagaagaatctacgggcattttctgcgatctgattcgactaaggaaaatctgtactatttttataatattgacaaaagaagatcggtggcgatctaattgtatttataaatcgtttccgaatcgacaagggatgagtcgggtaacatgctcgttctctattgcgctgcggatagtgtgagaatgacatagagactactcttcgcgttccgaaaaggaagtaccgtttgagttatgcagactattattattaggagattaactgagatgaaatataaaatctttatcaaaatttttcataatgtaagagtcagtacatttaatagcggttaaatacgaagttcaagtaccaatttgctacgaggtttgattgaaagtttgcgctcgcatactggggcacggaagaactgtctagaccagatgtaatttgctcaagactggaaaagaaccacaaagccgcagcgggcgtaacgggaaggggttccccaaagaaattatattacctaataatttctaatcggtgaaatttggcaaagaatactaaagaacccagtttcatagataagtattcgcggtgaatagcgcgttatgagtggaatttccatgcatgctgagaatatcaagttactgtgtggtatggtttggggctaatgccttggtgcaatcaaatggtccatttgaatacactttgataagaaagctcgttttatgcctgaggattgtaagtctgctatgatatcctctgtgtaatagtacaccgcaactgggaaatcgtaaaagagatttttgggaactcatatctatcacattcaagacattctaagttttgtcaattcaagatggctatgtatgtcaggctacaggttgtcgattgcattgttcccgtacacttgatgtgctcccatctaaaataatagaggatatagttaaccactgttgactcaagtttggtcaaacaacttgctcagcagataagcttcattatttgcaatagaaaatcaactttagtcacttacaataaggggaatattcgaaggttccgtttctgtattatagctgctacctgagttagaacggtctttaggctagttgcaatatatccaacagaatgggatctggacgacgttttcgaaggttaagatcattcgtctttctctcgtagaaattttgtcaatacattactcccatatgagtgccggaattcttcataaactcaattaatcctttgacgagagatatgtcttagctttacataatggggattactttttgatacataatacaaggagcattgaaagaaaaaaaaaaaacttaaaacattgacccttgagttgttactcggtccctttttacagccagcgaccaaaatatgctatctgacatcccggtcaccggttaaatagcattaggctgtgagtctggctggcccgggcgaacatgaacatattggctgcaatcagtcactatttgattcaacattactcttgtttcagatacttaatggccaaaggactgcggttttgataaatctgacatgagcccaagctcatctttcagaatggtattgaatgaaattttcctggtaagttaaaacatggatatatgcgtttctaggagttgagatagttctacgaaaccgttattcagtgtctgcaaatatgtccaggcaacctatcgtggacaaagacgatggatgtcggctctatgatgaaatcagcggtcgccctctttttggatactgacgttcttgatgtcatgcatttttgagtgagacacatagcttgggtgtcacacaataataaaaacgcagggctgtgtacagctgcgtctataatccacacatttgactagtagcagcatggcagctaacactgttgataataaccatgatgtacgcaaatgcatttcattcagtcttcgaaggggcaaggcaaaggaggtagataatgagggcctcgagtgaagtgtttttaaatttgtaaaattggaaaacctttcttcctgagaaaccttactgttcagcttacgctagaaatattttgcctatatgtatttccgccacgccaagaattgaattacttcgtctgtatctgttttctctccaagactataaataaacaaactcgtccaacttgatcaagtgccttaccgaatgtttgtgatccagctggcattcctatgtctaggcgtcagcctaaccactgcacaacctagttcacctttcaaggcaaataagtttccttttaaaaaggttcactactcatcaaaccctagcgatcgccttattaagcgagacaactataagaagcttgacttgagacatcttggcgtcttgtatactgcggaaattgaaattggttcaggcaaaactgaaatcgaagttattgttgacaccggatctgcagatttgtgggtaattgactcaaatgcagccgtatgcgattgtcctatcttgagatacaaggtacaagtgtttccacccttagtcaaactgccaacgtaacacccctatcaggtaaacttttgaatggacttcaagaaattggcattgtaactgatggcaaaatttccaaaaagtttcaggaaaaccatcttttgaagagaaacgaggccttgaattttgatgtcgatctgaataagcccatttgtgatcaatttggatccttcaatccacagtcatcaagaacttttcaaagcaacgacacagcatttagtatcagatatctggacaactcttttgccaatggatcgtgggtgagggatacggtttatgttggtgattttgaaattgaccagcaaagttttgcattggttgatatcacaaataactacatgggaattctgggccttggtccttctagtcagcagacaaccaatagtgatcctacagataacagtttcacttatcttggtattctggattctttgcgggcccaaggattcattaattcagcctcgtactcggtttatctggccccagatggtaagactgatgatactgatcacgatgatggtgagatcctgtttggtgctatcgacgaggctaaaattaatggacagttgaagttgtttccatatgtcaatccttataaatcggtataccctgaccaatacgcttcatacatcaccgtttccagtattactgtagccagttattttagtagccgcttggttgaaagaatccctcaattagctcttttagacactggtgccacattttcttacttgccaacttatacgctgatacgtctcgcctatgccatccatcctggttttgagtatgtccgacaactgggtttatttattatagagtcaaacgtactctccagtgcgagacaaagtaccattgacttccggtttggcaaagacgtagtaattcgatccaatgtttcagaccatctactcgacgtatcacaatacttcacatctggacattatcttgcacttaccatccatgaaagtgtcgatgggcttctcattttgggtgacacgtttatcaagtccacctacttatttttcgacaatgataacagtgaattgggtattggtcagatcaaaattaccaatgacgaggatattcaagaagttggtgaattcaccttagaacgcgattcagactattcttctacatggtccatttactcttatgaaacttctttggatcccttaagcactggcactggtacggggtcaacctattctcctactcgcagtactacagctagaagcgaaccgactacgtctcgacgctccaccacccttcaacccagaacaactgtgattccttctattgacaggctttcattgaacagcataactagtcatggttcctctactaacggaacctccccaactaatgagacttcttttgctgaggatggaggaactttgacacccgaagaagcttctttgacaacttcactaaattctgctactatttctgagactacttttgtcgatgttgaaacttctactaccaatggtgcttcagttgtatctttgagtgttggtccctgcattattgccttcctactactcatctcttaaaatacgcgtttatgactttcaattgacttgcaactattagatttcatgcgtaattcaagttttcgaagcccacagagatctttattaccgtgttcaaatgatacaagtaattggttccaagacggtaccagttagttggattcttactccgggtcactaagacatcggatactcaagaatagtcttgagctacttagagctcagttgtaccgttttctgatgttcatagaaaaacagattcacacttatgttgcttttatgaccctttgcttttccctatacggctggacaaagtaactgcttttttgcgattgctttatgatctatttttatggatgattgccaatgattgaagaacctagaacttgtttttgaaaaaagattacaaattttcatgacaaggatggttttttgaagcacataactgactacgcccttttgatcacgattatttctggaatacaaggagctgagctgagagcataatagcaactgaattcattaaaattaaatagatttctcgttagacataaaaacctgcttgattataatcaggagacctagctgatgacggcattagcagccattttgtttttggaacaggaatataactgttacgttggtttttggtcattccgacatatccagcatagaaagcgcacatagcagcaagaaaacaaaatacaccactagcagtttcacatccagtatgatttccaaagatggcaatatcatacaaaaggaaaaacatagctgtgaagaacgtaagtaagaacaacggcaaggtcgatttaaaagtagccgtccaaaggacaatggcaaagacagtccaggctgcaacgtatagacccaacgcgttagtcaattcatccgcatcggtataggcatctactcccatcccgttctgaattgcaccaaatgaggcaaagaaaccaccataacatagcagcagtactgaaccaaagacgttctcaaggacaatactccagataccacaaatgatttggattaaacctgaagaaaacaaaaaggaacctgttaaaactgctggacttgatacatttctggttccggcaagaataagacccaaagtgaacagagaagtacccagtgaaaacacgcctgctgggactggatttgcaaacttacgagaaggtctgacttggtagccgcttatcaagcccccagtgaaaggggccaagtaatcttgttgagttgtaacaaactcacccttatgtatttcgtcgtgggggttatgggctgtttctgctgatgactcgatatcttgatgagtagacattaaaagttatattttcttaagaatggagtgtaattcggatgaattgagctttcttatatacatttctgatcgttattaatgtgctcatgagtgtgaaggtcgatcaactaaaaaaccacgcagaaaactggtgattatggtccagttgagaagcttcagtggatcggaaattagacggaaaaggattgaagacgtattctgaacatggaggaacgggagtaaatagaaaatcattaagcttaacctttttaggctatcaagtccgttgctctagaaaatcaggagataaattatagggtggagacaataaatgctaatgtaaatcaacgcttaaatcacgcaacatcctattcatctagtacggaacctttgatgtagcacatgttcttgattgacaactgcaagggtcaaagggagtcaattaaaatgctcgggatttctgggtaaaatacgtggaagtagcatgactattggggatatatattttttactttgacacaccaagaatagcccctgcatgacacatatggtacccacatgaacatctactgggaaaagtgaacattttatttttagctaagatggacctccacacaacaaaatcgcgagttctgtatggaaatttctcttacttaagcaaaaagccttggattctatatcttcaattgacaagacgatgtttcccaattcatcactctttcggaagatcgcctgtccagcaaaagaaaaatgtagtactatgaattgcatgtttaatcattcttctgagaaggttatgaagcagccatccgctgcttcaaaagttgatcaacaacagcaaccagaagattcaactgaaggagatagagagaatccagaacaactgtccggaacagtaaaaacacttagcaaattctcgtcggaccccattaaaactgattcgtctgatttcttgaacaaagtatttcagaataataaagaaaatggtgaagttaaacaagtgcacaagatttcgttgttcccttcttcggcacctcgatcagatgaaaagaccgactctgagggctcatttctgtccagagcgacggtgatcaaaagacctgcggaagactctttcgaagatgagacttcaaagaaacagaaaccttccactccaaccagacttctcccaaagagtgtcctgaatcctcccactactgttcaagaaagaatgaggtatctcaaaaatgctcatgaatcgttgaaaagtaaactacgcaacaaggatgaccaatattgcgtgaatctagctgtcaaacttgaattggaagctgccaaatcaacaaccagtaagaatgtatatgaaagagccctgaagatcgcaatttacaaaattagaagtgaggattctccgcaaggtaccccttcttcgtctgaatcttcgcaaccagtctccaaaattgatgatccagattgggtgattcccaagttgagtaaattaatggcacccaagaacaagcttaaacggaactcattcattcttcagataccaccgccttatgatggtcacttatcgaagaaagtaatgcaatgttcgcattgtggtgatgatttcattcttggtgagcaaatgctgcatgacgacaaatgtgtttatcatccagaaaggccgaaactgacaaaacaagtcgccttaacaaatagcaggtataataacagttataacactcggacatacccatgttgcaatacaactatagatgatgctactgctggatgtgctaccctcaaacatcacgtgtataaactggaagatcctattgaaatgcatcacaagataccattcatcttcactgcagatcggaatgttgattatttggctgtaggattggattgtgaaatgggatggacttcattcggatttgaacttattagagttactgttgttgatttcttcacggaagagaaaatcttggatacgattgttcaacccctgggtaaaatgattgatttgaataccaagttcagtggagtttctgagatcacagattcaaattccgttagtttcaaaaaaatgagagatctcttattcaatgtaatcaataggcaaactattattattgggcatggattagaaaatgatatgaatgtcttacgactgattcacaccaaaatcattgatacttcaatattgtattcgactcactatgaccccaagaggaaagaccctctaaggttgttggtatccaactttcttaaccgaaaaattcaatccggagaacatgacagtatggaagatgcactagcctgtattcacatcataaagcataaaattctagaaagatacacataaactcaatagctaatttaggcaatcctttatatttttttgatatcgaagtaccaactcctgattatcaaggatcctggacatcatttttgcattatccgtaagtagtttattaatctccttaagagcctgttcagccttagtgtcttcaagcttggactttgatcgtgattgcaaagagactgcactttcttgactttgtagcggcttgtttgtaagagtacttttactgttaatttcatgcgtcaggttaggttcatccttattttttgtaatcgtgctgaaatccagcaatccgaatgtagtatcgtcggtaccattcttggctgcggctctattttcagaagatctgcatcccaaaggagttttcttgatggccgctacttcctctcttaaccgttttggtgtgaaggcctctcccaaagaaggtgctctctttcttagtggagagagtcgttcagcttcaccaagcgtcccaacgactggtttattttctttcgaaaatgaatttgagcccagtgaggatgtacttctccgtcgtttaccattaccttgtgtcaataaagtggaatcgttttcatcggggtagatccctatacttggttcccgtctactcatctgccgaactacgataagtttgtttattgttttcatgtcaacataaggtggtgttgaggtgtcttaactgtggggagactactgggtgggttctacgataaagtataaacgggatggagataagaacctttacttgaggtaaagtaaaacgatccatttagtcttatatataaatgtatgcaaagtcggccgaacactaaaaatttctaattttgttcacaagagatcgttccttcgatcatggaacccatattgaaattggcagatgcagacgagattttgatatttgatgaggaaacatgcaaatagtagtccattgctgtcaggacacacttgtctaaataagcatctatttacatcatttcacttgtggcacgacggagtcgcatatgataggtgcgctttctataaagacgggctcgggtactagagagaatactcatgactcaacgctgcttagcaatgcaataaatcacgagatcttggttgaaagaatgggttaatggaatagatgaaatagtcaccgttaatgaaattgttttaagtttgaaattttctgtctttttgtaatctttttgttatttggctttaaagtaatacccattgaaaacattgaacaatattcacttaagaatatagctaagatgaatctgataattttggcatatggccaaaagttaaatcggactttttcagaggccaaataattggtatcaatgaaaaaacaggtttgcactttcccatggtattttgatgatgatggtgtgtggagtgtctgccacctagacatttttaattaaactaatccactcaaactcaaccgctccaggaatggaggcaaatcctccttccgaagctcaattagtgaactctcaaaactatcgactttggcctttgcacctatttgctcagcaacttcttgaaaagccaatgaaaaagtattcaataatgcgatattcttcaaagtcgatccgtcgtcttcaggaggaaatttcgggggcaatccacaaaccaagtacgtctgagaatctggatcaaaacacgctataactaaaggaagtattgtggaatccatctccgaatagcagtccaacaaccaattccctagtttcatcacgatcaatggatttcgaaataacctattgtaattagtaagaagatccatcgttagctcattatcatccaatgaagtctggaaacgcttcatctcattagaatggatactgctactccaagagacagaggcttccttcaaaaccactaacctgaacactttcaaattagtaaccatcctcttctccaaaatttcaaatcctttatcaaaaacaaaccgctgttgccattttgcaatctctaaaccttttttaacaaatgtaaagtctgtaagagcatcgtagcagtgccagaaatttgatataaattgagcttcccgttgggatattatttccgaaagttcagcttcttgtgtctttggagcagtttcatccttgtatgtattctttgtttcatcgttactcttttcagttcttgttctagatggtttcttcacccttccttttagatctccattaaaatccaggagagcagtaatagaatcgacgtactccacagcactaacagcacctttaaacccaaagtttcttatgaaaccctcttcaataagtccatccaattgaaaatcatgtaaatatctggtcaaaatagcaggtaatcgcttcttcatcttgatatctaaataatgccaattctgagatgcggcatgcagggaaatacccattttagcaaacattttattgattcttttcttcccgtcattagtatacagtttgagttttgagttgacaaaattggagtaaaagaatgagttgtaaagattccaatgccgtaataaaaacagcttgtaatccttttctataatcaaagtgttagtatccagacttttattgctaagtacgtggccaccattttccactacagcgtcactatgttcattgatggagctgttgattgagctttccagtctcaccacttcgtctttcagcgatggaacgatcttctggtacacgttagaatataagggcatcaaagatgtagtgccaagtatggccagccacaaatcatcgattttggtttcaccaacggaagaaatcaatgtgtatgcttgtaaagcgaccgaagtcgcaatagtagagccttggttgtaataattgtcgatggtttcttcactcttacggagtaggcgttttcgtttttgagaaggagggggcgatagtgaacgatgtcttttccttgatcccaattccccatcatcttctgcgtcctcatcttcgtcggtatctcctctttgatcattttgttcatcattatcggtctccatctcagcttcgttttcattatgaggcatttcattctccaattccagtagttggttataggcttcacgttcttcaactagctctctctctagttgtccatcatcaaaacatattacgttatcactggagaacaaattatctaagttccaaggcctgtgaccatctattatgtacactttcttattagatgcctgtggactattgaggtccaaaaacgtcaccatatcaaccattgcgccacatcccaggatgataacgtttactacatcaaaatcaagctgctcaaacttctttttcagatccgtgtacccgattactggtaccagctgaaaactaattaggtgtttcctaaacattgtagtgagcatttttgatgaacaaatagcgtcaacatccaacgaagaggcaaatattaccagtcgacaggttgtatgagatagagacgacttgcttatactcctgaaggccttgtggaactctatggggttcaaatacatctgtagaacccgaaagtggctgatatttggtgtaagtgggttagtataaaatatagacgcgttcgcgtttttctggtaccaatagttatctctcagcgattaatcatgacagctcaatgaaggtgttgaactactaaaacaaatgtaatcgtagaactgcattagacaaagaaactgctaacaatacatcattattttatctaaatacttagtacctttcctcaagatattgtttcaccaacctcttcaattctctgtcaatagtcttcaacatggacttttctgtggagttgttcgaaatatcagccacattgtcaacttggatgttggacaatcttctttgagcaaagtatagtttaatctgcgcaagtatttccaaagtacggagattaccgtttacgccgttcgttttcatctcttgaagaagagctaaaattgggtccaagtcctgtgttttcagccatgtttgcttcaaaataacgttgtagaaatcattagtgcaggtaaccatgtacaggcttatatcccaagcctttattttctcaaagatgttaatggcgtaatcataagaattgaaatctacaatcaatgatatcacgcagtgtaatattaatgcctgaatgactgttggggttaaaagaggtaattccggggtttttgaggactgaatggctacctcttcaaggctgaatgacttttgtgagtttggtttgttggatttggactgtttcaaatacttttctgtcatctttaatgcaaatctgtatacgtcaacatctgtgttcaatgagttgatatgtctcaaagttggctccagtttttcgaataattcctttctgattttttcttgttctttgaaaaactcaacacttttcgatgcattaccttgtgtgtctacagatttctggaaatagttggaagttagggacaatgggaagtctctaatatctttatcagttaaactgaccttattatcaccgtttgaggtttcattttcttgaaataatgcatgtagagattttggcttaacagttttacggcctcttctcagtattttcgtgctgttcaaaggttgtgtcttgttcttctgatgtaatgattcaaaaatttgactgaagacatttctttcctgtagagaagggcctgaggtttggttcaattgctggactttggctgtcttcaagtgcatctctaaaatattgtcaactagcccatcgatctccgtatcctttttgggcttttccgaggaaacttccttaagcttttcgccaatagtgggttctttactgtctttcgtggaagagtagctaacccaatcatccaaaatggatctaattttatttctgacactaaaagcaccactcaaatgtctggcctgtatcttcatccggcctctgctccaatattttggacgtgagagactggaagagtgttgttagttttcaccacgatttttttttgttaagggcgcccctactaacagctgtcgagggaggggtcctgaggtgaattttaatccgctccagaatccagaatgtattatatttacatgtactatgtacattaatcatgagactttccactgatctttggatacaatcgtccagcatgataatttatagacgacctggtagcttgggctccgcccttattagtatccatacatgctttcagagacagctctagctctttgcaagcttgacttccctctccattagatgcccaacagttcaataatgttgacatgacaaccatacaggggttggactttgtttgaagcaatggctttctaacctttaacctcggcaaaggaggtaatctgactggcttctgcggcatcttggtcaactcagggtgtgtaattcaagaagattggattaaaatggattgaaagatttcttcttgttcgcgacttgaagagcttactcccttccacgctagacggagccatcatccactacagctaaaagtttccctataggatttcccttcaagctttatcgcggattaaacatcggttcgaagtagttacttcctttcaacgaacacatcattgacatggatgtctttgaacaaggactctccacacaacaaaatggaacccaggaatcaaatattgatgtgatcagcctggactcatcactatcttcggaacaagaagctgaagtggaaaataacaatgcatcttcgactagcacttcctcctccaagatctctaggagtaacgatatcttatctgagtccctaaacataatagaatatgaaattccaagccatgaacctatgacctataaagatgcaatacattacaatcccaccaaagaagattgctacaagacaagactttgtctgaaagctataggtatttccaagttcatcgacctctcgttatcagaaacaccaggggcaagtgattttgtttatcttattaagttactcgggttcgcacccaaagaatatcctgaggatgaaaactctaccgaaacggtatacacattggtcaagtatcttcagagagcaatgcatagagtaattaccacgaggacaaagaagctggattttcacactatagatcacctaatagaagctataaaaacttctaaaaacatcttggtactcaccggagcaggtataagcacctcattaggtattccagactttagatcatctgaaggattttataccaagctgcaggaacaaggattggatgatcctcaaacagtgtttgatcttgaatacttcaaacaggatccctccttgttctatagtattgctcacctagttctgcctccggaaggttcttttactcctctccatggattcatcaagttgcttgccgataaaggtagcctcttaagaaactatacccaaaatattgacaacctagaggctaatgcaggaattccgtcggagaaagtcatacaatgtcatggctcatttgctacagcttcttgtattacatgtaaatacaaaattcctggagaaaccatttttgaagagataagaaattcggaattacctttatgtcctttttgtataaaacggagacaaaaattgattaaggagattgaagcattggatgactcggagcaaggaatttccaggcattcgttttcatttcttggttccaccgtgaaaagatcgtatgctgaaagctacggagttatgaaacctgatattacattttttggtgaagatttgcctagagtttttcatgataatattattcaagatgtcaaaaactgtgatttattattatgtattggaacatcgcttaaagtcgccccggtaagtgaaattgtgaacaaagtcaagcctgaaattccacaagttcttatcaataaagatcctgtgacccatacggagtttgacatctctctcttaggttattgtgatgagcttatagtttatctttgtgaggcaatgggatggaaaattgaccatccaaaagtagatgaacttctcgactcaattgaagggctgatggaactggaaggggaatctgggagataccagctggttttaaaggaggaagaaagccaagaagttactcagttgcaagctacgccaattggatcatcccatagacaatttcaagaagcatccctaatggggctgtaaaataaaggcgcttgttttatagacagatctttctggttgatctagactgatagcggaattcaaacttgtatgtagccccatcttctaaaaggaatgagcgaagaccaaaattggtgcgacccgcgaggcactttccaccatcattttgttcgacgatctaaacgatcagtatagattcaaccttaaccttatacgttctctccgttcgatcacacatagtacacgacgcagggtaatgtccagtattcgaagcagattgaaggctagagaagacgactcttttcaagaggctctccaatttttaaacaacaaacagtacaagaaagctttgaaaaatgtagatggcatcttaaagaagaatcctggtcacacagaaagtgtagccttaaaggcgttactgttataccatttgaaagaaaaatctgaggcgaaggtctacgctaagcaggctgctgttcaaggtgattcgaaaccggtaaccaaccacattttgggaatttactacaggagtgttcaggattaccaagaggcggctatttggtttcaaaaagctgtagataacaaaattgctaacttcaatgtttacaaggacttgtcttgtctacaagcccaaaatcacagatatgtcggtatggtgaaatcgagactgatgaccttagaaaaagaagccgggtatagatgtaattggacaggtttggccattgctcatcatttgaataaagattacaatgcagcagttaaaactctgaccaagtttgaggaacttgcgaaagacagtttgagcgaaggggatctactggagcattcccaattgttactctacaaggctatcatcctgaatgaggctggtgaattccaggcatctttgaatgcattgaatcaagatgaaaaaagcatttttgacaaactaaagtttgatgaattaaaggcaaagaatctgatccaattaggtgacttgaaagctgcttcaatgatttatcgtaaacttttaaaaaggaacccagacaataattcgtactactacttgttagaaatatgtttaggcaccaatgttgcttctgctgatgtcagaaagcgattatatcaaagattggcaggtttttatccaaagtctgatccaccaaagtttatccctcttacgttcctcgagggtgacaaatttgtcgaagctgcttctgactatgttctggaacagttaagaaggggaattccttcagcctttgttaatgtcaaaccattgtacaaagatgtaaacaaagccaaagctttagggtccattgttacagaatttttcaataagaatcacaccagcccaaccacctatgtttggtccggatactacctggctcaacactacttggaacttggtcaattgaatgaagctttgaaatttgccaacttagtaattgaacacactccaactcttgtggagccttacattgttaaggctcgtgttttcaaacacaaaggtgagcctttagatgcagctaagttcatggatgaagccagaaagcttgatttgcaagataagttcatcaactcaaaaaccactaaatattacttgagagccaacttaataaatgaagcaactcaaactatcaagctattccacagaattgatgatagtgttgatgtcattgaaggtctacacaatactgaatgtgtgtggttcatcacggaggaagctgaggcattttacagaattttcaaagagaaaatggctctgctcaaggatggagattttgacgctgacctacagcaagaaattttggagaatcaagggcttgcttacaagagattccaggccattgatacgatctttggagtctttatagacgaacagtttgatttccatagttattgtcccaggaaggggactccagcaagctatattgaaatgattagatgggctgataatctttatcatcaaccaatgtacaccagagcttctgttggtatttgcaagatcttgtttaacattcataagaaacctgaagatttaaaccccaaaggattgagtaggcaggaaaagaaacgccgtgacgcattaagcatctctcaaaaatcgtatcgtgaagacgacgatgtgttcggagaaagggcagttgaagagttgactatggatgatttgaacacaatatacaacagactgaataaacaatatattcaagtcaacgaacttgggttcgaattatattgccgtcaatataaggtcatatttgctgcacaagccctaatcaacctttccaaattgaccaataacaaacacagggaaattggtcatttccttatcaaactaaattttgacgttttatccagtgataaagtccctgattcgttgaagaaggtggtcaaaataacattgttgaaaaattttcctgaaacaaaagatttactagatgacagaagccaaatggaagcgtatgctaaccaaaaattcctgagtagtctaactctgtgatcggtaagtatatatacatagaatacatctgctcatgagttcatccaactttccacctgacttcttgcaatgccacttgtgaatctcagaccatgtttgccacctgggaagtaactaatgaaataccatatcatggcaatgaactggactatacaactgaggattactagtatagtgctttttaagacaacagcgaatactaaagtcgctgtgatacttgcaaaataccccatagtaaagggaagtctttcagcagatgtcagatgaataaaatagtttttggccccttgaagcaccccaaaggatgcaaggaagaaaacggaacccattgtccataataaagcaaacttggtgggttttattgtgaggacgggaaataataagacacaaatgatgaaacaaactgcgcttccagcaattaaaacggcgaatattagcattctgtcccaccttgaaagttcaaacatgccagggtcgctagtagccacgtcttcattgtctaaagtaatatcgccatcagtggagaaaggattgaatttctgaaatgttgatttgaaggttgagctagatgagggtgaaaattgttcagatctctgtggaattgtagtgggaagaatcgaatagtcattccccaggttgacgcctggaattttattaagggtactcttgaacatttctagagaactgagtttagctggcagtgttttgatgggagatacaggaactgactgaggcgcgagattaatactgatggttaaatcaggcatcgggacaacacctcactttaaggacataagagtcttctacaaatttgtatctatctaaaggaaactaaggagctcatctcgctggcattctattatgtcaggactcctgcccatactaaaactatatattgtagaaatacaaattgaaaaagaaggaaaaaaagtgaaaaggtggagtagtgtggttgtagtgttgcagcgcccgagaagaatgtccatgaatgtatccctcaatctgctagtggtccaacaccaatgctacccaggcccttttcggcagaggtattttttaaatcttctctgcgttcttccggtacattatgagcaatctctaagtttttgagtttcaaggacaaagcgacctcttgacggtttctatcgtcaatatcctgttgaagacaatgaatatactctactgcttttgttaaaatttgccccttattaggctttccatctttggtacctgtagcttttgctttatccttggggtctaggaaaaaagactccggaataacagtgagtaggtcctgtatacgttcattgatattgtctctgcgcttgcgctcaacaatagtcccacctggagttgtcaccactgagctcctccgggacttcgctgtatttatatttgattcggattgattgttggaatcctcattgctgttgtactcggcctgttgtggagattcggacttgacattatgcgaggcgggtaaagcctttgaaagagactgcttaacatcaatgcttgaaggatagaagttaggagagggagtattttgtgacgcctggtctatattgtatgtcagcaactggtcctgttgcagtggggggtctgtgtgttgtacatgtttactggtacttcttccaaattcagtatcagtgtcgagtatattatccaagctggaaaagtccaagatttcattttcttggaacggacgctccgccttgggccattgattactatccatgaaggtagtctttcgtagatggagtcaacaggagtagtgaagaggagattcaaaggaagtaatagtgttcacagggatgttggggaaacttgctaggtaattatcgcgaagggtaactgattctagtggagaggaattttttttttgccaaggtgcaacacgagaagctctcattcgcggagaattctcctagtcctaactgcaggcgaaaaggaggtgcgatgttcgagaaacaaagaggttagtgcgataattgaaacaaagatgtgacaagatgctgtgaacgagatgagaaagagaagaaataggtgaatagcaggggaagaggaagaggtcagtgagtggacctgcggacgatatgatgtacacctgtgaacttggaaatctctctcagcttgttttggagtttccttcagccataaattcaatttttgaaaacatgcgcttagaaatttgttaattccaattggataaaagcacaacctgaagacagccaagtattttggactcaatttttaatattttttcccctaattgcagatatcaaggagtcccttctccatttcctgccaattcttcctatcatttggacaatatcattcctacgaaagacattctctcaactgccgatctcttattcaccaattaatttttcagaaagaaaatgtaataaattttttttctggaaaaaagaaacgttgggatgcatttcaaaaagaaatttccaacatcttccaaatcacccaaagtatcaaacattcccaattcaactccttaccaattgccttccacccttgtcgtaccagattattcattgaaaaatggttgtcttacggaaatcttgtcgaactcgtcgtctttcagagagagcaagagagctcgaaggagagaataaaccttgcaaacgaagatgttcaggagagtctaacagttcctccaaatcaacatccgctgacaccaattcacacatcaacacccaaagcaactcagatttgaaaccaatctcaatttcaatcgaacccagaaagccacacatgagcctaagggaacagaggagattaagacttctccagctgaaatcgctccaatcgcagaaatcaagcggcaaggaggcaaaagccagcaatcagagagtttcctctcctcaacctgacttgaccgatgattcgaacacagagttaaccgacagtgaggcagaggaacaattgatagtgcgtacttcgggacaagagcctcacattgatagaatgttgaactatatccaatcaaccactcgtattgatgattgtatgatgtctttgacgcattcttctcccctgctaaataacgatgaggttgaaattgttgaatctccaatgctagcggatagcttttctccattagcttccaacataccagtgaaaacagaaccttattggcccatgagtgccgacgatggatttttttcacttcttaatgataaacctcaattcaaaaactattctttgcagaagcagaaaccaccattgctggttttcaatggagattgcaacatcgatgatacgagccatgttccttctggtgaactaccattagatgagtatctcgaatgtgggagcttagaagaggaggaagcacaaagtggtgatgaagtacagtctccattggatgctcttgagatgaaacaatacccttctcaattagagtatcgctgtcatgctcaagtcaatttggcattggttcctgaatctacggagataaaggagtcagcatcgcgttccacgaaacctagtctctccaaaaagatcatgtccttaatgaagagctatgatatgcctctgacacagatggatttgttcaatagagctattaacaagcgttcgttattaacgggtaaagcttatgaagaaatgtttgctgttggagtcgataacgacttttcgatctgaaagagtttatggtgtttcttttatttcgtatgtatatatatgcctggtgtttttatggtttcctttctctttatttatttgggggtttaatatctatcttttcagagcttcaaaacgctttttcaattcatctaaatcttggtctcccttcttcacgtaaacaggtcctgctgtcttctttgttttttcagaatcattcggggtgtcttcgtcttcagattctagatcgggctctgattctggattttcagcccgaggtaatttggaaaagggagcattgtatgtcttggcaatttcaaccaaatacagatcaattagctcttcagaaggaggttggactgagcatcgtttcacgatcttttccggtacgatgccgtcttcattagttaacgcagcttgagcaaattccttcccatacttatgactagtgatatccctgattgtcatcagttctttcacctctgtaaacggggcggcatatatgatactcttaacggcctcttctagccctgggtcacatttgggtgattcattgatcagcccaattctggccaacaaaagctcgcaatacagttccagatattccaatagttctaccaaaatatcctctcttataattccttccacacgaatcctggcactttcttcctttctttgaattaacagatctcccatttgccttcgctgttgtttggtcaaggcacttttcttctcttgtagatgacgtagtctagagatcgccattttcaatgatgtcttcaagcgaaactgaatggttagcacttataagtcagctgaagggcattactttacttacaccgggtgctgcaatgggaggcattagttactagtattgaatctgggtgggagactaacgtataactaaaccttgatgcactaaaggccgcgaattgataactaaatcttatataatctacaattagtttatcaccaagtgttcctccatgactctacgggcagcttgaaaatttccatccatgttgtatatattggcgaggttatagcctgcctccattttcaaattatagtctggttccactggctccattgctaaaacttcttcatagtacgggatggccatggtcgtaagccccaaaaagtggaatgctcttccaatgttgtaaactgtctccattttaatccctttggagccatcttttttttctcttatttcttgatactctaagaaataagtaaaagcttgtaaaacttcaaagtgtctatttggaatcactctttgaatggaacgattgagataacttacccctataataagacaaattaacgggtcctcccgaaactctctgtaaactttgatttcgtatcctaatgaagatgtataacttctcttcgaaaacagcagtgtactgtaaatgtgataaaggtaggggtttattcgagttgagtcgacctcttgattcaccaagttagccattcccacgatcttctttcctagacgtaaagaatcatgagcttttagttgtctcagaaaaaacttggagttaatggaatcagaataaacatttatggcgtcattactagatttgttaaaggtcatgaaaattctgaacacctctgagttgaattgatatgccactaataagtttcttatagttgagttgatcaattgattgtcatccatctggagagcaacggacagttgcagcaaattaaccagagttgtcttttgtttagtattggtaaaaatttcaatgcccttcacaacttcaactagcattaatacttcctcagagtcatcatatgatgctaatgcaaggcaatatctaaaaaatatatcactccattctgagattttcaatcctctgaactcctcaagctgagaagctgtgttgcgtagcttttttgtctctggaagtcttgcaagttctgtctcctctctaacatatttcattctcgtaatcttttgcccaactttcagcatctgagttcgcttacggttcatcagtgctaagaatcgcttgactttctctcgagatatgaaaatgttggaaagcaggaacatttcaatcaaatcagcagcaatttcaagccatgctttcatgacaaagttgcccttctccttgggttcatcccccaaccttttcaatcgagagtaggtatgtgcaactcgagccaacgcactttgttccatatcagcaatttcatccttggtgtatacgtcccgtttcttcccttttcttcgactactctcaagaatcaaagcttgatcaattattggttcagcaggctctccagttgaacctatgtcaaccatagtctcatctgcctcattttcaaaatcttcgagagctaattgttccttctttgattcaatttgaacaaatagttgattggcttcctcattttctcccaagtggaaacatacttctgccaaagatagtaaaacatctatattatctgggtcattttgagcaagagacaagtaagctgcttttgcttgcgtataatcttcggtctcaactaaacatctagctatgatcataatcaattccacattatgataaggttctagctctgataatggtgagagaaatttcaaagcctcgtgaaacaatccgattttttccaaagaagttccaacttccaaataaagatccgctgtattctcgatagcagaatccataagataaccgaaatgaattaaagcttcatcattctctttgagacgcagcctaaagaatcctaattgaatccttatatcaatcggcaagttatgactcttttgtttttctacttctggaagggccttaaaagcttctatcgagcgtctcctgtcatcaaattctgaatcatccttctgatcctgccaaaaagtttcagattcacgacgctgaatccagcgtgcaatagtcttaatatcagaaatccccattctccatgccccctgtttgctacatagttcagaaaggatattcaactctgaccatccaaactgcggaacttgtaaccgttcaaaagatgtggggtcttcttcaatcaactgtcgataatttttgttttcttcaaataccttcttatacaatgcgattgcatcacttattcgtttttgtttcaaataaacaagagctagctctttcaaaatagttgaatttgtaggcataatatgaaacaatttttgaaaactctcagaagctctaccatactgaccgacttctcgataaattacggctctatcaaatatggctttcagatccttgtgatcgcttgcagaaattcctcttgaataacagtaaatagcttggctggtatgtcctaactggtaggataattcagccaccatggaccagaactcagaatcccaggaatgtaaatgagcagcaatgatccataaggttacacacttgtttaaaagaccttgaatcttgtaaatttctcctaaggtcttataagcgctgaaacttttagaatctttcttgataacctcaccgtacgtctcttgggcaacttgtaagtctcctcttacaaatgcttcattagcttgagataaaagcattctcacttcaggatcaagttctctatcctttctcatgcgtcttttcatggcagccataccaccggtcttacgcttcggcttaaaattggaagcttctctaagagcttctcggaaatcagcatcatcatcaatcagatcagggtcgagctcttcatcatcagaaaatcccaattcaatcgcaggatttgctgagattggtcttgatgatgataaataatctcctctttgaaagttttccgattgtccttccaaaacctctcccatttgagcattatcatcgctatcgtaatcttgggatatctcttcataatcctcatcatcaagatcgtctgcctccaaagactctttcagttggtcaattccctcaaacagatcatcatcatcatcgtctaggtcgagttctttatcaacggttttagttttggccattgctatatgtttgtagtgcctttatttaccttacactaatctcagttgtattgcatttgatggtagtgtcctatccattatttcttccccagaatcaaatcttttgcttcaggcgccttggcctagagttgaagcttgctccgtctagcagcgggccgcgaccattattatgcatttcaacgcacggatggcaaacctcttctatcgctaagaggttagattgtcagggtgacttgaattgatggtaagttttgaaggttttcactgttgctagagtacctctcttccaattgaggacattcgtttatctttcgttcttttttcaaggtgtctaacatttagttttctaatctcggtcaatccttctttcgtgctcagcaggcctcgggcttcgaagactacttcagatgctacccggtatccatgatgccaagtagcagctctagagaagtagctaactttggaggaaagatatttttacccccttcaactttacacaagttgaccatgttgcatatcagctaccctatgctgtttgaattgacaaaccaagaaacaggaagaagcacgcacagtggagtcctagagtttcttgctgaagaaggaagatgttatttaccgcaatggatgatgagtaccttgggtattcaaactggtggattgcttaagattaagaactgtgatttgccattaggatcattcgttaagattgaacctcagtcggttgacttcttggaaatttctgacccgaaggccgttctggaaaacgttcttagaaactttaccactttaaccgttgatgatattgtcgaagtcagctataacaataaggtgtttggaatcaaagttttggaagtcaagccagaatcgtcatcacacggaatttgtgtaattgaaactgatttggaaactgattttgccccacctgtaggatatgtcgaaccagattataagaaagaaaagaagcagagccaagtcaacccggctgcaaccaacccaggacttgttggccaaggctctatggcaaagaagatcaactacagtgaactattaaaagaaaaacccaataccaccaagttccaaggttctggtgtgaagctttcgggaaaaactataaagaatgaggaagtggctgctcaagataccagtggtttgagtttagaaggtcaaccagctcctttaatacttcctgataaccaattgttcttcggctaccctttaaaaccatacaaaggagacaatagaactgataaaaacacaaatcaaaatccattatttgcagggcaaggacaaactttacgcaaatcaaagaagagaaaagacaaaagcactcaatcaaccagcgccaaggacaaaactcgaagtcctgacgcaataataatagattcagactgattaatcttatgaagtaaatgtccgtattagttcatgcgatgagttgggttattcgtaataaaatctttagtagccaaattaagctctatcagctccagcagtggccagtttgtcggccatttcattcccataatccccggagtggcctttcacgtattcaatgttcaaagggggcatacctagctccttatatttcgaattgacagattcgataagatttgtacagggttctattaggtctctgttttgtacagggcctgttgcagttctccaatcgttctgcttccatttagtgacccatttggtgatggagtttattgtgtatcgtgaatctgtcctgattgtgtagtgcttttttgacccacttgctaaatctttttcaataatgatcaaagcatccctaaccgctgaaagttcagccctttgattagtctggactccagtcaatggcttcgaaatatttctaaggtcattctccttgaagaataccccgtaaccgccctttgcaccaaattttccatttccccgcgtggcgccatcagtgtagattatttcatggttgaaacatagttcatcagaaatcagttcacgattcagcaatgggccatgatttgtagcgaccccgtgatttattggtttggtgactttagagacgccactgttcgaagtaagaagccgattagtagatgtgaaaggtaatgagtgagttgaactgtttcgactactagccgttttatcaattgagctttggttcaaatagtcttgagcttctgctgcgctggaaaacttcttaaactcagcattggaataaccagagacctgtctttgacagtcattccatgagtggtagattcctatgttttggccttttcttacagcataatagtatgcttttcttgacatttgatttaagaggaatcagtctagatgaaacagtttcattaatagtattttcagtggatggagtagtacacgcatctcttaaagctcttggtaggcttgagcagagtctggtcaagaaaggcgcatgtagtttagcggtaaaattcgacgttgccatcgtcgggcccccggttcgactccgggcatgcgcataacctttttaatttttctaccacatgaatcttctttgccgtctttggcagtcaggtacttagtagttaattaattggtcgttctatgactgaatgattgcacttagaactaacggagactgctcctgctaactctaactagtaaaaaagacatccatcacaatgctaattgtgttaagaaaaaaagctccgcgacggggaattgaaccccggtctaccgcgcgacaagcggtggttctaccactaaactatcacggatcaatgtagtaggattggctggtatatttacatatgcctgccatggagtcttcttcaatttcataactccctttcactatgtcagactctattgaataaacaagccatgatatcaggtgcccactcacacttcaataatgatggattgctagcaaatcatttctgtaccttatcgcctcttatcaacacatgcggctcagcacaaatactaaaacccagaaggtggatattttgtacttggtctctttttcacactactctacttaagcttcaagaaaaagctgcttataaagctacaaaaaatccaatcattcaagctaatatggctgatgatcctctaacctactacgagctacaatcttgcgttggtaagggaaatttcggggatgtctataaatcgtaagtgaaaccaaagattggaaatggattttcttactccacagagcaagcactgacattcaaccataactctagtattaataaagtcacgcatgaggtgtttgcaatcaaaatcattaatatggaagaaacagaagaagacattaacattctcattcaagaaatcaatctcctttctcagttgaggtctccttactttaccaattatgtgaagacttttgtaaggggaactacgatgtggatagtgatggagtattgtggtggtggatcttgtagtgaacttctgaaatatctaggaaagttaaatgaacaatgtgtggctctcatcattagagatactttgaaaggactagagtatttgcattcacagagaaaaatccatagggatgtcaaagctgcaaacatcttattgacggaaaaaggcgaagtgaaacttgccgactttggagttagtagtcagattggcgtcactcaagtcaagagggacacatttgtgggcaccccattttggatggctccggaaatcatcacttgcaagaacgggtacaatgaaaaagtagatatctggtcattagggataactactatagagttagctacaggatccccaccgctatcggagaataatccaatgaaggtcttgtttgacattcctgatcttccagcacctttacttaaaggagacaattattcttgcaacatcaaagcttttgtcgcagcctgcttacaaaaaaatccaaagttacgtcccagttgcaatattttatcgcaaactccgtttgtgaccaaaattcgaagaagtacttcgttggttcctttgatactgaagaaacaggagaagatgagagaaaaaaacatcacacccaggtcaagaattccattggaaaaactggtcaacatgacaaatggggccagggaagattattggcagctatccactattcgaaccagaggcagaaatttgtcaagatctccgatgtctccaatcacaggtgaactcagtgcgagtaatgccatgactgaagaaactaccccagagttagatatgccttccaaaaagctacaattggggtattcggattatttaaagtacgtaatcctttatgccttggataaagttaggagcagagccagtactgaagtcacgaagcttgatgtggatactttgaaggctacaatggaagagtttgagaaaagacagcctggtattagttgcgcactagtggaagagatatttttcagagttagggatcaacgactttttactgttcatgaaagtaactgattgctcttttatgatacataataataatacacaggaatgatacacttagtcaatggtttctgggccttcttccaggttgagatctttgtatttggcttgcatgaatattagtttggctaacgatttccccttattgattaattggtagaagttacccattggtacctcaaatgcacatcctttgttgactacaaaaacagtattactaacggttatttcaaccaaaccagtgatcacatagaacgtgaagtacatgtccccattggtttttagtgatttttgacccgctattggcaactccattataccaacggcagcataatctcgttcttgatcgaaaagaattgagattcgaaagttatctccattctcctggaatggcggtaaatactcctcatggcctggagcccatgcaatagtccttggaactttcttatcggatcctggtccatcatatacaaatgtgtttagtttgccatccttcaaccattctccaccatccacttcagggtcaacttcttcgttagaaagatcttgagattcttcgtctggaatgacaattttccttcttgctatttgtttgggttttgctcttgcctttggttttgacgttgtctttggattagctttcgatcgaggctgggatgcgcctgttgacggggtatgggtgacaacggagtcgacttttctttccgtttcaccattttcaccaggtacaggtttgtacacaattttttcattttcccagtactttaagcattgaactctcttcctactagaccttcttagtggctgggatgatgtctgtgtgttaacagtaggcgatttgatcttcctcgtttgggtgttaacagagggcgtcgttatcttcttcttctgtgtcttctttggtgaatcttgggtatcttgttcttcgtcttcatcctcgtcttcatcttcattatcagataaatcggacaattttttcctcctgctattcttatttaatgctattcgtttcgtggtgtttgctgcctttttacttttatgtgcctgcttcttattagaatttgctaatctctttgttactgacttgacaaattgatcatctgcatcgaaatctgggctcaactgttctaaattttgaagatatcggttcttatcgggtgaatctttctgcaggtttataggtgacatagattcattcatattaaacatatcatcatcatccacaaattctggctgttgactttcatcttcagtgtcctctaccaatgcagaagctttcttagtttgtggcaaaggagagcgtaaagagtttgcctttggcaaagatgttcttcctcccaccttactcaatggggttgtctttattttattagtaggagaattccttccccaagaagatgccagtgcgggaggaggggtgatgcttgtcaagtttgatgcctgatcagcttccgactccgaggactcagaggtcggaatgaagaattcttcaatgtcttcaaacccatgcgcatctttagatacattactcttcgccttccgaccagtctttcttgatattctcccaatatttagctgctccatggctaaaatatcatgagaagctggagctaaaattacttgagaaatccaagggtagactgaatgaactttaagacgatgttgttggaatgctttctttgttttggtttagtttacaggttgaagtaccgtgtagtgcgatgggccgggtaagcgcagattgtgtcaaaaaaaacaaactgctcgaaggggtgctgggcggaagaaacaggcggtttaggccaggtcgggaccagaagtatgtcggattaggagcattttaaagtcactactctatctatcaattactatgctttacatgaattcaaattagtttttcttttcccccacacaaatgacttgctccttctcagagtcatagtaagccaacatttgtatcttgaactcacttgatgctataccaaactgcttcaaaatcagagcctgtgtgacattcaaaatatctcctttttcgcacactttgtaaggctcgtcaatgacaactttaccggccttaatacgcgttggaatcttgtatttgtttctgaaagttggctccaagttgtgaggtaaaggaacgtcttcagactctgaaacttgccctccagtagagtagataattcccgcaggaattgtaaaagaaattgaactcttttctttggctctgcaaaagtcattcttcttgtaagattcaaaataggtagatacagtgttgacatcttcattagtgaataataatccgatcaatccttcaaaaacatcaacaatttcatgcaggttttgcttatattcttcctcaggtgtttcccccaaagctttttgtataacttttctctttcccattaacagcttggatccgacccaatctgatctcacatcttgaaggactggtgttctgacatcatcaagtctcaaaacccaaacgtatttgtatgtatccagagcagttcttacttcatcaaatattctgtctttgttatccctgccctttttgtctgtctgggccaaagtcacgagcttagatctttttgatctaggcattattgagtaggtatagtaatcttgggaaaaaaaaatactctagtgaaaaaaaatttttgtatactcgcgatgaaatctgcagagattacataagaacaggaccgccttaaatgtttggtcacctagaataactagtctcttagcttgatgatgatgatcagcctaagttttcaggttgctagttggttctccaattccctacaattctctgcaaccctagttggtggtggttaattgtctttgacacagaagagagaccccactaccttccagttcttccctttcgggctgcacatctcttcgttccgactttcctagtagtacccggaagccccatacatttctcattcgagacacttcttacctaattagaaaaccattttgcctcctatctaagaatacattgccacttaccaaataagagtgacatgagttctgataaagaaaagttaaaacatctaaaggccagtaaatcacccaaatggcttgactcaaagagggaagactcttcacccaacccccgaaggtcttccgaccttgcaattcctgggtcttctatcaatcacactcttcctgataacacagataattctgaagcgtcccgcaataatggaacgaaggtgaaaaattcaagtgattttggattcataagcaatttgaggcgtgcttttgaaggcactcaagagagacaagccaatggaaatggctcagatgatatcgatgtcgttgaagatcaagggagaacggtattacaatcgggcagctctgttaacgattctagccatgaaaacgatcaaaattcttctcttctggatgatgatattgtaacgaggaatgaggattatggcgatgaggaagatgaagatataggggaaagtcggcaagactttagatcaatgaatcaattgcggtccatgtttccaggttccctggttgatatcctttcaagaggtccacatgtcaagattaatacattaattgatggattatctgagcgtggtgatccttatattttactcgagactttaaatgagttaaatgaaactctccttatcatggatcttatgatgggaagagggttttccgtgataaagttatgccgttccatagtatccataatcaatgaccctctacttcaagagcaattggaactacagctggtggcttgtcgttgtttatacaatttagtggaactgaatccggaattcgtacacgaagtggtatacgccgacgctgttctttgcttgaagttgaaactgatggatatcagctacattgatcttgctgagcaagctttacaaacaatggaaattatcagtcgatatcagggaagggcactacttgaagataactgtctggaggctgtcctacagtttctagattttttcactatccacgcgcagagaaaagcactgagcatcaccgcaaacgcgttccagtcattgtcatctagagacatacctatcgttgaatctgtttttcccactgttcaaaggatagcgactgaatatactgaccctcaatgctgcgagagcgcttggttaacaattgcacgtgctgttccaaagctaatcaacgatcccatgttgttagagcgccttattcccgtgtcattaattcagaagctctgtgccctgcttccaacctgtctaggaaaaagcacttccaacagtatattgtcattcagaacttgcttaaagttgatcaattctctcacactaattgcatctgcatctcctaaaatttctctcaatctgatagaggaatgcaaaattgataaaacattcagaactttactcaacaattaccttgtctcctccaatcataaaacacagcaaactaaagccgaggacaaacttatttcagatccttcagctccgtcaaccctagacaagtccacaattgacagcgatgctatttcaattgaagctctgatggctgctcctaaagagctggttacaactttactgaaattgttagccacacttttgccatacttatacgtagatcccaaatcgaaaaactcacatgacgttttcgcaaacattggaacttactacgttttgtcacaaactgaggcacaacaagatattaatgaaaagaagattgaattatacaatgcaagcaatggttctgtccaattgtttattttccactgttttcctgtcattataaatatatactcctccaccgtcgactacgatattagaaggttggtaattatcacagtgttgcgaatgatcaatatttgtaacagttctgccttacatcaaattgcaacccggtctcgagttaccaacttactggcttcgattgtcatccaatcaaaagactttattagcaagagtttctctaaaagtcaaacagaggagacaacagatcactccaataatcaaataagaccgtacgcccttcttcatggagcgctattaatcttgttccatttgacagccaagtcgtcggatgcatttttgttaaaactggagcgagagggtctttatcatgatattggtcagttgttagatactctgaagcattgctattctgcgaaaggctttaatttgtcctcagagaatgttgattctaaaaactttgatgaatctggaggcaattcgtatatggtggggtcacaaatgagccttgatgagaataacgattttgagaatgccggtgattatcaatcgcaaaattttgaacaggatgaaagtgaatgtcaaagtgaaaatggagatggagatggagatggagatgaagatgaagatgaagatgagggtgagggtgatggacaacaaatatctgatggtggagacgacagtgaagacatggctgatgacaatgattttagctacagctcgaggaggctattgggaaatgttgattatgccttatccaataatggtacttcttctttcacatacagggagacactaaaagctcttataagtctctgtaccacgattatagaggattactcttattccaagggtgatcggacttcgcaaaaatctcctcatcttcttttattagagaatgtccttgctagaatatcaaatgcgagattggcgtctaaatttagtttcgctcaatggaccgaagtttggagtgatctgagaaccgctcttggtgaaaatgacgagtcaaatatctctagttatgaacttaccgcttcaactttggtagattctttattgaatttgttcagctcctcagttggtacccagggaacagtctgtcagtactcttttattaaagtattctgttcccgatatagttcgtcacccgaagatgttcccttagtattgctggttaacaaattacaagaaggtgtctcacgttctgaatcatttgaaattgtgacttctggtgtttcaactgtaggtggttttggaggtaatcttactggtgacattatgagctcaaaagcctcatctatggcaaagcaattaaaaatgatgcttatctctaccgacaaaagaatacccaaaagccatcgacaaatagtgctgaatattcacgccattgccacttttcgttcgatagagacttttctgaaagcacgtatggctaccttcaataggttacggggaaacaattctggtttctcggctcttcaagacctcacatcagatgaggatgcttccaattcatccgaagaagacaatgattctgactatcagctacaattcaagatcaatggtgaagttattcccaaagatgctactgtatacggggctatttaccgatcccttcaaagatcgcccgatgacagtattgatagcaaaaaaatttggtcgggtttaccacacaaagtaacctattggaaagaaaaacaatcgacggagtcactgccgaaatcagattttcagatttctaccaatgacacggacgaagatggtttatatctgctacaggacaattttacttataaaatacttcttctactgaaggtcttgtttgagctaaatcaaaatgcccagactccagctgtctccgaagcgttgtttttaaactttaaggtgacggcaaaacttaatagacaattagaagagcctttagttgttgcaagtggcaccctaccgatgtggtgtgtccatttcacaagagagtttcctttcttattcccattgagtacaagatctttttttctaaagtctgtttcttttggttactcaagattgattcagcactggcaaaataggagcaatgaagaaaatagtagatccgacagtgataacggcttacaactaggtcgcccatctagacacaaggtaagactgtcaagaaaaaagttgttacagagctcgataaaagtacttgagacttatggcgatgtacctagtatcttagagatcgaatattttggtgaggaaggcactggtttagggccgacgttggaattttatgctaacgtctccaaagagtttacaaagaataagcttggaatgtggcgcacctcagataaggaagcgatttacgttagttccaaaactggactttttccaagacctattgccctggatgtgaacgagattcataaacccctacatttgttcaaggtgttaggaatcttcgttgctaggtcgttgctggattctaggattattgatttcgagttcaatcccttcttttttcatacagcaaagaatatggtcctgggagttcaagagaaattaaaccgaagggtactactggatcgcttagatgaaattgacccagtattgtcgaaatcattacggtatttgctgaaatttgtcgaacagtatcctaatgttccaccagacctaagagactccattaccgttgaagattctccactatctaacctttccctaaattatgtcttgccgggatatcccgatattgaattaactgaagatggagccgatactgaaataacccatgaaaacttagaagattacatagacgaagttttggattatacgcttcaatatggcattgaacaacaggtcagatcgtttattgatggattttcaaccgtttttccttactcatcattgctaatattttctgcttcagagttggttaagttgtttggtaactctagtgaggattggtcgtacgatactgtcatggctagcgtacatgcagaccatggttacagtattgaatctgcagctgtgcaaaatttgattcagttgatgtctgaatttacgaaagacgagcaaagaatgtttctacagtttttaacaggatcacctcgattgccgattggaggatttaaagaacttaagccccaattgactgtggttcgcaaaactacagaagacggtcttcttcctgacaattatcttccaagtgttatgacttgtgccaattacctgaaactacctaattacacaaacaaagagataatgaggcaaaggatcatgcaagctatcaaagagggagctggggcattcctactatcatagaaaggcatttgcgttgtaagtattagttctttcctcatttagtgttgtcgttcatctacttattataaaacaagataattattattctagccgtacatattttgacaagtgacagctctctttcctagacttcgttcgatgcaattgttcaaaagtttgcagtgttcacgaagtatctctgagcgatgagtctctattttgctcttcagcagacgtagcaggccaacaatatgattcttgcttgaaatctcatcgattacgttggcatacaatttcatagagctgtggaaagttaccccatggaacacaccaccaagtttgagggacaattcagtcccgatccgcttaagataggtataaccttcctcccttgctggtagagaatctccattttccataatgggagatctaagaaggtatgattcgggcccttcagtgcagaaggtataagcccaaagcacaaatgcaatggaagtgacaacatgtggtcgatataggtgatgatctgcactggcattataatcaataatttgttccgaatactcgggagaatcctgtggcattagtaataactcacacaggaaagcataaccatgtactactgcaagccgcgcgttgaaggtctttgaccacctctgaattcgacgttctacagcttcataatccctaccacaagctttcacattcattctacttggcgccccagcgtagatgaggtaatcataatgtgtcagttgcatgtatgactcagcaagatgataaagtgggaatttgcaagctgtatcctgtgggtaattaacttggtatataagttgatcctgattatcacagcatccatcttgacagatggcaaatttccagaattcaatggcagatgaaatgacttccttccattgatacttcacagatacccattccagaactgagacttgcatgtctttctgttccatctggaacataatcgtgagcaaaccggctagcaacagcttcttaccaaatctactggtagtaatcttgtttctatggagtaactttttcaaagcatccaagaatttaatctcgttgccacatctcttcttacaatcatctagtttggaagattcccataaatgttcatcgcatggaagcgaaagctttatctgatgaagatataatgtgatttcatggccaaatatcacggcatgctgggtatctaagtagaatgccatcagtgctgccctttttagcgattcatcttctatccatttttcccaagtgccatgtcgatctccgtcttgttcagttttgaggggatttcctccgaaaagtgcacttcttctcaaaagctgaatctttagtccgtgattcaaataagctctttcatgaagtctcctattggaagatgtcaactcataaatctccaataggttgagactttgaataacccaggattttgggggtggtgcaaactcttcgcaagagcaaatactccacctcaacggtagaccaatcttgtcacatatggaaacagtagatttatcgtaggttgccccaaccataatcattgctagcactaagtagggatgagctctcttagttgaaaacgaaggtttatgaatgataggaaattgaggatggtggaaagtccagtacgattgtaagcttgtttcaataagtggcaatgtaaaatcagactcaaccgatagttgaggcaatgactctattagctgtgcttgtaattcatagtctaccaatgtttgattctcagaaatgggtaacattgaaaacgactcattgattgataaaggtgaaaaggcatccccaggaagtccaaattcaaaattagttaagttaatactatcacttctatcatctttgaaaaaatattggatcaattccgagggtggtaaggtcaaatcactttcaacatccgacagggcagttaatgctagtggttgaggggggttgagctcagtttcaagttctacagccggctgtttccccaaggagaataatgttgaaatctggggatcggaaactttttttttaagcttgtttttattttgctctttgagtttgaacttttcctctcttttctggtgtcttttgtagtgcttatctttaacatcgcttcttacaaaagttttgtggcatccaggccaggcacagttgtaggtgtgtttagttttatggtttagttgatgtcttgccagatgatctggtcgactaaaagacttggagcactgaaattccgaacaatgataccttccatcctccttcaaaaacggatcatactttagtatcttatttcgtggctttctcgatgcttcagaagtaatcataatcatttagtgatatctagcagggagcataagggagttaagccacttctattcctaaattacatcaatgggagaagggttgtcggatcctggtttttttttcttccgtcttttggcggtagacatttcagtgtgaggggcaacatgattctggggtactgcaagttgaccccactctattgttgcatacgcataaagtgcatacgacaagggtgagaaccacggtgcaagttttgtccgatgatttaagcccactattcaaattagaattacaccattaactactctaaatttgatgctttagtcttcatcgttgaagacgacaataggatcccaaggagggctaactaatcgtttttctcctctaatcgaggccaattcattaagtttttttccatcctcctcacacaactcaatgatcttaagattatcagcaattctggaaggcgttacagattttggtaaaacgacgatacctctccacactgcccaggaaattaagagagtagattcagaaataccattcttcttggctaggtcctgcaccagctcatctttcagcaatggggcaccagtggatcccaacggtgaatatgcctccaaaacaatatcattttccttcgcatactccaaaagtctctgctgcggcagatacccgtgaatttcaacttggttgacaactggcttgatggtgatttctgggtctgcaagcaatttcttcaagttagtgatagaaaaattggacacaccgattgccttggtctttccagaggcaactaatttttgcatctctctgtatgtatcaacgaagttccagtcaaacagaatgtcacgtttaccgtctggtaatgtaggaaatttgtcgtggtttccattagggttcattggaactggccaatgcatcaagaacagatcaacatagtccaaacccaacaatttcagagacctatccaaaccttcctcagttctggtgtggtcagttccccaaagtttggtagtaataaaaatgtcctttcttgcaactccagagtccttaatagctttgccaattggctcttcatttccgtaacagtaagctgtgtcgatgtgtctgtatccagctttcaatgcagcaataacggcattgtaagcctcttcatcggtggattgccatgttccgagaccgactgctggaatggacaggccgttgttcagcttgaaagttttagtagaattggatggaactgccattttcgatttcactcaataaatgttgatagaagcaattgaatatgagaacacttgagtttggaaaactccactatttatactgactttggattaggaatcagtatttttcgggtgcattcagcaaggcgcgacggtgggggggggcctaccgtatggggggacaaatcaaggtggattaagtaatcgcaaccttggatgggctggaggagatggtttattggacagacactactcacgatactacatgggctattcattgaagccaacccttgacagggatctcgtgacccaatgtcaatacttgagcgctgaaaattggaaaaatgccttgaaagatgatgatgactacatactgagggaggtggtggcctacaacaccagattgttcaatggatttaggaaaatagaccaatggaacagagactctttgaacggaatcacattttgggtcttacaagatgagaatgggacaattgcttcgtcctgtgaaactttggtaagaccctcttatgtaatccgaggaaagggtaatggggagagtaaagtcatagagagcgtatctccctgctttgcttctgtttatactccccctgctttcagaggaaagggtcaggcgaccaggatgctgaaaggggtcgttgaacgactggaagaagtctataaagctgatcctgatgtgtttatcgctctgtactcagagattggccgattctatgaaaaattgggatttaccttctttgatgtggacattctgaaaattcatgctggggttcaggatcaaatcgttgtcgaccaagaagaaaaatattcagtggttaaaatcacaaaaagtgaagaatgtggtgaaattgtatctcactacgattcgttggtcctagatgacgcaagagagagatgttcaaaagaccaaattaccagaatactttataaaccaactgtagatatcctcgaatggatgtttaccagggcagctttcattggttgcaaagccaacagtgaagaaattgaatatcaattcggagtaaaaattcttgaaaatgacaaaactgttgggtatgtaacttggacatatgatcatttggaaaagtctgtggatattctattcattcactttaacgatattaatattttcaaactgttgattaagaaggttttgctagttcttgaggtcttgcattatgatcatgtaagtatctgggagtctcaattatttgaccacaagtacccagtttcagcagagcacctcgagaatctgctcaagtcaattagagctgaaagaggacttaaaaacccatctttaagtgctgctaaattttttaaaggggaagaattcatttgggaagagaacaccaaatggccttggttttaataaaaaattggccaaaaactattcgtgaattatgctgcttactttcaaccattcttgaatcttattagtggaatcatttgcatccggtattctctcgtgtccaaagttttgaaaagtttcgatttcgccaattgctgagtaattgacatttacattatcatctattttgtcctcattattctctttttgtaagagatatcccttgtatccgttcaaatggagctctttaccttttaactttcttcctctgagatacgattccaaagtgccgtctgcgttcttttcaaccatccagtaatttccaagccctttcacctcccttgtgtgcttgatactgcatggaacaactgatgcctccaatctggggagacttccctcacaaacaacgtacttctcttgcataatgcctgctgaattatcaagtgttgagttttactaacgcgcgtacagtgtaatagatcctctttgcttagtattcgcgctaataggatccctcaatctctcacttaccaaacagattccctcccttagtgaagtttacgagcaacaatggcacaatacccctatttaatttcaaagcaagtcctcccttatatgccatatattctgatgtcaatactaactgtgcagatatcttgatccattgtttggattaacagtcggtgtactagcttactattcctatgagaaacgagtaggcagagaaccgggccattcgttggcagaattgctggagaaaaaatggcaagcatccactaagtgacgatacgacgtcaagacttactttcttattcatatattcaagataatgctaactattcttccttcttggagggttctacttgggcttcttcttcgctttcatcgtcggatctttcgtctttggtaacatctaaaaagatgtgacggtacaaaatccggagaattaacacaaaccagtacagattcaccagctgcaaggcaaaaatcaatgaaaatacaattggttgtgaaatccaacatttgtattgctgtgtgatccagttcaattcaaatggacctacggtacggaattcagtcaatacagaccaaaggatcttgacattgagccaatggcgcaagtagaaccagacacccacaaagaacatgaacgcgggaccagtgtaagctgaatcaacatagttcagggtcttggaaagagccaggaagaagtcagagatgtccatggtaatgtagactgcaagccccatccaagtgaaatgaaatctgtaactacagtaaatcagtgcaatggtgataatgtggtgaataaccagctccttgaaatcttttctcggcttttccaattgtagcatcaagacaacagcttgttgagaccagaaagcggcttgacccaaataatagtacttgaacagatattcatgacttttgtgagggtaagtaatatagaattctgtcgtgttgaagtaccacaagggcatacctgccatgatatatagacccaagggcccagaaaatccatagtagcacattgaataagactgttccatgaatcttctgactttagactctcttgtgatacccaacttactggccaaaggtttcagtaacgcttgcatcaaaaattcacggtagaaactgaagaaaatcatgaagtaaaacacaaagcagaagtctttccatcctttgccatacatgggagggttagttccttcgattttatatgaaagatcaacgaacttgtgcaatggattggatggagtgtggttattagataacagatacgagccatgtatggcaaccaaagaaaccaaaaatggcaaccatgtgtgacgcgagctcagttcgaccaaggaaagtccaatttttttaactaaaccccaatcggaacttcccttcttgttgattaaattaatacgggcggagctagactttctctgctgagcattcgactttcgggtagtcaaagaaggaactgcattgtcacctaggtttatgtttccaatggatgacgctcttcgacgtcttgtcttttcctctttagacatttgttgtgctaacctggtatacctgtgagagctgctttacggaagcaggaagcagaattccaaaaactttgggaagacccgcgcgaattgactcgagagtacttctactgcttatgtaatgtagatgtcaaatgtctggcaggtgtagatccgatcgaggagtaaatatgtgaatgttactgtacataaggtcaaaatttgagttggagaggagagtaaacaaaggcaagattgccaatgaccgcactcagagttggttatctgcatagtcaaaactagtcacctttggttagtcattacatttgaatacttcagaaataatcgccttccccagaatttaatgcatcccccattcccaccgaaattccactaaactcccaccagttttcagattcggctgtgagtgcgcatcagttgctcggataaactctttcaaaaccataacgttcgcccctccacctcaacatcagtgggggcactattggcttcaaatataatatatatagatggcgaagtgaaattcgtttctaaccatcttatttttaattttttatttcatcactataacaaatggcttacccagacacttttgaaggatttgcagttcacgacccaagtaagtggtccgaagtaaagaaaattcaatttactcctagacctttccaggaagatgatgttgacatcaagatcgaagcatgtggtatatgctccagtgatattcacaccatttccggagggtggggtcagccaaagcttccctccattgttggtcatgagattgttggaactgtagttagagttggttcaaaggtcgacaatatcaaggttggagacactgtcggtatgggagcaatgtgttgggctgatttgacgtgtgatgtctgcaagtccaaaaacgaaaactactgtcctaactggattgatacatatgatgacgcttatcccgatgggtcaagaacctatggtggttactccaactatgctcgttgcaacaaagagtttgcattcaagattccaaaaggattatccgtagaaggagttgctccaatgttgtgcgctggtatcaccacttattctcctttaaagagaaacaatattggaccaggcaagaaggtgggtgttgttggtatcggtggtttggggcattttgctcttcaattcgccaaggctcttggagctgaagtctacgcaatttccaggaatgacaagaagaaagcagacgctcttaaattgggagctgattacttcattgaaactgagaaggaaggttggaacttaccatacaagtataagttcgacttaatcattagtacagccaattccagccagaactttgaccttgatgcctatgtatccacacttaatattggggcaaagtttgtatctgtcggacttccagaggacaagatggaaatgaatgctggatctttcatcaagaacggctgctatttcggttcttctcatttgggtaaccgtgaagaaatgaaagagatgcttgagttagctgctgaaaagggtattgaagcttggtatgagccaatttcaatctctcaggagggtattaaaaacggactggagaagttgcaccgcaacgatgtcaaataccgtttcacccttactaattacggaaaacagtttgaatagggtaaaatagatatgaatatataagttaggtgacgagatatgtaggaatggaaggtcgaaggattttattcaatgctaaaataccattttccgttgtatcccagcataattttcatgatggagtgaaactattcggtatttgatatctattatcctctctcctcggcttcgaagtttggaagcatcgaaattgtttccacttgtgcggaagcgcccccacacttaatagtcatgcatgatgtatcaattatgtactagatgcacccctgtgccccaccaaaaccgtgatgtaacccccactgtggagccatatggtcaggcgtcaaaataaacttcttctgttttcaactccactttcagttaatgataaatcgaaggtaatatcattattcggtggcctccccaatcatataaagcttaatgagtaagtattaagtttcatttcgctctccactttttacttgtaaacttttctctaacatgacagttgactcttttgttttgccccgtggaatatacacccccatcccaacctacttcaagaaggattactccttagacttagaaacccaagtagagcacgcaaagtttttacataatgctggtatcaatgggctggtcgtcgctggatccatgggcgagtctacacatctgactagagatgaaagattgtcacttttccgtactttgagagaggctgtccctgatcccaatttcaagatcattgctggagctccgtcaggacctgtggaagagattagagaggagatgaggttggcaaaggaagcaggtgctgatttttcaattatattggtcccgggatacttcggtccaaacttgatcagccaagaggggataatagaatactttgaacttgtttccaaggactctccgttgccaataattatttataactacccaggtaactgtaatggtgtcgatatcaaaccggaaacatttgaaagtttgggtaagcttcccgcaattgttgccgtcaagttgacacatttcaacttagcaacttacacgctattgggacagaataccgacctaatcgagacgtacaattttaggccctttacaggcttaggtcaagttttaattccctcattatctgttggggtttttggtgccattgatggattatctggaatgttcccaaagagtatgttgaagatattggagctatacgacgctggagagttacaaaaagctcaaaagattcaatacttggtcaccaaagttgatgaaatggtcactgcactaaatgtagttggagtcaaatactcactgaataaactgtatggatacggagaaactcttacaggaagaccacctttgagtaaacctgccaacctagaagtttggaagaagtatgaaattgaatttaacgagctagctaagctagagaaatccttataagactttcaggttattcatgacaaagggaaagactttatagatggatagtttgtattacgaattttagttcttaacattgactgcaaatgggccgcccacggcctctatagatatgtttctctgaataagttataatcattgaataattttgtattgatcccttcaaggtacgctaaatgagtattcatactatctatatatcaaaggtacaacttggagtattccaccaaagcaatcattcctaacgcctgtccgtaaggcatagaagtcaatgggatatccttgtaaaattgcaagtcatctcccataccagtaccaaaggaggtgtttaataattcaccgtcactatcgatttggctgataactcccttgatagcctttacgccaacgtctctgtatttagcatcaatatatctttttctcacagatttcaaaattccataagcaaaaccagcacttgcagaactttccaagtaagacgatgggtcatctaacagcgtgtgccataatcctgaattgtcctgaagctcagccaatttggaaacctgtctgttaagagtctctagtaggaattccctcaagaaatcacccggttgaagattcagaagctcaataaattctggtataacaatggtgatccatgagttaccacgagcccatagggcattcgcaaaattatgatttccttcaaaagtataaccatggaaccaaaggcctgtcttggtgtcagctagatatttgacatgcaaaagcatttgctttttggcttcctccacgtaatgaggtctgttgaacaaaagaccaatcttggccaatggcatgacagtcatcatcaaagtatcgtcccacatttgctggtaattgtcagtcagataggtggcatgttgcattcctccacattcggtacgtggtaaatcgtacatagcccattcagcccaagagtccaagtatggcttatacttttcattaccgtgtttctcgtagacgtaggctaacgataggaatacagcaatggtattaatatttttagaagtagatccgtcaggaccaaacatttgggcctggaaccaatcttcaatatgcttcaagatcgccttgttatcagtttgttggtagtaatgccacatgccatacaagccaataccgtgtgtccattcccaaccagtgatccaacccttggtgtcaataactctcccatcaggaatagtcattaaaaactggccggtgtggtctttgatattgaccaaattggtaattagtctgttaatcaactcgtcaacggaggaagctttgatgtcgtacaattcagagggcatttgtgtttattctgctagcactataaacggttctcagtaaccttatccccatatttatttctccagattagaacggaaacacggaaaaaagctgaatttgacgagaaaagagaggaggtggtggaagtcatggtgggggacttcatgcaatttttcttctaaaccacaaagtggggccttagtcgcgctccgtaaacaagcatccaccattttttgtccctgatctgccccgcgattattattttcctgcatggtaattaccaaattgaaaatccttggtcactaaattgttagtttctggggtaaacgttgctgcgataaaactctccgtttgtgcatgcgtgccttattgtcttactaacaactgcaactcccaccagaatccccagttttttcgtgttcatttgcttttcattactccctgtcaaagagttttggtcacagtctcctcccttagttacgttttcatcttaatctaaccctcttactgtctggggtataaatatgtccacagggattctgtttcagtaatttccaacactatcaaaacaaataagaccattttaatgtctgatttaagtgccaaaagaacatcagtcgaacacctggaggatatgggctccctagcgtctgacgagaaacatgtggacagagtccatgctgagaaagtcgacaaggacattcttcaatacatggacgaagaggctgttgagattgatgccgaaactgatagacgtctgttctggatgattaacagacgtatcctcccagtgatggttggtacctacttcctgcaggctttggataaaggtaccctttcatttgcttccattatgggtatcagggaggactccaacttagtcggtcagcaatattcttggttgacaacctgtacttatttggctgtcctggtttgggagtacccaaccaactggttgattcagagacttcctattgccaagtacctatgttttaatatttttgcctggggtgttgttttgggtttccatgctttgggacacaattttggcgcccttgtcgttgtccgaacactgttgggtcttttcgaatgttgttgccaaccttgttttatcgttatgagttctatgtggtataaacgtgatgaacaggctactattgtcgctttatggtatatgatgaacggtggtcaacagatcgtgggtggtgtgttagcttactgctttactttgattaccggagcttctttaaagaactggcaaatcctgttcttagtttatggttgtatcacagtcgtttggggtgtcttcgtcttaatttggactccagattctccgatggccgccaaatgttggtcggaagaagacaaaaagttgatggttgagcgtgttcgttctaatcaaactggtttacaaaacagaaagctcaagagatatcaagtagtcgaagctttgaaagaccctcaaacttattgctacttccttattcaatttttgacctcacttccaacttctggtttaggtgcctttgctaacatcattatatcctcttttggattcaccgttttggaaactcaactgttggccatggttcttggtgcttacttgatcattttgcttctgtcttctgcatggttgactaagaggttcaaccaaaacattttctttatgattggttatgtcattccttccatcattggtacagtggtattaatgactgttactattgatgggtacgatacggattcttacgattataagctcagaagaggtgtgctgttgttttgttactacctgaccttgtctttctggggtgttgcgaacttgggtctatctctgctatcccgtaacattgctggtcaatccaagaaatcgttctgtaccgcttttaactttgttggttgggccgttggtaactgtgtgggtcctcaagttttccgtgctcaggatgctccccgttatttgactgccttcggtacccacatggggtgttatgcagcactgattacattgctggtcttcatgagattgtggttaatgagagagaactacagaaaagagaagatgattgagagaggcgaagctctaagagatgaacatttaaagcatgcttttgaggatttaaccgacagagagaatgttaacttccgttacgcatactgattcaatcccgtatggtaatagttatgtcaaattatatattataatgaaaaaccgattttacgaaggtaagtatgccttattcattttacaccagttaaacagctatggtcccactttcctccgccaaatcttttgcttcttccatccctcttgaaacgtccagggcgtttattatgggaagtgccaggattagcagaccaaaaaggaagtaaaaacaataacgaatattgtgagttttatcaatgattagtccaacaatgagtgggcctaaaatactgcttcctttgtctgtaacactgaataccgaatagaaaatagattcctgaccaggaggaatcaacaacccgtatagagaccttgaaacagtcgccaatcctccaagagcaaacccataccatgctgatagcgcatacatttcaactggagaccgcagcccaatcttctccgtgaagaagcctaagattccccaacatggaataagcgctgcccaaataataatataaagaagcatatctttggtagaaatattgaatttcggttgaattacattcggaatgagagttgctccgagtatcgctgaaaccatggtaagaataccaataacagatagtgccaaggtagacatctctaattgagatcttgcaaacaaaatggcggcagagttgatagttgttagagagtctgagattatgaaccaacccaaaagaaaaatcgaaatatctttcagatctttagtttggtttaaagcatgcttcaatgtggaccagccaaaaatagtatagcttttaactatgtggagatgattgatgatagtactcgtaccatgaagatgaaactccaatgggggtccaggcctggattgaagaagccatttcaatggtagttggaacagaaaccaccatatgcctaccatggaaatagcaacttggatgggccaaattgtgtcttctgattcgacatgaatttcatggggcttcttcttcctcaaatgaacaatcatactcatagtcaatagttgcataattaaggccgacacataaccggtagcagcaccttttccgctaatttttgaggatattaatcccttcgtgtcaatataactgcgatcattctcgggaatctttttcaactctgggtgaaacttcgtcaacaagggcaaaaacgcgttaccacaaacatttgctactccatagcagctgttcgctagcacagcaagagtgcttgccgtataatattgggtgtcgttgatgaatatgtaagaaattgtgaaaagagaacctagtaggcccataataatcaatatttgcttcctatgagaccctctatcagcagcaccacttaaacttatgaccaataatgtttgaacgagaaccgaaagtgaaaatgtgtacaatgcaaaagaggatgtgtctacatagtaatgtccattgaatagaggtaaaacacatgtggagtcaggtgatggctgctggggtggcagtggctctggagttgctgggtttttttttgggttgcaaggtgttgttctgtctgagttaagaaccccattatctcttgctaactgctccaaaagtaagggaacataggtgccgaccacactgacaataaacggttcagaggaccatgaatataaacaccatccaaatatttcccttttggaagtatcaggctgctcttcaggctgttcaaaaagggagtagtcagtctcaggttccggctcccgatacagcaattcctgatcggattgcaaaggcattttctaagtgtaagcaatcaaagcaatgggccatgtggtagcagaacttcattcgatggatagatactttattgttgtggggttgggatgtgcgaagatgttggatgttacatggcctatccagtgtggactggacaaggtgaacttatatctgaatcaaacgatgttgtgagtattatgaatgaaaagccgagactgcttcgtttgcactaaagtactagacaatgcgtggatcaaaccccaactattagcgtgtttcggaacagagtctcaagctcataatttcagtcaaagaagatgtcagatgtcagaaatggcatctccttcaacacccatgcatattcacatgcaaacttattttcacaggcatcacagtttcttgtgtaagggaaaagtatataaataagccaaatgcgtctttctaccgtacaactttctcgatatatatcttatggactctcctaccgataatattgagagcacagaaacccttacagatttccttaacgtgttcagagcgtcaaggaacggagtggtttatggaggaagattaagatttgcacatgcgctggctttggccctcgttttcaaaaggaagcaacctattggagacacaatctataaggcgttaaagctgtcctgtgaacatgcatggatactggcggctttcgcaattgtctacaaaggagttttatttgcggtaaaacatgtcatattgaaacataacaaagctagtcgcaagaagtacattcattttattgctggagctatcgctggtttattagtctacgggcagcctactggaggaaaactattttccagaaatatcacccatcaggtaacattatattgctcttctcgtatgatactggcaatagggaaaatgattgcagtgaaactgtcccaaagtagaacctccgatccaaatacaacaccaaaggtccaccagcaaagcaaaagaatgattgagaacgtgtcatggtatatttattctatgttgtcatggggctgctgcatgtatttgtatcaatcggacccgatattccttcatcccagcttgcggaatagtttagaattcatgtacaacaatgaacgttggaaaggtctcaaaggtttctttactcagtagttgtggggtagttttattgttaatagacatgaatctatcctaacactacaacttgaaagggattggttggcaattttaaattttttttagattttttttttctcataggatcagatctttatacttaataatcattttcatttcgtctttttctttatctctatcatagagtaatgtgtgcggtcaatatttacaaaaaaatgcattgaaaacttttctgaagaaggttcatgtaatagaggcagaatcatgttgaagtagaagcctcaacctccgtttgaatgatttcggaaactggttcaggaacagattcatccttaccagactcttctctttgggaaaagggtaaaacccacttttcccaatcattgagggccctgatcttaattccattgtccgaaccacgagactcaatgttcatacagtacttcaaggcatccacaactaaatgatagttgccagaacttagagcgttgacccggaaaaagttgaagatcacagtcaatgggatgaaaccttgagagttcatttgtttcctcaaatatatatccttgaccaagttttctaatgagaaatagtaatctagctgataagttaagctagggaggggatcttgtgcagcaaatgcggcggcctgctgtggatatataggctggaaaggtcttggatggaaagcatttggagaatatgctggaatgaaaccgtgaaatccttgtgggtgctgttgcctattgttgaatgggatgaatacaccattgttgttgttgtattgttggcgaccctggtatttgcggtatccattgttgaactgtctgtaaggtttgtggttattttggtggttgtggtgagcgtgcaggttctgttgggactgctcatgctggtggtcgtctgaagtagatataggctgctcgacttgatccaaattgtcctgttgtggtacctgaggggggacggctttagcggtagcagtttgctgttcattaaactctagaggagtggcgattggagcgacagctgactctgtgctggtaccgttaggttgtttcttgtccagcttcttgttattttcgtctgaacccttaatttgtgcttgctgttgatgctgctgctgcttaataggtgttttcttcctattctgcttgttcgactggtccttcaccttcttcttatttttcttctgggacttcgaagaaactggtttgggagcagctggaagaactacagcagctttgaatgggacccatttctctttaccctgtttggctgccgcaggcttggaggagctctttgaattctctcgtgaggcggcggttaaaatgtcatccttggttttgactatttcatcaatagctgcggacggtatactactaccccaagcattcaccacaggaacgggggctggagccaagctctttttaatcttttcggcctccaattctgcatcgtcttgtttggtggacttgtcctttggtttgctattcttctctgatttgggtgatggtgttttgtcctcgtcaccagctgattcgactggagaatcagcaatggcagtcttagcaagttcagtggatagttctatctcggtggcttccttagaggatccattagcggcagcaatagcgtacgacattctcaaaaacgatggcaaaactttcttttcctaaagagaaaaatctagaatagttgaacggaaaataaaagaagaaggatgtttggggaagtatatgtcaatctgaatggctcaacctggctaaattattggctttgttggtttagaaactcagtgtaacaaaagctctttatgctgggttttggcaatacgatccaagtgcttgtagggttaaaatgaaaggatccgacgaacttttttttttcctcaggcgagaagacccagaaaaaatagttctgttaagaaatttgcgtgccagccgggtaagtcgatgaataattgagtttcgtggggagattttgcgggaacagcggtgggcaaactttggtcatatgggggagaggagaaagagaggggggaggatctgcaatgagagttttcaggatagttttgtgattgatgttttccgttatgatttcacttatattgtaatcgtcacaaagactttctaggatattttctgggcaggcccccccccatcagagagcggcttcatcttaaattccttcgcgcccttctggtctcatccatttctcccccaattacatctcaaacaatgcttaaagcaaagaaaagtcctttattgcctccgctaaagctgtttcgtgagatacttagagctcatagacaacttcccgcattgcaaagatccttaggtgatagttatgtcaaacaggagtttaaactacacaagaatacggataacccaatccacattgttggttttctacaaagctggcaagattaccttcaaatgatctctgacggccagtggaaagattacaagttatccaaacaggaactagacaaaatgtcacctgaacaggtcggccagctatatgagttgatgaaagagacacagaacttctagaggacttgtgcgtcccctatctctctccttctgctgggcggagcgagcagaactggaactggtctcgtttttactgaggtactgatgtttaccctgttagacatcaacattttttctctcatttccctcacaccgacactttaccaagttcatacaatggagttggccagcgtccaagagataaaagggtttgttgtgcttcctgttctgtttcacgcacccagcgggaaggtacccaaggccgcacattacatttacataaaaaaacattcttccaaggatgaaggattatcttccaggtcccttttcatagttaacattcccttaggatcaggattagccaccttaaaacagttttttgggaaacatgccacaggcgccataatagaaagttttgtagagtgcaagaaggactccagcataaatttagccaagttaacctcagatttggttactcataaacaatctccatttccacatctcccaaaccattgttctttgatcacattcattgaccaagatgcttgtgatttagcttaccaatgtatcaaaaagcttgtaaagtcatccagatgccccgtgtggactttggctgaccctctggggtctgcaagatataggaaactggcccaatctcatatattggacattgcccaattgaacagatccatcttccaagacatgtcagagttcaatagaagagaggaaacaagttacgaggaattgagtaaattaggatccaccgtagatgaagatggtttcataacagttgttggaccccacaagaaaaccagagatgagatattgggtagggtcaagaccaacaactctgagattcttgcccaggctcaggaaaagatgaagaagaaggaaaaacaagatttctacaagttccaaatccgagagaagaaaaagctggaaatgaacgacttgttgaaaaaattcaaggacgaccaggagaagatcaaggtgatgaaagaacgtaaacggttcagaccgtactaaaggaaaagagaatgatacctctttcttctcttttcatactttgcataactcatattacaattatctgtaacaatatcggtagactttatattataattcataatctccctccaggggtttcaatatggttctgatcgtcattattagtgtcaatttgacgaagcatgattgcaggattctgtttctgatctttgagttccttgaagatactcccaggtttttcatgtaagcctagtactcgttcttcatctccatagcagatgaccaaagcatacttgcgccaatcatctaccgataagccatgtcttttcatggcattctgaatcaccttatagcaaggctcatctgctttaactctcaacggcttcaatagttcgttctcagtatgttcctgtgatcctgacgaagcagatctaagattgggtctttctccattcagagtttcaaaattccccgtcgaaggagatgatgatgacacattcaggtgttcaccagttggagacaaagcatgtgattgtcttctggaggataatgtaggtttcctcccgagagattgccctgcaactgcagagttcactccttcgccagcattgatggtgcttagactggggttagacaatgttgactcacctgaagtatgctccacaggagatgctggtactgaacccatatttgcgaaatgtgtattctctggagtgggtaatggttgggtctccttgatccatttgaatatcggcaaaagatctttgcgaagcttattaaactgttcagtgagccttctgttattcgaatgatgagtggaatcatctacaacattctttctgttcgccatctgggttatgaatttattagtcagtatcaaagttcctagctcggtagcggtgtctgatagaatactggtatcaatgtgcttttcattgctcacaagaagttcatgaatgttcttttttatagagattctgtgcttgagctcgttgatcccaatttccttcagatcttcagacttcaagtagggtagaacatctcccgcaatgtcatgttctaaaaaattttggagtagacttggatcgatctcaggaatagtctcccctatccaggacgatacatgaatacttgtccaattgagcacgttatctggccgcttagaagtgacatagtccgtcataggaacccttgtatgtggttaaagaaaacgtgtggaagagatgaattaagggtcgattaagcgcagtgtgagcaaaatgttaagtttgacttggaggaatccctaaaggtacgaaatcctatttttggattccaccaactaaactgaggaatgcactccaagacaataaagaacaaaaagttcggggcgagctgggaattgaacccagggcctctcgcacccaaagcgagaatcataccactagaccacacgcccgataatgatgtttagaatgactgatgaccactatttctgaacaaagagtatctgaaaaaaaaaaccttttttaacctccagcgtgctgaagattaataggcccgtgatgatgacaatacattttccaagttgaagcaaacaaagaaaaacaaaatcggggcgagctgggaattgaacccagggcctctcgcacccaaagcgagaatcataccactagaccacacgcccatgatctaaaccaaaagtactgctgtacactatagtgtaaaaacaagccttctttcatcactaatttattgttgccagattagtaacataaggctagctatttgatcgtgtgcacttttcgctttgatctacagcagtcttgacgtcaatgtcttacttcagatcaagaggtggtataaaggtctcgcgtttgtgatttttgtcattaaactctctgctatgacaaaggctaagcattcaaatattttggcaccagatatcttgaactcctcaatcttcactagccatgctgtttgtgaccaaacagttgaattgctgaaagctattactagtcgtttcaaaactcttttcgacctacttaaggttcaactaaagaagtgtccatctattgacaatgaaaaggccctaaagaagcttctgaatttatacgatagtggagctttggtaaatctacttgtaatggggtttaatatcttcttgaatcaacatatttatggaaaactggtcctctcgtctatcttattcctctcctttttcatactgagttgtctaggcttaatcgtgttaaacaagctgaaagtagaatcggcttccagctttacaaaacagtgccgccctatacaggaaccgctaacctctcatattcaagagtccattgatgtttctatcgacttgaaaaactttattccgaaagtttctcctaattctggagagatcccaaacaatttagagttgcaatcaattgaaattgaaaaaactacccaattttcagatgaagaaaaaaaacaaacggtagaaagagttcgattagtttaccgaagattgaatcaaagtgtattttggtctctctaccgattgatactaaaaggcaaccaagaaacgttattgaggaagtttaatcttgaaaaatgattccaagccaagcaagaaagggggagacttaggtccgcaaataaataataagcatatatacaatggataaaaaaacctttctatttagttttggtacgatctctgacaacctcttctaataacttatcgtatgccttatcgacagcttcctcatcctcaggattcaaacgtggttctgctgagctggattcatcaacttcagatttattcatagactcttgtgaatccatcatgttggcagaagctgttttttggctggctatgttactttgggatgcactgggtgataataactctggttgtggttcacgttgagcattactaaccagtttataaatcgtctctaattcttgattttcactgtttattctctcaatgagttcgtcaatactttcaatacctttaagtttgagtagggctgccttcaactgagatccggagggaatcttccctgaaattggcacccaagcatttccgtttggagttttgattgatacatcttcaggtaactgactcttactgtcttcgtctacaattgcactattatcctccagtttcagcttcgccacatcatcaaatggatttgaggttggcagctgggcattctgttgttgcacaaagaatccccatttatggaactcaccttcctcttcctcttgtagttttccttgggtggaataggagcttgatcttctcatcagtactggttttccagtgctactatctacaggaacgttcaggccatcctgagtagtgtcaataaccacattatgaggtgcttcagcatcgaatgactgagtggcgctaaagtaaccaggttctttcgattctgcataatgaaggtgcggcgaaaggattggacctgattgaataacagctgaagcaaccgcgtctgtctttgcagccgaagatcggtcattgctattagaaggtattttttccagtgctctattctcatccaataggttgagcactttctccaaagaattgtccaataaacataatcgtagcaacgtttccttgtcttccagcgatatttttccctgtagtctcttttcaaaaagttcgtcaatacgagaatggagttgtttttgaaggtattctgttgattgaaggaaaccagcaatcttagattcctgggttaataaggatttctcacttgcagaagaagagccatctttgttcaacaatttttctgcagtttttgtcaatatcgaagcgtcgaagaatatgtcatcttcaaatttgaggttgaaatccttgttgattgacttttgcatgttaatcatcatatagatagcaattttagaagtcagttcctcgtcctcaatttgatcgaattcaatgtccaaagtgtggatattagatcttctaatggctgtgtataaggtggctatagtggcataatcatgagcttcaggattacccaagaacgaaacatgaatcaattctttgcaatccgggaaggcgcttgaaatggcaataacttcgtccgaagttaggtcagctaattcaaaatgaactctacgcaggcttttgtacttgggaagatactgagttaacgttggaatcaccttggggaagatcttcggatttccacttagatcaagaaatcgtaatgactccacatttactaatgattcaatgaatctattcgcaatttcaggagtcaaatttgtggagtttaaggatagaaagtttagctttgtagcctttttagcagtgaaaacatcaatcaatggttgtaccaattccaacgtactaaagtcgttgaaacctaaatcaattccacagcacgtggaagtaggttgagaaatccaacgacatagcacatccattttttctagatttagtccggcgttggcgacacccaaacgtaaggtcgataaagacaccccgttcgtcaacaaataatcaaaatcaggaaaggttaggttacatccattgataacgagctcacagatgccacctcgaacagaaagagcatctgttaacagtttccagtttcgtttacttctgctatgtgttttcgaaagttcagatttgattttttgttgcgaaagatcaagcttggttatggatttgttattcatcaaaaacttggataagaagagccatccttcctcgttaatcgggacatttcgaagagacaatttttctagccatcgagagttgaccaaactagaaagaatgacttttaacatctggtgagttaaaaacacattgtccaatatgaccgttgtgatgggggttatggctaaaaaatccgaaaaagatagaacatcaatcaatgtaggctttggatttaaaagtttcagaacttgtaaaggagcggatttattggccagctgtttcagagtcgccgggataggaaggatttccctcaaatgacaacatcttgtatatatcagttccaaagttggttcctcactcttctcagattccttcttctgcttttggaagtaatctacgtgttgatgaatcggactatcgattgccacatgagtaggaggggatgacactgaaaatgggactttaggatcttgttgggatgaaaatcctttggatgtttttgagctattcagatatgaagcggtttctttggcaagctgccgagcagaatgatgagcttccaatgcatgtttttcagattctttgcaagccttttcacgactttcaacagcgagcttcagctctctttcgtcaactttcgaatgttcatcagtactcagactgattccaatgttcaattttggaatgcctcctacaagatcatttggaaccaatacatttcctcttctgggttttcttgaaggaatctgctgttgtggatcatcttgcagcttttgaacagcaaatgttactcttttcaatgaaactgtggacaaagcaccagcgttagggagcttttccgaggtttccagccgtgttaaatgagctaaaccggtctcactcgttggtgaagttgaaattgaaggagtggacggtgttgacaaaggagatttatcggacttctcggctcctctttttcgtcttccaaaaatgcctttatccaatgaactggtagaattgctaccgactgtttgcccggcttttagttttgatgatagcgatgaaaataacgacttcttaccagtggaagaacatcgggataaaccttcacctccactactagtagatctgttaggaacaggcatattcctgggctcagtaggaagttgttgaacagtaccggtagacaacgatcttcgtctggtactaccatcatgctgtgcttcctgtctagaagacgtaaggtcggtcttacttttaatgatccctctaggtgccgacttgggctcagagtccacctttgtgaaacccgccatgggttcttttgaagcagaaactccaggaatctggatggaaaaattctcaactttatcattcaagccaaggctcttctttaccagctcggaagatttgatatcggtggctcttttagcaagtttctttccctgtttcccacggaatagccaatcgacatctccattgctaacaccattctgcgatgtttcagacatccacaaatgttaaaattatcacagttgggaatgaaaagccttataaatatcaattgtgtgtcagaaaggcaaaattataaagtaaatccgaaatttcggaagacaatgggctaaagaagacaataagagacagacttggatgctcgctcgcaggccaggcgcgtgggggactacctttcagaacaaagattacgtaatcgattagctaatcaaaaatgtggaaacgtgatcaggatgaaatgtgattcgtcatttaactatacgattcaatacacaagaaaaaattagaaagatagagcttagttctcagccttgaaagaagcgatcttggcggcgatcttagcttgtctctcctctttggtaagcttaacttgtctgtacttcttggacacagcagcatattgttccttggtgtacttcttctcagttggcttgaaagatgggtcctctctgatagcctcgtgagcagccaagtagatgtcttcaatagcgtcagcctcgatgtcatcagccaagtatcccttgaacaattgtctgaacttctcttcatcgtcgtcagccaactcctccatgtactcagcgacgtgaccaccgaagatgtactttctcaataactcagcatcaagttcttcaccttcaatgtcccaacctgggaatctgttaggagagtgaggaatgtacaaaccaccgtcggaggcacccttcaaagcaccaaagaccctggcaccggtggtagttctttgcaaaccaacatccaagaaaaccttgaatggtcttgggccatcctcaacagcctcagtgagctcgaactcaccctcgacctcttcaacacccttataggtctcgtccaacttgagtttttgcaaggctcttctggcaaccaaaagaccggtagcgtaggcagcggaccagttggtcagaccgtgctcaattccgtatcttggcaactcgtgggagtaagcggaggtgaacacaacatcaccagtcaaagtggaagagatgatttggcagatgatgtccttgtgggtaaatctaacgaccaatctgtactttggagaaccgtacttgttcttgtgttgagtgaccaatctctttctttggtagtagtcggtcttaccctctcttcttcttctgaagggagtctggtaacgagagtggtaagcagcagtcttctggatcttttggaaaggcatttctgggatatagtgctgatgaaagaagaagaaaaaaaaatcacttcactctttttttttttagcgacgttcgccgggtgccagagtgaaaaatcgagggtatgtttgtttcctggtttggagctgagtgggtgtgctgattattgcataccagtatggattatacgcacagcacgcgatttggggtgcgaaagagtgagaaatagtcaaaagagggtgaagcggaagcctatgggggtgaagaagaggagatcacggaaagaagggggtggctgtgatgaaatatactttagcaaagaattaacgttgatggattgagctttcatcaaagtctggagggacataacgtcaacagagggtgatcattgggggtctggaaattagtcctagatttccgagatattggcggggatatccattataccgtagcggaacccgaatcgtaatcttaatctgagagttcaagaggcaggatgtgttgtagggcgaagtaaaggtgcatgggagggcaaaataaaaataattgctatcaaagattcaccccaggtcggctaatcgaaagactggctctaattctcctgatattgcagtttgtcgtctagtagatgatgttcccatccaatggagttgcacggtctaggaacgtcttttttagggatggagagccagtcggattgggataattgttcctcacgatcggaaatatggctgaggttaggagaaatgggatattcaaaacacgaaccccataaactatcagcatttttgggatttcattgggggtacctccctacggaatagggaaaccggttgtccttttttcgaggataggaggggtgaattcccgcaagtttgtgcaataaaaggagggaaaaaaagaaatgttcgatgagtcaagaataccatataagaacagttgagaccccctttctctatcgccaacacaacaaactcactttcactcaaatcaatcataaatcaaagatgttctctaagcaaccatctactacagccgtcgacaaggccctctttggtgccgagaaggagaagcaaattatgactgagatcagaaacgctcaacaatccaaccaaaggaaggttgcatacgaaagctcttttttgggtgattttattagtttcgctttcagatccaaggaataagtgggtacgaaggtatggctgattgccggtgtatattataagtctaatgaatgaagtgataattgaggtcgcacttgtagaatacgcggttatctgggtaggatttaggactgtggggcagctacatgggctacctgcaagcgtaatgggggatatgagacaagatgacgaccaaaccgttgcagcatggttttcgtacattcagggaaatgggttcacaattttgatgaatcggtgtcacccctagtgtgaactctcgcatcttgcatctcgcatctcacatctcacatccagcatccagatacaaaactttaccatccaccatcgaacatcttgaacgacatccgttagtgacatcaacacccgacatgttgccttattgatttgccaaatcggctttacagaggtcatcgcgcattggctgacgcattactatcgcgccttctgtcagctgtcagttcttcgtactttctctatctcctctttgttgctgccgagcccaagagctgcaaacaaagatgaccaaaacgtccagatcggtggatctgcattttcctaattccacatcaccgtgcgtgctgctttttttggtagactcttgtagagacctttcttagtacgtcgaagtgtaggttttcctcctatcagctctcccaccatatcatgtgtggtgtttctcatttcttttttgccttggttctgtttctcaccttttccagctcggtgatgtcaggatctgacttctctatctactgccatctgttaaatccactaccataccagttaatccctcttccatttacagaaaatttcttcgctatggctctccgtttcggtggacggctttccaaaatggggtgagttcgtgcggctcatgaccggagaaaccagtagacggcgttcgctccgaaaactattgtaattttgtccatcatggcgaatattcaccgaagatttaggagatgagtcggctctggctgtgtgtggggtttatcttttgtcagtgtttcttgatcggctagaaaactgattggaatgaccagttttgacgtagcatttaaaaaccgcaagagatgcttctgtttcattgctgcatttttttcttatcttcaaagcctagaaaaataaaaagaaatcacaaattgatttctgaaaaaaaaaaataaaaaaagtctgaaggtttgaccaatatatctaggctgtagactgctcttctgttacactaataatctttagctattgtgttagaagcctaaaatggagaagaaagaatcgaccatcacaggtgtttatgatgaggagcactcatcaaatttcctctcagagacaggagagattaagaaagtcaagcgtgggcttgaggaaagacatgttgctatgattgcccttggtggaaccattggtactggtttgttcattggtatttctactcctttgaaaaatgctggtccagttaatgccctaattgcttatatctacatggccacattggccttctcagtcacccaatcgctgggagaacttgcaacccactccccaattgctggttcattttgtaccttcaatactcgttatctgtcaaaagctttaggattctccaccaactggtgttattggttcacttgggccatcacatttgccatcgaattgtccatcgttgggcagattatcgaatattggacttatgctgttcctatcggtgcttggatagctatattctttgtcattttgattggtaccaacttgttcccagtgtctttctacggtgaactcgagttttggatcgcttctatcaaagttattgctatcattggtttcattctctatgcctttatcatggtttgtggtgctggtcaaacaggtcctgttggtttccgttactggaggaacccaggcccttgggggccaggtatcctagtgtccaacgttaacactggtagattccttggttggttatcttctctaattaacgctgctttcacatatcaaggtgtcgaattgactggtatctctgctggtgaagctgccaacccaagaagggcagttccaagagccattaacaaagttatttacagaattctgattttctacctcttgacactgttcttcattggtcttttggttccgtacaatgatccagcattaaactcaactgaaaatttcatctcatcatctccatttttaatttccattcaaaactcaggaaccaaagttttaccagatattttcaatgcggtcatcctaatgacagtgataagtgcaggtaactctaacatctacattggttctcgtattctatattccatgggtgattcaggtaacgcaccaaaatgcttcttatgggtgaccaagtggggaactccttacgtcggggttatattcaccggtatatttggactcttggctttcttgaatctttctgaggatggtgccaccgttttcgactggcttgtcaatatcacagctgtggccggtcttattgcatggatgttcatttctgtctcacacatccgattcatgcatatcttaagaagaagaggttcatctagagatgagttgccttacaaggcaaaatggatgccatggtttgcgtggtacgctgcaattaacattttcgttatcttgttcatccaaggattcgaggccttctttgattttactgccactaaattcttcacagcttatatttcattgatcttgttcgtcgtcttatggataggttcacagttctccctatacaagaatgacccatggctcattcctatcgatgaggttgacatcgactcagaaaagaggaaggttgatgaagaaatatgggaagaggaacctcctaaaaccttatggggtaaaatttggcaaaccatcttatagaaagagtatcaatcatcaaaagaaccgatgggcgggcgggacttactccgctaccgcatatatatctttcatttactgcgtaatttaactttttgtatacattttttgtccattattattattctattttactagtacactttcctgttccaaaaccttttcaatttgagagacgatttgctttagagtcttggaagaacccttcactttcttgatcaccaactcggacctcacccccttgcttctgtcaatgagttcctttataacaatctggaacctgcatgccttcagtcccgtagagttgtgcttggatactgcagctataatctttgaatcatatcttgacaatgtgatgtctttaactccatactgtttccagccgattaataaagaattcagtgcttcgaacatatctggccttttcaatttacttttaataaagctgagttcctgagtgtcaccattggatgtagatctgaaccagtcagagaacctccttcgttgttgagattgagactctcccgattcttcaacctgcttgctaccgaaggaaattttcctcaagaaggatgatttctttcgctgcttagggatgtctagggtttcatcatttgagacatcattcaaaactctccttgtgggttccgacttattcctcgtaatagatccatcattggccttgtgttgctttattggttgtactttctcgctggttgctcgttgcttctgttcacctgatttatctttctgagtatcgtcatggatctcaaaagatagttccttcttgactggagacgatgggatatctggtaatgatagtttcttatagtaatctttattagagtcctgtgaaatcaaagtatctttgctaggcttataatgtaagttgggtttgttgtccatgatttctccaatctgatctctttcttcctctttctctagttcttcaactctacggtcgttaatgtcggtgcttgccaagtttttatcaacaacttgcccataagtttgatcaaagtcattgtttgctttctgtgcggaaatatcaatgctcatgtcgatttcatcatcctccttgaatatcaaactatttctagtagatcttttattggtgaaggcagatgtggatgaagtgacgttctgtctatcttgtagctttgcgtttaagtcacggtatgaggacttcgtagaatagacggaaagcacgcttaatcttttgttcgaattggagaagtgtcttgattttctggtcacctgagggatcttaatatcagataacctagtctgagcaccatctatcacagcagactctctataattcttatttttctcggtagcctgtttgcttatgatagagtttaaatcaaatttgctcgtcaataatcttgactgcctcatctcatccaagaattcgtttgccacatgtaaagaagcgtcagaagactttagataatcatccgactctggagcagtctgagattgggaaacctgtggaatggaaggaagggatttcttgagatcctgttgtggctcagtctcttccttttttttcccttgactatcaggcacttctaattctttagctgcatcctgagaggtacgtttgtagttttcatatacttgatatctaggatcaagcctcgacacgggtcttggtgggatctgcttgtctttagatctcttagaattgacttgcaatgacattgaacgtcgcttgatgtcctcaatatcgtccttatttaacaagtaggaatccctcttcttttgaggactcgatactgctctcactggttgatattggatatcagtggataagacctctccattttcattctcaactttggtcaccaatactgattgtcgttttgcacttaatagagattgacgctttctggatttcttttggctctttagctctagttcttcttcctgcaaaaactcgttgaaatctacatcttctccactgaaaattctttcacaaagagttgcgaaattggaagaggtccgtcttgtggatctttccatataatcatattgaggttctgaggctagcttagcatatgttgatatgatgcgagatgtgatggagtttctcttcatagcactctttcttttattgggagagttcgaagccttcttaccctttataggagaactactgcctgtggatgaggtgttggagaaaaaaagagatgatcttttcgagttgagtgacagcattgataatctctttgaagtaaccgaaatcatagacgaacgcttgtttgccttgggtgaatgagaggacttcttctctgcaacatgctttggaagagcaggaaggggtggtaattgattaggcttggagggagctttcctcataggagtcaaagaactaagtcggcttaaagaagctgaacttggctggctgtttggagatggaataactttattgatagagttggccattgatagtgattgtgaaagatctttatcctggtgatcatgcctgtagtgtagtaatagagagtagaaagttttctctgggttctgttcattttcaactagtaaagattgaatgatttgttcagctggcctaccgtgccacagaatcgtgagattctgaaggatcttgtcgtcaatatcttctctgcagctgacaggtttgatggacaaatcgggagagggcaacctttccattgcatgttgttccatctctgtgcacggatacttcaataataaaggatgtttgagaatatcctgagtctttattctttcctcaggagctaatttgagcatctgagcaataagattttgggcttctggagacaagcttgaaggcatttcaaaagcacctttttgaactttaagtaatagatttctaatattttcatcatcaaatggtaatcttccagttaatagtgcgaacagaatgacaccacatgaccaaacatcagaggcagaaccttggtatttcaaaccactaacgatttcaggggaagcataatggggagaaccacatgaagtttccaacagcctgccattcgcttctagtgcggccattccaaaatcggcaatcttaatgctcagatctttattaagtagtaagttttcaggtttcaagtctctatggcatattcctagggcgtgacagtacgaagctcctgcaattatctgtctgaagaacttaacagcgtctttctctaacaatggcccactttcgaccagtaaatcaaacaattctccaccttctacaaactccaaaaccaaatacaaagcctttgaagtctcccatacatcgtatagtctcaacacattttggtggtttagcaatttcatgatgataatctccctttcgatcccatatggtaatccaacagagtcacagcctttctcattgagctcacgagattcttcatttagatttgatttattgaccactttgacagcagccttctgaccggtggatgtatgtgttgcaagcaaaactcttccagtcgaacctctacctagagtctttcccagtctccaaggcccgatgtattgagggtgagacttgataggtggagttccattgtggatacctaatccattggcaggtgcaaatgaggatgccaacgatggttgtctcgaatgaaacgatatagaagtcattaagtgatcgaactttagttggtttgtgttgagggtaagaagagcttcccaggaattcaaggtatttggaactaaagtgctattcctgttttaggtaaaaaaaaacgttgacgcgttttcgcgcgcggaagggatgaaatctatttagtactggcagggtaaaatgccaactgaacgtggcataaaacagagtatacgatggcttgcgctctattgcattgtggtgcattatgtcctgtgagtttaatgaagacattgggccggccgttttatttttttgcttcgacttaacttcatacaatattttgaggctccttgcaccaatccaccggaggcccactcgtcttaggttcattgcatttctccgaagtcacagatggaaagaaccaatagtacgtgcctgcacccactaagcctcctagaaggcctcctaggagaatatctttgaagtgatgtctgtaatcttgagttctcgatatgcaaatttgaacagcaaaccataggggaagagttagtagtaactgagaggctttggagctaccatgtaacactctagattgaccatatgcatataaagtcagccacactagaccacaaagggcaaaacttgagtgtccagaaggcgtagacttgaatccgtctagaaatactgcgtctccgtacggacgggtgcagacccttaacgggtcaacaatgatcgccgtttctgttagtgctccctttggtgttctatcaggaccacatctagcaacaaaatctggtcttggctttcctattaacgtcttgaggaattccgtgcttataccattcagagccacagcgaatccgaaactaagcaatgacatgtgccaaacgtagaactgttttgcatttctccaaccgtttaaagccagccacgttgagttgtatacacatatgcagaagaaaggaaggaatacggcggcagaaaacagtttaagatctgagtattgttgtttggcaatgaaagggaaattaatggtgggatctgttaattggactgccctgatgaaagggggcttataccactcgatcaatttggcagtcaagagaagaacgaataccaaaagccattctagtggatatttgattgatacagggatgaacatgcgatgagttgagaagagtccaagtcgctcaagaacctagttattagcgaaaagtattgcggaagtatgggtggggtgagatctatctataggcgagttggggttatgcgatgacaccaacaaactagaggacctacaccgtcggagaaacaatctagatcattcctactatttttattcttaccagctcaaaccgaatatttaaatttgctgaatgtgacccccttagttcacctgcccaacacgatacaatcccattttagttttttgtcctcctgttcgtttcttttcttttactctgtttcttccccctggactggaaagaatggcctcttcaatccatttaaccatccaattctacttcaaacattgagataagattgttaaaaatacgtccatgaaaatccgttggtgcaagagttttgaatccatctttggatgtcaattctttgggaatttcatctttcacaatagtctttgctattccacgatgatccgtttctataggaagaatagcacataaccaaattcgtgtcttatacactttgaaaagctcctttattagtccacggaaatccaaacgacgttcgctgaagtagtaaattattaactttttccgatcaaattgaaactcaacattcttaacttgaatatcaagtttcaatgatgctacgtatcgaaggcatagcttatgagcggtcaattcatcattgaatttgtctaccaaaagctgtatttctgaaggcttcacgaatctaagcacctgtttgtttggcaaggtgacaaaattctcatcttcgttgatcatagttggtttcttggaaattgctgaagaatcaggttgaactgaggggattctttgctgtccacactttaaactctttagatgaagtttttttttgagatagttaaacagaattgccacgttttgagaaactactggttcaactatcgtcaccaagtccttacctctatcgccttctatcaccactaagtcatgtttttcgaatcgcaagttggaatgttttgcaacggagattaaatctactctaccatttttacagcttatcatcgagaagtttctgctttggaaccttagatcttcgttattattcttcaaaaaatccaatagtcctaccactctttgatctttcagtagcatattcagtcgttgtgttacttggtcgcaagtctctgcgtttccaaaataacttctggcattgcagtattcatcatgaagttgagaagaggcaattatttggtttctcagcaggcctaacccattgtccaaggccgttgccgcaatttctgtgtttccatccaaactttgtgagctaactcttctagtagacgtttgaggataataatgggagtaactgctccaagatgatctttgctggattggattgcttatacctctacctctactagggaaaggatcgatccaactgttgcttaaatcaccattcttcttgctggtgttctcttcatgtgctgccacctccccaatccctgaatatgcttcagctctattcaaattctgaaagtagaattccctctcccaatgagaccactgatcagaaactccatcgtcattcactacaggtccagacacctcagtctgacaattttcccagatatctttattataactcatcaaaccagcatcaatgtttctagatttcctttcctttgctttttcacttctctctctcccccacacctttatacgagtcttctctagaaggtctaacaaaatagcctaaaagcttatagcatagcaattatgaaattaaatatagaacttaggatattataagcaacttagatatataggaaagcgcgtaggtacattatttttttagagtgggcttcttccagtaatactgtttgtgctgctttctacagttacgaatgctggaatttccttttaagttgttcactaaggaaacccgaccactgtcatcatccttatcaacatcgtagtagtactcttcgtccaatagctcacctgcagcatctttaccagatctgtagatcacaccgatgcacggaatctttttgatcaaaatcacccgcaattgtcgcttggtgagaacctgcgtcctttgagacactttctgcaaatccctgagtggtgttgactgtaatctagagaatgctagatggttaatcaaaatcttacatatctcgtgaagatcgtcttctgtcacgtgctgtaagaatccgtcaatctcttcgtcagtgagatgggccattaaaagttggtcattatcgtctctggttgctcgcttggttttcctagccggagttgcaggggaagctgctcgactttttgtttgtgggatggatgaacggtctgatattgacgatgtttgcggtggtttctcagcttttctcttacgagctccgtcaactatcaccttcatcacttcccccttaatgtcaaaaataacaccttcatggtaagggaacacaatcgtttcatccttaaacatgttgaaattggtgaggaatttgtcatgaatcatgtatctgcttagtttgtactcattgttgacctctgtaaactgcacgtcaagtttatatgggatggttacgttgacaccattgtggccaagaactcgtaccttaagatcatccgtgttattatcgtatgataactggatatggcaccttgaaatctgtttattattagacagcttgaagtcattttttgaagatcggccaattgaaacctcttcaccagagccaggtatgcgaatgattggtgtggtctcttcaacaagactttcatggacatcttcttgcgcagtttgcttagtgacctctggatcaacttttgaaacttcagccaaactatttggtatggcctcgttcatttcagtgtgccttcccgtggtagaggaaggatttggagtgggatagaactcatgaagatgatcaagaaccgattcatcttccacagtctctatcacttttggtcttggatcaatattctccttgtcttccaagacaggagacgatggagggaattggtacgacatgtgtggtgtaggtggctggtaagtacctgattttttttactagatattctattatgggcacgcgtatacaagaaatagaacgcgcttcacgtaagcatcacaacaacaaacaaaaagatgcgatcatccgacatcttgttacgcgaatttttatacaaagagttccaaacatcagaagctacgatttgtttctagggctggaaaccctactgagaatcacacgcttttttttaccttctttcctaatatagccgcagtcgtgaaaaattatctcgacctagccaacttcctcaaatccattcttcctacctaaacacatcttcataagaaacagacaatatgacaagtacgtagactaagaccaggttgtccaggattgctaaaatacggatcgttgatggttgacctctaaagagctggttccacgacttcctgtttgaagaaatataccaggcaacttacaagcaaaccttcgaagaatcacaatactaacacccaactatagaaggtactccatcctttggtaagaaaaacaacaagtcacacaccctctgcagaagatgtggtcgccgttctttccacatccagaagaagacttgttcttcctgtggttacccagccgccaagatgagatcttacaactggggtgctaaggctaagagaagaagaactactggtactggtcgtatgcaatacttgaagcacatgtcaagaagattcaacaacggtttgacctctgagtctaagaactaagtattctaatattgtacatgaatcataatttgagaaactattagttacttattacacatctccttacacgtggtcctgtcctggcctgaatgaagggtttagaatgctgtcgtacagctcgtctgcatcttcactggtcacatatttacctaggatgtctttgctgagttcgatcgtcttgtcgtcgtaggggacttctaatccgttgctggtttctatttccaggtagtataactgtgtcggatttgtttctttaaaatcttgaattaatggtactcggttacgtttcttcaaccttaaatcgtgaccaaactcacagaatgaagtgtgcaagttaggtatcttactaaacgtaatcttagctagcaccactataaggtctgctaggacctcactgggtaaagtgctgatagcgtctggaaggttgctagtttgatcgtaaactctggtgtgaatggtttctatcatgacattgattagcttcaagcgtaagtggttgctgtggcatctaggaaacctggttatgtaattctgttgaattccaatcaatttgcatagctccggtattatgtcgttgctttgcagctggaattgtgccttctgcattagttttaatgctttcaatttgaattgaagtacgttcatattgaacctagaaataaattggccatctgaatcatagttggttaattgttcaaaagttgacagagaaattggcgatagagcttgaggaagcccgaagagaatggttttcaaaagttgtacatcattattgtttcccagttgatcattcaaaccatacatgttgtaagatttgatggaatccatctggacatttagtagtctaacaaatgggaccaggtaggtccctagccgagcttcagaagaaatcgattcaagtatatcgaggtaattaatcaacaatttaactggagtctgtgtggatactgggaatcgatccaatcgttcaataatatctttttccaatccatgaaattcaaacactctgctgattgtaactaatgtgtccatagcatagaccactgccagtttcttcaaatactcatcttgcaaattggtataaactggttcaaacaattcgactaacttcgtatactttttgaaaacaccaatatagtgtaagatcttgtcacacacttgctctacaatgtccaactgacctttcagagcggctggtctgtagcttattcctgaattgatgagagaaagaattaagcttatcactattggttcatcctgggtgtttaacacatctaataacagttgcaaatagaacgaaaccagctcgtctaacctttccagattacaattgattaggcttcccaagataaaatcttttaaagttttttggggtgcaatgtgggagaatttctccaatatgtccaatgtgcaataatttaaaccagatatggaaagattcgtaacgtgttccaagaacaacgacttttcatttggaagaaccggtagatagtgaatgatcgtagttgaggggttgcctatctgtgaacttgataaatcagtagtgttatcaacagattgtgttgaggatatctttcttttcttggaatttaggtactcttgatgcaggctttgtttttcattcttgaggaacttcttttcatcctctaaccgaacaatgtcgttcttcagagattcaatttgttcatttaatgcacccatgttcgtttcctgtttcttcaaagcttgctggaaacgatcatgtattcctttgatctctttatcatgagttcggttgatgctttcaatcttggatctaagaatgctattctctccctgcaacatcatatccttgtcaggaggaggccctgttagagctaccagctgattgtccagctcttggtcatcaaagtcgtcaaaaccatcaatgttatcctggtccatatgaagttcaaaggtttaattctttatttactaaatcatttatgaatagcgcgatagcccaatttttcctggttctcccctactaactttgactccacccttcagctgctgggcggaacttcttcttcttttcgaagcaggaaaaagacagcgggagagaaaaaaaaaacttccatcaggtccaaaatttctcttccctcatcatccactcaatatggtagaagactccaaacaaagagacaccagaacaaaagtggagatcccagaggcctctttggttcctcagagacccacagttctaacttcaaaagataaaacaacacagagattgatagtcgtgctctcccaagccagcttggaaactcataggatgacatcttcaggacataatgacaagtatgcattgttaaattgcgatgaccaccaagcactactcaggaaaatgagcagagacatcagtgaagctagacctgatatcacacatcaatgtctgttgactctattggattcccctataaataaagctggaaagcttcaagtatacattcagacggcaaagggtgtcctgatcgaagttaatcctacagtacgtataccgaggacatttaagagattttctggcctgatggttcagttattgcataagcttagtatcaggtctgtcaattccgaagagaaacttctcaaagtaatcaagaacccgatcacggaccatcttcctaccaaatgccgtaagattactctttcttttgacgccgaagttgtcaaagtgtcatcatacattgaaaaactggcctctgacgagagtatatgtgtatttgtaggtgcaatggccagaggtaaagacgattttgccgatgaattcgttgacgagaagattggtgtgtccgagtacccattgagtgcgtcagtagcatgctctaagttctgccatggagcagaggacgcttggtccattctttagaagtgttcagcactatatagattatgtatacacaacattacgtcatgtttcttcagccttagccacttgggatgttgaaatgcggctcgctgcactgggtgggacgccgctttatcatatactctttgtgaacaggacaaaggaacctaaggtgtatttggtataaaagggcccagatccctcgttattaatcctctgtcttgtttgcctccttatttcatttttttcttgtcattgcttcctccccttctagctaaggatgcccgtattcgaagcaccagcggtgtatgttcagaatgcatacaacacgctgaataactacatgattcaccacatgtacctctctaacctcatagatttccatcattccaatggtaatgtaataccactggaaagtcccactgttggatttcatgtccgtagagataacaatgataagcaaagaatagttaatgtttttgatcacaatggtcaattgagatacaccttcgagcgtttatcctcgttgaacccagtatggtccatgtttgattccagccgaagggagatagccactgtacgagttggcttttttagcagatcgatcgatttccacaacaagcctggggtgctgcaacacagagagatcaagacagtatccaattggcgtcagggtaccttggattacattaatcttcaaggtaacatgcttgcatggaccaaaaactccaagttcttggaaatcattaccaatgttgacgataacgatgaagaaatcagagtgagagccgcccgagtacgtctgatgcgtcaatggaaatttgactttgagttggtggttgatgaatctagagtcgacgcagagatagccctgggcactgggtttgtctctatgatgacaaggtggggcgtcggtgatctcactgatacgcggggtcctactccaatcgttgcaccagcgctacatactcagtcaaagtcggagcctaagtcagagacgacgaacgggaacacaaacaactcgtcttctcccaattccatcacactagttgtaaacgatgatgagatcattattgagcattagttgccatgaatgagaataggagacatttttccttaagttcgctcagagtcacgcgaggttctttctctttccattccggccgcaccccacccatgcatccctttcgaactttgaaccgggagtataaattcgcaccttacactcgttgcacttctccacctaagtattactcccccagtatttttgccgagcccacgagagaaacattatgtgccaaactgccatatgcccactttgcaatcgcaaatcatggactggatgtggccagcacatcccatcagccatgagtaacactagacaagaattgtggtgtacttgtactcacatactggatacaaactatccacaataccctccccgcgctggtacggggtctgctcgtcgttctatttccgagtaggataacttgatatatgaagttctatgggttatgagatgatgaataactgagttcaaggaaattgccagataagttagtaagggtttcaatgtgtgtaggatgaaatttatggttttgatggaaaatcgtcgtaggagcaaaatccatgataccccgagcgggtgatgtctttgttatctggtgttgttatctgttatctgtgcggctcctatcttttctaggttctctacctaagttttatgagccgcgcgacatatcgaatgttgttggagatgagaactgatgtctgaacgatgaacgactagtcgtgatctccgtagaagttttacaaatgacgacaaataattgctcggcggaaataattcacaagacgtggaagatgtttatgcaaagagcaattacgtgtcaaagccactcaaaacctgttgaggcgaaggatggagctctagacgattctgattgtatgttgtttcagaatggtttcaggagggataatacttaaagcgtggggaatctggagacaaatggtaacaatattaccatatgcacagtaatagctttattaattttaaggaaagctgcgttcaaaccgttctcatcaataaatataatgttctgatagtgctttttatcatcaagattaaactatttcaggcactcttccattcaagtattgccgtgttgagacaatcatctttggggttatgtttacaaatcaatcggttccagacagagtataaatctatggtggatgaatctttggattccctttctttgtttattcatgagatgaccaataaaagcattcaagttcttggatacattttcaattttatcgttgacctttttcttggaacatatgtttgcctacttgatttgatgattacatcaacaactagagtttcagctacagtggccgaagaaattgttgacgtagtgaataatacgatcacgacgacggccactgaactcaataagcaattgtccacagttgcgtcagttatcaacagagtgggcaattttttttccgatgacaattttaaggctattgatttgacgattgactcgctgaaaaattggcaaataccatcttctgttgatgagaaaattcgtagcttgaacaatgttgatgtcaatcttgacggtttgcttgacggagtagtatccaatgtcaccgataaaataatcaagactcgatctttaccagagaagagggccaatgaatcttttacactcaatgaagcatgtagctctgatgcagtagccgatttttatgacgttttgcacacttcaagcaacagaatgtttacattgatactaattttgagtgtcggcagcattgtcgtagtcaccttagttcagttgtggctacagaatcgaagcttcaggcatataagagagatcgatgaaaaaagaccgaacatggaagttgtctcgacgtttgagaacaggtatattcataaatattgcggttctggatatatcaaatggctcatgctgtacatttgttcaagcccgtccatcaatattttagtactattctttttttctttgttttcctatatcattcaagttgctattgtcaacaaaatccagaacttgagccatgattggctggcagacggagaatcttatgataacgacaatctgaaccagtatgttcagtaccaagtaaagtcttatgaaacttatatcaacaacaatatgacactggctagcattcacaacactttcagcagtgtaaattctacaatgaacgactttatcacagacgtgaacggaggtataaatagtatcttcaaagattctataattggagatatggtcaacggagttgtgtattgtgtaattgggaggaaattagaggcagtcaataagggatttgactggctaactaaatcaacggagttacagattcctacagagaactacgtcatcagcaatcaagatcaggatgacttaatgtccaaaatggccgaaggtatttctgcactatgcaaatactacaaacagaatctcacatgggaactctggcaatgcttattatttggattgttatggatggttcagcttatgataggtatactgatatcaaaatttcagcaacaaccagagcaacaatgtgacgataatcctttcattcatccggaatttataccattcaaaccatatgagacgtatcatcatacaaaaaatgatgtaattgcagaaacacttaatcgaatcaaaagaaatgaatctgttccatcgttcaaagccgactctctatcattaagcagtatcctggacaatgctgcaaaacgacccaaatagttctaggagtataatgaaacctaatttcgtaatttgttctttctgtgttcctcttcaggcgcaacataacccttattcctatcatccctttttttgtcagtgacctcctgctgcttgtctctcttttcttgaagttccttagcctttttggccctgtcacccaaaaagtattcaccactctcaatttgtaagtccacttttctgggtttctgttgaggtggaaatggagtgtatggtttcttttccttcttggatatcttgttcttacgagcaacgtttctctttctaaacattggcaagaaccgagaccaatcttcatttaccagttcaggtttctttgccaattctctcttaatcattaattccttaatatgataaattggatggacattcttcatacagtcttcaactacacgacgaacttctttcagccctttgaaaggtcccatcacactgacagtgtttccttgaaccaggatataacaaccagtgagtagttccagtgctttcagggtattaccattaggacccaccaaacgttgccgtcttttggtgaagcgctctttattatccaagttacctccaatcttgatgacatcacaagatatgtcgtcctgaaggatctttacagcttgaggcaaaggaacagaacgtgctagcagcttaattaaatctcttgccttcaaaataatggcaggatcaaacgtctttcttgtagtctttactgtcatggagccttcaaccaaattcagttcacagcctatatggtgggcatttagagcctttgcaacatctccccaggcttgcttgagatattgttctctatacttcggaaacagggttacaaacgaggactcttccgcaaaaggttggccagagacattatcttcttctttgaattcgtcttgcctccatttgtcgacatctggagtatcccatggcttgtctttctcgtgtgaaaccatgtttaagaagttttttctttgcaagattttttttttctcagtctcgtttttcctatccaaaagattataattttttttcttcccttttgatattggagaggcatggcttcaaaatcgcaaacgaagggaacttcaaaaaagctaataccgaagaaccagaagaaggatgaaaggaagatgtcttccaaagtgtctaaattacaaaagaaaaaaagcaatgccaataaattgcagaagatggcagatatacaactaaaggatctgatggatgacgaagaaccagttaaacaggataagaagacagctctcaaagacattaaacaaagttattataaggataagatatgggaaaaggaactattgaaggaggaaacaaaggttggagatgacatagccaagcagttggaactgatgggagagtttcggttgtgacaatgatagcaaatcgttactagaattgtgcctagacttaaaagaagatcaaagaaatttgcaggaaacacaggcagtttaaccaagaactaatattataggatgtttgaatgggaaggaacatatgggtggatcgtaatattgagcgatagacacataacagatggatacttgctaccggacatcttatccgtaggatcagaaaggtaagcgtatcctctcatttataattcatcactgttgaaattcattgcattattgaccacatccactcacacactctccccacatgtaattacacctttatatcacacaacatgcattcctgtgtatttatcctatgccttgacatcacgtaaaccagcaggagatctaaatatagcatcaccttcagagtatccacggcccaaaccaaagccaattcccaaccacacagggaaggctcttcttttgaaaaacagaacacttaacagaacaccgcctccgaacccgagaccggttttaaccactgtgttggccaatacaacgtcccacttatcgtttaacaacgtagaggagacgggttgactcaattgttttgattctgacatttctatatatgctttgaagagggttctttccaaagttgttgatcgatcaccttggataatgtcgcacctttcgttggttcggctggcttaactggcgcacgaccctgaaagatttgattttaccgttcacacgactatttttggtacgcgttctgggatgtgtatttctttacaatatacaacgcggtaggaaagagttcttacggtgcagcacagagaatggacttactgaatggtttggatatcgacaccgttcagatgagcaggtacaggcctgttgctgctgtaagccaaggatctgaggaattagaggaagaatctgagtttgaacttggactttcccgacctaaggaaaaagctcagtattctccattgttcaatttcaagctcaatttatcgaagattgaagatcggttgaatggaactacacatgacaatgcagatgacaaagaggagacaattgaggaaactcaactggttgaaactcaatacttagatactcaagtggtcggtacggaaattgataacacctctgctttcaagacacaaattgacgaagctgtcgaaacatacagaatacccagtgaggatgaggaaataaatcatagtcaagtgagaccaacccagtctgatttttccaaacaatcgttggtcccagtaatctctctcgctccctcacaggccaatgatgaggaaaaaccggaacaaaatacagaaaaggaactagaaactctccagatacaaccagcatcaaattctttaactgccactcttgttgataatccagcctatgcctgcctttctaaagaagataagattaagtttcgactatcactcaagtctactgcagattcgaccccagatgatttcatcaactcacatgagttgacagatttaagaaggagcattttggaactacagagtaagcaagataaagaaaaagagtctgggtatatagatgaagacaatgacgacggtcaggtggaggatcatgaaaggttcctatctgaggatgatcttcaaaatattgtgtccaataataaatcaatcatcaaggagaaaaaacaatcaaaatttacagcattaaaattacttgaagaattcgaaaacgatgataatttggaggaaatcggggctcaattcatcaaatcgtctccgatcagaatcgatagcacgcctaatacatcacctttgaaagtgagagaacctatcaagtctcctttccagcttcaaaaccaccaacctctttctaatccattacaacaatacactgttaaattgaatgagactatcaggactgatgatattggagccaagttaattgacctcagttctgatgaagacgattacaattttcagaaagtaaaagccgagacaagtaaggcaaccgttcttcaagtcaaggccaaatttgcccgcaagaagaatcgtcagggaggagacaaacgattagagggtccatttgtgaacaagtttcctgttaaagatctcattagacatgttaaagaatccaataaatcgaagaataagaagcttttcaagttattgaagaacaaaaccaagcagcagatgcttctttatttgaaagacaacaaacaagaggagggaattgtttacaaattgactcaagaggataaagatcttgaagaccttttaacccgtgaattggaaatgaatagaaaacttaaggaacgagaacgtagtagttccaagaaatctaacaagggagatacgcctgacaccgaagaagtccctgatagtgcctctgaagttgaaggagaagatgccgaagatattgaagaggaaattggaaccatcaatcaaactgatgatctggaggaagacaatgaagatgagatttatttaggtgcttatggaggtccccacgaaggtccccaacctacttcaatgcatcaaagtaacctcgacacccagatatcgatagacattgaacctacccagaaacattctcaagatcaacctaactccatgaatcatgttggttacaacaaagaaattattgaaacggatcaggttcaactcgattctttaactcaactagtctcagaatcacaattcccatcaattcccaagacaggaatagtatcacattcttcctccgatgaagaggatgatgacgatgaagacgaagcagaatctcgtagaattcaagtagacctaatgaaaatgaagatgcataagaaggagcttctacgaaagaaacgtgatagagaaatgaaatccaagaaactagatcaaattatgcaacaagaagctgaagaatctgaggacgagtatcaaggtatggggggaatcgacggagattttgacgacgaggccaatagtgaagacgagaagatgttagacgactactccaaaatcaagcagagagaagataagttgcaaagccttttagccaagactactattgaagaagatagagagcagattaaaaagttgttacacgacattcaaactggtaggttaagacgaggtcgtaggaatcaagaagatctagaacttagtgaaggtgaagatgatcttttgatgcaattttaccgaaacagaagagagaaacaaagagaaaaattgaagcaagagttggagtctgctaacagcttccataacaataaaaaatctagggcctttttcgaaactattagtgacgttcctatcagagtttccagtgtggaattagaacaagtggtggacgatgatgaagaaggagaggacaaagaagcaaatggtcaggaatataatgaattaaaagacatacaacgttctgaaaatgaagcagacagtgaccagtttgatgacgatgatgaagaaccgatcaaagtatccaaaagagggcgcaaacggaaagtcacagaagcctttgttcaaaagcagctgtcattcttgcgagaggtcgatgacgaaaacgaatccatcccaacacaaactcaagtcattgcagaagaggacgttgaagatgaaatggaaatattaaagtctagagccaggtttagaatttcaagggcagagactttattggaagaagaggaagctcgcgtaactgggaaaaaggcacaagaagaagactcagatcaggaagaactgttcggatctcttagcagaaaacaatcggctgttggctccttcaagagcttttctaatagtatgcaatctgccagcgacggcatcttgggccaacagattaaaaacgttgaatcgagtcgtagtaatataggaagcgcaaaagcttcagtgacctatattgcaaagaaagccaaaatcaacaccttggaaatcaaatataaggtcaatcaaatagacaggacgttaaaggctgctaaaaagaacaaagaccgtaaactgacagctcttttcaacagaaatagagggtttgaataaacaatgcataaatctttgttttatgtaacattagttaaactagttttcaatgcatcttcaaggtgatcttgtctcacataagtgctcactacacgtcggttatcaggggatgcaattggggctattgtagagctattagaggatacatttcttctacggtcgtaataggtgtgttgattgagcccgcttaatgctccatgccttactatcattttatggttaggccctatggtgattgttgacgatgaggattgacctagactggctgatctatatctggaaagagatcctgggacgggaattggttttgatttttcaatctcagttttatagtctttctggcggttggtgggatcccgtgattctagaccagatggctgtgatgttgatttcttccggaatttgtccagcaaaagactccattgagatgcttcctgagaagacgatacaagttgagaaattgaaggctttcgtgaaatttgtgtcttgtcaatttgaaaatctggttgtgaatggcttgacgaaccggtgttgaatttcgtggattctttggagatcaaagaagaaagcaagttccgagtgttagaacttgaggagatgcaagcattgacattaggcgcccagttgggagtttgttgcgaatctgttgtgttgctctgttgaaactggttgagccagaccatagtctgcttcttgagtgccatggcagtggaagaatgattagatggtacatgacggggtggagtttccaatgcagtaatattggaaggacatttagttaaaacgtctccaaaaaagatcttgtggggattatgttcatcgtcgatatctgagacttgcgttgactccgttatggaatcaaatattgaagttgaatgagcatgtgacataactgacatgtcaaagctatgcaatttttcttgaaaaatagtattattctccgagtttcctaacctagagttcatggatttcaatgcggtctcaaatgatgtgtaatgcctcaaaggtttagatgactcatcaagcgatggagagtgaggtaacgaagaatgacgtcggtggaaattgtacccattttgaatattcttgtgattagataaatttctctgtttccccacgtgaatgggtcttaggtacgaatcgtcattaaattccaaggtctggttagccatatgagaagaaacattaacctgattccttgattcttgaatgtattcaaaagtggaaggaatacccctaaaggacagcttttgagtcttcagatactcaaactccaagaacaaattatccaaagttgtctcacaagttctccagttcagatcatcatccttccactcattcaaaggattcaacccatgctgctttctattgtgattaatgtcactatgaagttccaaaatgtgcaattgcgcctggaaaaactcagaacgcagattaagcaggttcaactgttgtatcatgtccaaattgtgatctgatttggcgttcagtgtatcgataatcgtatcgtttgagagggcatcaccatacacattggatatatcattcaacagttcggtattcttctcgattgaagtagtacactgatcggcgagcccctctatcgagtcaatgagagcgtctaaatccatgaccaagccataggacggacgtgctgttggtatttgtgggttgtttgtggtcacaaggagactccaacctctgttttttttttactcatatgtttacatttgggaattattagtgtggtcgtgtactgttgcgaacaacggatgcctttcttggatgcaaaacagtgatggcgtcagtgtctcgctaaaacgagggattgtttacaagtgtgacaaaaggcgattacacagtgggggctacatgaataataaggattatacgggtgctcgcgctcctaacattattgaacctgctcggctaacgctgctttctattatgtttctctagcgtttgtttaccaaaagcaccactcctgctgctgcggtgcagtacagcacagtagctacgatgaaaggaaagatttggaatactggttgcagcaaagcactagtgcttacagcgatctagaatcttaaacccatagagttcaaacctaacatctcaacatatgaaagtgcgattaccaaaatgggaaatggccgtacacttgatagccaatcggcttgtataccataacttgttccacagtacgggcgaccaccaaatcaacaacttaacaccatagagggaactagttctggaacaggttctagaattcggaccctccgtcacaaaatgcgaaggagttgacacacccatacagagattgaattttactgccaaccgtttactccaaaattttgcccctacaagccagcctggatatcctaatcaccatgcaatatagtcacaacgtccaaagatctacgaatgttaaagtaactctagatacatccaaccagagaattactagtgatgggcaaccaccttgctacgatgagatgcttgattagtaaccttatcgtggtgcaatctacttctggtacctatgtatgcattacacgtttctttttctcatgtacgttttgttattacattcagatgatgatttctttcgtgaaaaatccgcgaccaactaattgaaatctggccaaacaagtgcataatttaacctggagcagtgtcataaagatttcaagacctaatttttatttctcccacttccttatccccccctcctccgccatcattatctttccagttagtcgcttttttacttttgaacgttgccgtattcatgacgagctccctagtaaaccccaataacgatgggaacaagagttcactctctttatcttcaatgagaagcaagcttcaaagaacaaaacaacgaataacttcaataccaaaggtcaccacttctccaagaaagaaagctagtagcacgagtagcagtggtagcaacagcagtaatggaaatgtcagcaacgataatcaacacaatcatggtaataataatagtaataacagagaagagatgttagtggacgactttgctcttcgatacgaatcattcagtgacgaagatccgtcaacgagtccaagacatgcaaagtcgacttcggtagacacgtctaggtcaagatccaaatcactttccaggtctgtatcgatatcctcatcgagttcaatactagttttttcaaaatcgaaggtggttagtcctcatgagtcagtagtaaatgagaccgcaaagttgtcttcgtctgtcgttgaaggcatatctcaggatcctttggtgaaggattccttactaccgcctatacctatggacaaaccttccaatcatgaagaacttcatcctacgttaccgacaagtgtgattcgtggcaatggacttttgccccctcatacttgctctagggatcatctaagccagcatcacttgagtgactcaagtactgcgactatgtccagtgtatccacgatgaatgaaaatctacaacttcaatcatcaccagccatacaaaattttagcattcagacgaatcataaatcctcctccatttccagtgcctcttctgtgttggcaaaaccaaaaatcgaagacgtcctggcttcggaggacgcattagccactgcgatactgaagcaagtgaataatggagaaagctgggaattatgatcggaccccataatgaaagaacaaaaagaaaaccccagccgttaggcatgtattatagattagacatatatttaggtggtgactacgttaaaaggaattgtattagtatatcccttatttttagctactaggtgctacagctgctagccaccttatctttggagcgattagtccgtttctgtccccctttcttgtgaaaaacgcctttttctgactgtgttcctgcctactcccgttcaaaagcttgcttcccagtttccaactattggctgcttttctttcatgaaacacttggctgtccataagtacaaggtaggagccatcgcagctggcttggttgtctcctataaaatctttgcctaccgcgctgcgtcttcctcctcctcaaacgtcatcaacttgaccaatatggcaaaaactccaatcactttaaaaccccctcaggctccactccgctgggaccatactccagagcagatccttgccgaaactgataagtatatatctaccagtcaagaggttgacgattgggtggcaaacagctttgccactgccaatgtggacaccatcaagaaaatagccgccgctgagaatgaacaatacttgccactgtgtcaattgagtttttatcaacatatctcggataaccaggacgttcgtaatgccagtactgttagtgaggagaaaattgataagttctccatcgaatccaaccttagagaagatgtgttcaaaacagtgaacaaagtgttcaaacaggttcaagaagattcggaactccaaaagaccttggacccagaatttaggcgtttactagaaaaattgaacctaggttacgtgagatctggtttagatttatcccaggagaagagagaccaagtcaagagtttgaaacaagaactatcaaccatttcaatcaagtttaataagaacttgggagaggaaactgaacacatttggttcaccactgaggagttaaaaggtgttccagaatcagttgttgagcagtttgaaactaagaatgagaatgatgttacttaccacaagatgacatacaagtatcctgacctgttcccggtactaaaatatgccgttaatccagctacgagacaaagagcttttgtcggggatcaaaacaagatacctgaaaattcaggattacttgtgaaagccgtcaatttgagaaacgaacttgcaaaagttttgggttatgatacctatgctgactatatcctggaagtgaagatggccaagaactccaagaatgtttttgaatttcttgatgatgtaagggaaaaactcagacctctcggagagaaggaactgcaaagaatgttgactctcaaggctaacgacccaaatgctgttgataaggaaaattactacgtctgggatcatcgttactatgataacaagcttcttgaatctgaatacaaagtggatgagcaaaagctggctgaatactttccaatggagtccaccattgaaaaaatgcttgccatttacgagcacttgttcaatttgcagtttcaacaagttgacgattcggagaaacaagtttggcatccagatgtaaaacaattctccgtttggaaaatcgataaccctgattctcctgaatttgtgggctggatctattttgatttgcatccaagagaaggaaaatacggtcacgctgctaattttggaatcggtcctagttacatcaaagaagatgggagtaaaaattatcctgtcactgctttggtttgcaacttttctaaaccatcaaaggataagccatccctattgaagcacaatgaagtcactacattcttccatgagctaggacatggtatccatgatttaattgggcaaactaggtatgctcgtttccatggtacttcagttgctcgtgatttcgttgaatgtccttcacagattctagagtactggacctggactagagatcaactcaagtctctttcccaacattacaagacaggagaagccctctccgatgaactcattgattcgctagtcaagtccaagcatgtcaatggcgccattttcaatcttaggcagttacactttggtctctttgacatgaaactacatactgccaaagagcctgaatctttagatgtgacaaggttgtggaacgaattacgtgaggaagtcgctctggttaagaatggtgaccaaattacgaaaggatacggttcatttggacacctaatgggcggttatgctgctggttactacggatacctgtattctcaagtgtttgccagtgacatttattacacctttttcaaagctgatccaatgagtacagctcaaggtatcaagtaccgtgatatcattcttgccagaggtggatcaagagaggagctagataatctcaaggaattacttggaagagagcctacatctgatgcctttatgactgagcttggagtagaaaatggtgcgtccaagttgtaatgtattaacctttgaaaaaatagtttcgtactttaagcgtattcatcgataatatcatcggatgattttaacccattatttattgacggatttgtttcttggatctcatctttgctcatccggtagatgctcattatccatgagattcctgctagtatattcttgacctttttggaaaccttccagttcataacttggatcaagtaaaatgcaaattcattaacatttccaagcatttccaagaaggtggatattttggatgttcggattgtgagcagcatagcatcatattcatactgaatggaagaattgggagatcttgacattaaaatgtctctttccagtttcactttcttctcagttctattgagttttatcatgcgaatgaacaaattcttgacggtaaggaaaataatgactaaccatatcttcgaagcttgcttgatgaagtttctcaataacctcgtaattttgctatttgagttcgaagtgttgaatccaatcaacgatgacaaaaagtagaaattatcaaaaagagcaattagttgctcaaaagagttgatgaaaaatgattccagcatattatactttgcagtcagctgtttaattagcaataaaatctggttggaatcttgagtcaacatcgataactggccagacttactagagactccagaatcggggctgttcacatgcgtgtattctgatggtctacccttggattgtgattcattggagttagtctcatgtaaccatcgttttatattgtcaaaagaggatgaagttgaagtgtctattagagtctcacttgaagacgaatcgctgttggaatcaactgtttgatcgtgagttgagaccggctcagcgttagttttgaccactttgatgttatcacgatgtttttgatgattctggagagcttttcgcaggttcaagagtttcttgccttgtattgatgtgactggatgtaagttgctctgttgatcatggatcatcttttgacgggtctgcttgaatatgtcgatcagcgtttgcgactctttcttcaaatcagcctgtgatttggagccattcagtgattccagaagatttttcagccttatttgcttctccaggttagacatttggacaatgtaccaatttatgtgagtagagaataatggataatgtgagaggggagggaagggatgggtttatgatgacgtttcgcgatcattttttttgatatcagaagagaaggggaaagcgctccacatcgaagagcaccagctggagtgcgctctcgagaactagcgacaagcggaggttttaacagtgaattgagccatctcctggaactgctgtcaacctatccatttcctttagtctttttttattggtcgcaggggcatctttacgactttaatcttccgcgcacgtccttctactaccctgcgcagatatatcgatatatcgcgagaaacccatacaacatacatcttcccctaatggaacaactagtcaaggaatacactgaagcgacaactattgatcctagagagatcgagaactctctcaagttctacgaaacgcagtttgagaaacttggctttcaatacttggaacaggagagtaaggaaaaatttctaaggatcattataaatgaaaaccccaaattaatagacaacaacaacattgttcaactagaaaaggaaaactcccaggtcaaagataatatagacgaagttgacagtaagataaaaactcaggtcaaagaattggatcagttgggtgcttctagtattgagttagccaataaagtgtcacagaaatccgatcagatatctcaaacaaaaaaggaattacaacagatggagcaggaattgcaggaactagcagagtatgaaggtgtagagaaagaactgggcaagtatattgaaggtgacatatttagtggactggaaatgttcagagatcagttgaactccaagcaggcggagaatgatgaacgtaacgaggatatcaaacgattgcaaagattactgaaggaaaatcaagacttttatgaggacaagaagaagcaaatacaacaaattaactctgaaattaaatctattgatcaagatattgaattagacaccacattaggtccgtggtattttgaactaggaagtcttttcatcaagttaagtcatgaatgaatctctattgggcatcatcagatgcccgctttgataaaaatgcaccaagactgcccagatatccctcatgccgcaagaagtacgcagattgttgattgttagaccaaaactttacagcgtagctcagggtcttgactgtttgagggtggtttcggatgtatgagcctgcaaagaaaatctttgatattccacatcgttgagcttccaggaaagctatttggccgatgttgtttgaaattgcaaacaatagtgatttggcaatatctttctgatcaaatgcaagtaacctttctaaacgtcgagcgcgtatctcttctgcagaagcatcttctggtatcttgacatcagcagtgactttcttgaaggcttttcccatagaagctgcaatggcgtcagcactgagaccaatcttattatatccacgaccatagatgtcacctaccagtagatcgacattttcgttattaccatcttgagctagagccagcatttcatcaaagtcgtttgcagcagttaagattgatagaagaccccacagtgtccctcctccgaccgatgagccgctcacacgggtgaacgtgttgttggccgtaactttaatcatggacactcctgaacctatgtttaccagtaggtatggataaatgtttgggtcttccagacattggaccgaattgtaagaaaagtgttcatcgatcgtaaagatctcatccgggatacgggtgattagaaaatccaatcccactatgagactttgcatttcatcagtcttaacaacgggacacttgatttcatccaacagcaactggttatatttgaacgcgccacctccagtagccatgattataacctcgttttgttcgccactgtcactatcagggtcgaagccatagtgaagtttgagtacttccttgagtctatcaattatctgctctactttgctagtttcaatactctcaaagtttagttttcccccgttctccagcttacttgaatagacaattttggttaaagatccgccaatatcaattccaacatgattcaaaggcttctggttgggtaaagctatgtcatttgtggaaacaagctgtgaatcgtctttttcatcaattatatgtgttcctttaacattgagactgattgagttactcagatggttactgctataactcattttttagttggaaagcggggttgaatcgaggtttcccagtggttgagttagtgttgatagagacgttgttgggcagaggagactgaagggaagagaggaattcttcgcggctcatgttaaatggcatttggaaggttaacattggcgggggaatgaaagattgtttcgtcctctaagaagagaatttcccacttgctacagaataagtgaatttaagacatgttagatgattctgatttctagacatagagtttgagtaaggaccttgcaccgggggaggggtcgccaatagtaatgggactaccttttattattgtacatctcaacaccaattatctaacaatggactagcgcggtgcggttgaaggaaggaggaagatccacacccaacagaagcatattgattaagatggaccagttgtctatttcagaactgaacaaagttgatttgtttcctattgttcagcaagtatttgacaaagcatttaaagaagagaaattaatttacaacgagtctgactcatttgagatactggaagatggaaacttgaaattcaagattgaaattgttggtggactgtcgaagcgtccatctaatagaccgcaagagcctggaattaaaacaaatatcccaagacctagaaaagatgttcatgcagcagaccctttcatgattcccgagccagaattaactgtcgtcgagtgcttggcagatgaatatagactcatcctaaacaagtatccaaacacttcaaatcattttctactggtgactagagagtttgtgaaacaagattccttattgacgccgaaagagttggccaccatgtatttcactttacagaatctcggtcgtcatgaaaattatttcactttctttaattcaggatctgaatcgggatactctcagtatcataagcacgttcaattcatgccatttccaaaagaactacaaaacatctttgttgatgacttggtacgtggagaagaattctaccttcccaaagatacaagatcgtccagacagtgtctaaatgaccctaattgtccctaccaacattacgtccttcccctacctaaaattccatttgaattagaagaggcagaagagcagctaggaatggcatatatggttcttttccgtaaagttctgaattgttttaagtatttgaacagtacaaacccgttcgatgtgagctataacctgctaatgactactaagtggatcatgattataccaaggcgcaatgcaaaatttgataaggtctggaccaacgctttggcatttattggattatttttggccaaagataccgagatccaaggattgatcaaagaatatggtccatctactattcttcaggaaaatggattccccaacaatggggacgttttgggcgacgaaaacgactactgaactattcatcaacaaagctttgtatagttatatatatatttatatgttcagttttttaccaattgaatgttgtccagctcagccttctcagcagcttcagcttcggcttccaaaatgtatggtgtaaggtaagggatatcgtcttccgctttcaaaaacttgttttttggcaaaagactggccgaaagggtcagctggtgagcagttaaaatacggaagtttctggcgtaaacctcttcacttggaagtcttgaaatggccttttgcatgactggagtctcttctatcaataggtcatcaacacgcaaaccaacttctctgtgtccagatgcccatccaaaagctttagcagctggaaggaacacctttctcaaaattggagtctttaagatgtaatcacaactcttaaccacggaagttaaagtagccattatggtggagttattactgaggttactgaagattactgattttctgttgtcaatgagcgcgcgtttattggtggaattgagatgatgtttggatgttgttagtggttagcgagaataatatgtggattgatccaatgatttagctggtacagttgctactatcagcggtactaccaactggtagcatattgctttcggtggttacaatgtcgaacacccattgcgatagacggtattttatacactgcaggcactgaaagagactatcaaagagagaactttcatacttgggtaaactaattattgcaaggttgaaggtcagaagatatgagatcaccagtagtgggggcgaaccctgaagctgatttattgatacattacttttcatggtatgagatccaaaaccgtatttgaatgttagctaactgagtgcccttctccaagtggtgagcctttttcatgtaatcatcttagctttaaagaatcattacccatcatcagaaacacaaaaccgcaaggaaacacaagcactctgtaaagaaactcttttttgatttatgatggacattgttgtgtatacatgtaagctggtaatagctagctgtaaaagaaagctttcggttgcggccatatctagcagaaagcaccgtttcccgtccgatcaaccgtagttaagctgctaagagcctgaccgagtagtgtagtgggagaccatacgcgaaactcaggtgctgcaatctttttttttttccacccttcaagaggatgaaggtgtgtatgtagaagggcgtccgtctccttgtaaagagattatctggtgatgacttcataaatcgccttagtcataactacgaaacgtgacacgttccaattcagatatgtgcctagaatagatccagtgcacaacagaaacgtaaagtcggattgaccggtcccggtccgaaccttctttttttcggcggtagtattacttacaggcagatccagggattgataaaataaacaatttgtgatttacccacgacttgaagcatgaatcaacgtacgtttacggttggtgaaagccaaccaatgcggaactccccatcaaatttcctctggcctagtttgaccaatgatgcagtagaatcggttatggtgcttcatgtgagaatcaaactagtttttctggcgagtttcttttacaataaacccttggagttgtacctcggggccacagatatttgttagctgtcaaaaaaacgttgcaccgcgcattattttgtagtatcattagatatgggatcaccccccttagagaccttttctggcgtatataattggctaggccacttgtaactgcttagagcaacagcaatcatgaacattcaaggattcactcgaaacgattaagggaagggaaacatcccaccgtcacaacgtaagctcctgcttttccccgtaccatttattttatggctgaaaccctgttcacgtttcctatccccctagttaatcgacatctgacatctctgcatccaaaatagcttttgtcacccaatcttatctcattgcgacggatattctggatcaataaggccgcggctacggacactgctttattctaaaactttctttttcagcctacactataaatcccctccgcttcacttgctgtagccataccccagagttatccgatgctcaaatggtttacacgtctgatcacccatataactcgcttgggtcgatcaagctacattcacactcccagtcaaacctaaacttaggccccaagcaacatccggctcccatgagatcgaactcatcagcgtctttagcacaacaacacacttcaagttctccattaaatagaaagaccagatcccgcacaagttctctttccaggatatttaggtcaggaagcgctgttactctgaacggttcaatagcgtctccaatagagtcccctcgtacatcgagcagccacacttttagacatcagccttcaaggtccaggtctagtaccttatcatcagtagatacttccagccaagattactttggtttaactgatactgataacaatgtcatgagtatcatagaacctggacccgtaaaacctcctccttacaaagatttgcttcctggaggatgtccaaaattccctatttactcccaccagcttgaaggaagtgaacagttaccaagctataagcccacagtatacaaggtagctatactacaaagaaaaatggaatggttatctccttacgaaccagccaacgggagggcttggaaagacgccattgtggaacttaataataccagattgaatatctatggatttgactcaaggttactagacgaattgattttcagaatgaatggaaaaacatgcttcgatgaggattttatcaccctctacaactcttcatttaccaccaaaacagatctggtagttttgcagtgcctgaagcagctaggttttatgagagaggagtgtctaattgcaagccattctttacagtacgctaagtttggatctgcatccgattatttgaagaggaagcatgtattgagattacgctgtgaaactagtcaattcttgttacaattttccaattcacaaagcatgatcgattggaatttagctttatctttggcgagagataactcgttagatattcaaagcagagagatgccgttttatagaacagttcctcgaaggacccgaaggaacaccaacccaaggatactaagctctacggagacaagatcatcagacgctgcctctagatatagatcgagatctatgtctgatttctttaggaagagatcaaaatctggtgcaacaactcccactttgccgtcttccttgaacgaacgacttaatctcactatatccagttccaacgatttacctcttacacctactgtcaccccaactatttccagttcagttgaacactctccattgcgtccggggcagaaaccaaaatttctcatgggccaaagtaatgacgatactcttgatgaaattgactgccttgctccagtgttgatggaaaatgatattcctgagggttgttcctgtgatgacacagtcgatgaagcccaaaatcaaaatactaatcatgacgatcaggatgatcttgatgagtatcctcctcaggatgaagacgacgacgatgaagatgaagatgaagaagaggaagaaagactggaacctatagaacagtttcttagagtggaagatttaaatcacgatctagacatggttcatctttccgccagtacttcaccttccatagccgattccactcaattaacattttcatcttctaatgtcacaggatcttctataaccacagcgagctcaacagaaaccgaaattaagtggaggcccataaatgaaaaaataccttccaggagaagaataatccgagactctatcaagtgtattcagcatctcccttccaacgaaacatggtccggaaagctactggtaaagcctgcaagacgtaaacaatcatctattgcgtcaaagcttaataagcttacgggtatgggtatctcgacaacaggaacgagttcaaaggaaccactgcgagtttttcttgtaactccaagaggtctcctttctgcttactacagtaactacctggataagtataatagcctatagacttaaagaataaagagaaattttattcacagttttgactcagacttgaaggtaccagcagcatggaacacctccagagcctctttaacacggccactcatggttttctcactctctctaatccacactcttggatcaaagtatttcttgttgggtttatcagctccctgcggatttccaaccatggattgaagatagtctttgtttttcaggatatagtctcttgaaccaatggtgtatgcatattgacaatcagtgtctaaattaaccttaacaactccatggttaatagcagtgttgaactcttgttgagaagatcccgaaccgccatggaaaactaggaaaagtggttttgatccatttttaaggcctaactgttgagctgcgtaagcttgatgttcacccaaaattgatggtctcaactccacattgccaggtttgtagaccccatgaacattgccaaaggctgcagcaatggcgaagtttggagaaataggagccagtgctttatgaactgcaaaaacagtttcgggactggtatagagtgagtctttatcagcattttcgttattcactccatcttcctccccaccagttatcccaatctccatttctaaccactggttcatttttgtcattctcttgaaatatttcacacaaatagcaatgttttcatcgtctgtttcctccgacaggtctaacatgtgggaggagaacaaaggctctccatgggtcttgaaatattcttcatctgcatctaacattccgtcaaaccaagggagccattttttttgacagtggtcagtgtgcagaatgacaggtatgccataagaaggtgcaatagttctgatcaatagagcagcagcaatagatccagtcactgaagcgctaaggtctttattattgacgccttttccctggaaaaaagcagcacctccctgagatacttgcagcataactggtgatttgttgtctctagcagcctccaatacagcaaccgctgtagaagaggacgttacattgatggaaggaatggcaaatttcctttctcttgcatattcgaatagctttctaacgtcatctccaacgatgacaccgctttttctggaaaggaaatcaaatgtagacatatttatgaaattaatcaattaccttatcaaggtagaatttgggtgaatttgtatgtttaaataccggctaagagaataggctacgtaccccacagactggaagtcgcatccgaaccgaaatggaaaaggcgtgtaagggttgcatggtacgaataggggaagaagagaactgggaagtgatcattgatagtgtgagtggcgggaaatattaggtgtgagtttgaaaggcctacaatagggatgcaaaaatcctgctcatagggtcactggggagtatttattttctgttttcaggtttcccaccaatgtaaatgttcttcttagaatagaagaaagctttctgtttgcaggataacatttttgtccagtaaaagatatcattttagtttgagttcatgtgatcacatttagatcacattaaaagcaaaagtgacggtacgtcttctataactgtttaaatggttgaggtttgaagtcctggtaaaagtcaagtcacaatgccccacaattatctgattaaataagtattgctaattatggctttcatattggccaatccttttctttaagcatcttgatctccctcaacttccatcctactagataagttaaccccagtagttctattcaaataccatgcttatataatcacaacactgttttcaattacttaagcacatttgccttatcttatggattaatttatggatctgacaagtgttaccaatgtcaccaatgaccttcataattttgccagaataggaactttgttcttctataactttccaagaacccccagtttttcaaccttggccccagatggttggaattggtatgatccaccctataatgaaaaggttcatcttctaactcaagatggaggtaaatctaactatgcggactttttaatagaagtcaactatctcgttaaaagaggagttatccgtgtgacatataagcagttttgtattcgcagaagaaaaataatcctgggtagagtttattgtcttttcaacgattgtgctaattatggaaaagtcgaaacttttagagaaggcaccagacggggtaaaccaacagcatggcatcaaagcagacagaagaaagctctacaaactgtgctggaagttatagatttttcgccaattgcctggaatattagatccactcatcaattggtacgatacttccaaatgtatcagacagtgttgatctcctttatcaaacaaagattctcggggactattcaccgaagttcagattcttttacaatgtatcgcttactaaatcgcaagcctttccagactagtaacgaacaacagcaacccatattatcactggaggagagagttatcgcattgtacaatcggattcaatcacccatggttaatagacacgatactcagttcaattcagcagtctctatgattttgaacaacgagattaaagaccttaaaagtgtcctgtataaatatcagagaagatctatcgttcgcatgttggaaaaagaactgtacccatcttcaagcttatccccgaacttggtcgtggtacccgatttgtacaagacgaattcattctacttgcatgtcaccgaattgacattccaaagggataaatctacactgtctcttcctcgtagtggtattcttgctgagaatatgggtctcgggaaaacttgtctttgcttagtattgatctatattaccaaatatcagcttccaactattcccaaagagtttagataccagtcacagcaaactgaaaaagtgatatcactacaagaactgtgcgtgaatatgctgagtcaagaatcattatcttggaagcaatttcggtctgaacttcccgcatcgtgtatcaaggcattgaggagccatcccccctcttttcaatacacaacatcctccaatgaaactaggaaaagtgcaaggttgaaagttaaagataccataacgatatcaaaacagttgtatctatccgctgcgactctggtgatagtgcccgataacttgtatcgtcagtggatcacagaaattgacaaacattttagccccaatgccttcgagctacttggttttccacagggaagtgatcccgagtttcctccacttgaaaagcttttggacgttgacattattttgatagcatctagtatctttgccagagaaaatgattcctctgattccgttctaagatgtatttactggaagagacttatcgttgatgaaggccattcaatgagttccaagatatccaggccttctgagcttgctcggagtctttacgtcgaacgaaaatgggtaatttcaggtactcctactagaggacttactcggttacatgtcaacaaagaagaagttcaaaagcctttcaacgccaaggatgacttattaaaactgggattcttgatcacaaaatttttgaatgttcctctttggtctaatgacccgaaggcatggaaccaacaagtggtgaggccgtttattagcaaatgcttcaactcagaactacagttattccaaatcctcaactcattaatggttcgtcattctgtcacagaagtagaagaccaagtggacttaccgcctctagttcacgatgttgttttgatcgaaccggggtactacaatagaatctcagttaatctctttacttctttattagctacaaatgctgttacttcagagaggacagatagagactatatgttccatccatccaacggagctgaactgagaaggttgatcaccaatttacagagggccactttttattggactggattttctgttgaagatatccgagctttgatgtccatctgccaaaagagtttaaagaagaaaaatgatgatggaacggcctattattctccacgagatagagaccttttgcaaaactcattgagaacagccaaacttgccctttctaacaaacgatggagaactgcctctgccatacatgaaatgaattactacgtttctaacgtaatccaccagtttgcaagcaatctgtccctggacacttatagaaatggtctcacaacgtacggagcacctcagttgtaccaacttcaaaaggcttttttcaagtatcggtttgttagaagtcaactaggattggaagagcgattaactgaagacttgaagcctttttggaaaaattattggaaccttgtctggcgtaaagatattcaaaggatcaaaaaccatgacggacaacctatcaaacaagaaactatcgcctctgctataaagaatcccaaatggagtacaaaatttacagcaaaggaaaagaaagagctcacaaactattcggacagctttactgaaacaatgagcgagttccgtgagggtgagtcagttaatgaccagcttcgtcaatccacagtagtcggtactggatcggccaaattatcctacttgacggctcgattgctagagcaccaggctggaggaataaaaagcctagttttctttgagtttgaagactctgcatattatctatcggaagcattagatctcttaggagtcaaatatttcatgtatgcttcgtacaagaaaccaattgaaagggcggaaaatctggtaaaatttacagaaattgaaagtggggctgcactgataatggacctaaagttggcatcgcatggtttgacaattattgctgcaaccagggtgtacttcatcaatccggtttggcgaagagatcttgaagctcaagcaattaagagggcccatagaattgggcaacaaaaagaagtaaaagtagaaacactaatactgcgagggacgattgaagaggaaatgcttcagcaaagatctgccgaagcctccagcaataacgagcgtgactcagctagtgtcattgaaaaccgtgggatccaagaatacgttctaaaacatgagttccttcctataaattttcatgatgttgagtattctccttttgaatcttcgtctacttcaaacaaacctataggttccaattcgaagaaagagccccccgagttattagaagcggagtcaagggttgataatggaattcgaagttggaatgtcccattagtgtctatgaattatgagaacgggcaagtggttggatcaaagctagtgaaagaaggatctttgattcggtcccgcaaaagagctgttgaaaccgtcaccggtgccaataccaacttgactcgcaaaaaagtccgcttctttgaataattaatgtacattatctattatctaatactccctgattaatatggtgccatcaacagaagtggaaagtaggatattttctgttggatgtaaatcaacatctatgatagtgccagattgactggccaatttggaaacaattctggcagaatgaacatcccagacggtaacagttttgtcagcggaaccacagaataatctatccccggctctattaacagtacttctaagaagaaagttctcggttccagtatccagatcggcgtatatctctggtttaactcgtgatattccttgagctacaaatgcctgcgcatcatacgatcgaagcgtaccatcttgggatgaagaaaatagagtgctctcatttagagagagggaggtcaccgtgtctttatggaccgtttcctcccataatgatttttctgtgtctctcaaatcgtaagcatgaattgtggggtctattcctgaaaaatatactctgttatcagctaccacaacggaagtgagcggataatttgtctcaattgaagcaactgggtgttttgatcttggatcccatatcaaacatttaccatcatctccaacgctggccatttgtgaatcaaggtctagttgattcacgatgcttttgtgaccctgaaattttagtagttttttgcccgtttctagatcccataaggctaatgtggaatctgcactcgaagaatataaatgagagtcatcagaggaccacattaaagaagttataccgttcttatgaccagaaattgaaccaatactggcttctgtttctgtttctatcgcttcattgggaagaacccaaagaagtatttgtctatccaaaccaccagatgctacgaatttcccgtctccactgaatttagcagtgataaccggaccttcatggccttcaaatacaagtgcttcatacgatgtatcgtcatggttttcctcttcgactttttgtcttttcactaaagacatgggtaacaggaaaatacaattttgttgggaggaaatctagtggaaggatcgcgcaggagtttcgtcctcatctgcctctacggaatgtgctttcttgttaagtgaattgagacttaaccttgatgctgtggtctaacacttaatatagctttgcttatcactgaactaaatgatgttcaacgcaaatggaactaaagctattccaaaccaaaagagctcttcaaacatcaaaaatcctatcaaagtagaatgacatctttcaagatgaggatagttggatctctgcaactctgaattgtaagatcattagcaagagtactcatatgttatggaatggtgcacagcatttctaacacttgtacaaaaaatactcacaatgttagttgactcaaaaagtggatagcaaggctttctgaacaaggctttctcaagcagcatagtcttcctattgagttggcccatcattgcactgaaccaaccgctgatttcatttaaatggtacacattacgcctgttttgaacccttagggatccgactggttcaaatacgtgtattttgcttgcgcagttaacttaacaaaagattggagcttggagctttagcatacagatctaaaagatatacgaacttttccctagcaagaatgatatagtcatttacagattcactagatagttactgagttgtcgcgtgacttagtgggggagctacgaatcttcggcgacttcgctgatgacttatcgtcaatatatgatgctaggaatgagcagtccccttttagggttatggtcagattgaatttcttaagaaaactatacggcactggatcactaggcaccatgttctagataatctgatcggcttgccagttcttgatccaactctatgtaagcaaccaagcaggtacaggacctctgcatctagacagagaatactcttatcatgcaaagttatgatatggggcatcatcaaatcacgaaaacaggtgattagttgtggtgattgcatactcaggcacgatagccaagaaaattcgtgtgtcctgaatcaagtgaaatagtcacagtttgttctgctgtgtccggagatttattgagggttgagtatctgaattgggttgcttcaacctcatttgccccatcgtcattgggactgagagcaagtaaaataaactagtgcttatccttgaagcaaggatagcttacacattttgcgttccacctattgatcttgactccactaactgatttgcatcccatagtgcataattgaacaagaactagtacgatactatacatacatattgatactggcaactctgaatcttcagaaaattaacggcgtctttgttcctccaatcatttcaatatggagtaacactagtcctagaatatgttcatcaaccatattcgaccatctatagaccatgcccttttcctatatacccgaacactagccgattaattaccaaccaacatcttcgactatgaatccttcttccccgtgttttttccccaacctgtccctcacccatactaaaatagtagtgcgcgcaccaataactttaaccaatcccatgtctcctctccccctaacctcttctcccttcttcaaggaaccgaaaggaaaccactaaacaatcaattgctttaattacaatgtttcaacgtactaccgccactttagtcagacaaaacaaggccattgccagattctattctgagggatctacaggagctcctcgttctgacggatccggcgacgctttcaccaagcgtgagaaggctcaagaggacttctacattaagaagcaccaagccgagcaattagccaagctgagagagcaacttaagaatcagaaggaacatctgcagaacttggagaaagagatcaacaacatcaaagagaaataaatgttgtataactagtgaataaataaagttaccatgttgcaatgagaattggaaggaaactgcagtattctgatagtgatcaatttgatatctattgtcatgtcaatttaggttatcttcgccaattggagtttccctatgatctgtcactgattttttctttgagttctcagtagtaatagtagtactagctaatttttgcctctgttgccttctctgaagaaaccctttcagtggttgaatgattgcccttagttcttctttcatccttcctaagtaatctctcaagcagacatttttctaattttgtaattgaattcacgttgttcctattaatctttctacctctcgctttgttttagctagggatcttacatcaaaattcagctcgactcgactcaaccttcaacaatactcgtaatcaatcgcactaatggacacgtcaattgatcggagagacgaatcattcagcgagtctccgtctcttaatgacgatctgttgccgtcgtcatcggctgtgaacactcccacccacaggagattactttccagctcgactctatcgtcgtttcgtcccagttttgacgatagctccatctcattaggcatcaacagattaagttcccaatcgataagcccactgggccagaactcaatttacgagctggttcaaggtgctgaaagatcaaagagacatctccgcactatatcggtgaatggtggaaccaccactgttcatttgaagggaccatcaattaacgatatccccgctgtcaagctgcctaaaataactaaggccaacccaaattcttataaaccatacttagagtccctcaaagactatttcaatgaatacgaatcaaacaatcaattaactgagaagactcttgaaacatatctgaagcaagttgatgaggaggatcaacttgccaatgatatccatcaaagtgctgctgatgcttcattacaggacattccgagtgtctactttcaagaagattttcgcctagataacccaagagtttttgaaaccgtggttgaaggatcccatatctctcttcaagatggctcatccaaatcattagcaaacaacaaccttctccaagagaaattatcttggtatttagatacagtggaggtacacctgataaatgaaatttccaagtcatctggttcattttttacggctttagatgaccttaacaaaattactacaggtagtaaagttacggccaaaggtttacttgccctacaggaaagggtggaccttcttgatgaacaacaggctaaaaaagcaattaacattcttcagaaaatacaaaagaggataaacactgagatattggaacaatccctacttcaagtgcagacaattttacagcaagctgatttggccgaagcaacatatttgaatggaaattatgagaaggctcttgaccagattgattctattcgctgtcttataaaaggtgacacgtccaaatctttactagctcaatcagttgtgtccaaatggccttacccgttgcagaatctcactgaactcccagccttatctagtctcaaacatttgctaaagaacctggaatctgaaatcggtaggacttattgcaaaatgtttgtagactttttgatcgaagatctgagaaatcattatgatcacgtttcgaaacatgatactttgtaccgactatcatcaaatcttcaacgggataacagaagattcacttacataaaattagacaaagaaatcaacaattcattccaagatgttaatgcccttttcaaggagaaactatctcattttatgaaagaactctcaagatgcggagagttgactaatgcttttggccgttatgaacaacagctactggtggaggtcaagagtatagtaagatcatttttgccagaagaagattcccgaacctcgtcgcacgcttctcaaaccaatagtacacaaagtaatgctcgtaatagtttgagtgataacctgagattgatgactcccagagagtttgaggatatgctcattgaaatttattgcagggtatcagaggcgttgagaagattaacaattcaccagaaagcattattggacatgtccttagattttgttacggaatctgattttgctaatacctcacaaacggatattataatgacgcttgatattaccaaatctattctaacaacaattgatgttgtgcaaaccagggtttctaaagttattggagttcgacgagaacaaacagctcaaatctccttggattattttctacgcttctactcagtcaatggtctctttctttatgaatgtgaaatgattaatggcggaaatacaaacacaacagcactacaagatgcaattggagttcagaccaaacttttcaatactgctttccattcttcgactcttaagttaatatctgaatctattgaaaaggaaccgtggaaaagtggctatcttcccaacgaatttcagactcttttaaaccaagtcattcaatctgccaatgaagatcctgaaaaatggattaattcacttaagtttcaatatgagaataacgtgcaaagtgatcctgaagatatccaaggcgaggaaagaaaaactttatccattgatcaagattctttcattgtaccaacagtggtctttactatactaagatgtgttaaaaattatgaaatgctgaaacttgtatttcctcaacatactttgttgtattactccaatgtatgcgagtttctgcgattgatgaacgtcaaaattcagcaatctgtacttaaagcaggcgccacacgaacagcaggcctcaaacacattacttctaagcatttagttatttgttcgcaattgttgaggttcattgttcatttaatccctcacgtcaaaaactgtttcttaagatctgttaagcaagaagacaaacttcaagttgccgaagaattagataagatcaaggaccttttctttgatcatgagaatgagatatttgccaaactggtttcaatcatgactgatagatttggcactcactctgctgagattaaacgaattgattggtctcaaaatgttcagtcgggtcaatgccatagatatatggaaattcttgtgaaggaaacccttacgatttgtaatgttcttcaaacttatcttcctgaaaatcaatatacctcaatactgagtggaatattcgacaactacaagcgactattacttgccgagtatactcaagttcatttcaaggattctattgagaaggcaatcatgatgagagatgtagattattttagagccaagcttggtgatgtggttggttacaatgactcaggacaggtgatctgggagaagattaattcaatgccaacagatgaagacgaaaggatggcaatagttatgaatggaaatatcgcacaggaaagaaaatctgtcgaggtagctagaagctcattagagtcgtatagggctgccacccctggtaaatggtttggaagaggaaaagaagaaaagattgaaagtaaaaagccaaaagattcgaaaattaaccctaaagagagggagatagtagaggttgaacaagattcgaaagagcagaagaaggaagaaaccaaagaactgccaaagggagagacgaaggaggaagccatagaaaagccaaaggcagagaaagatgaagaggttatcgaaaagcaaaaggaggagaaggaagaagagaccagagaaaactcaaaggagaagaaagtgaatgactccagtccccaaatggttgctgtagagtattccacaggttcagagactgaaaaagtgacagaaacaaaagcgcatgatacttccagtactatccaggaggaagaggacgagaaggttgaaaagaaaacgcaagagaatggagaagagagcgagccacagagaaataattctcagaatacccaggtacctacagctgacgatcaaatccaggatagagtagatatggaaactgaaacaatacaagaaaacggcgacgatacaagctcggttgatgaagatcataaccaaaagacagatattcttgatgagaatgggtccgggacctccaatatagacagtgaagttccagaaccaccttctcttcaatccaggccacttgattcagagtttcaggaactcaataaaaatggaaagttagaaaaactagggtctaaacagactggtttgattcaagaaacgaatactgctccagaagaaggtaaaacagtactgccagaactggatgatgaaaaagatatatctgacatccaagataccagtgaacaagctgacaagcaaactttcctggaaacttctgaaaaagctccccaggaaacttccgatgctaacgatcaacgttcgtctgttgagttgactaaagaagttgagattgctcaggatcaaactgttgcaagttcagaaacagaaggaataaaacagaatagttcccccaagaagaaaacgaaaccaaagagcagaaagaaaaaaggtaggagatgataatataaataagtcatgcatttattcaaagtcgtttgatgcaataaataattcggtactttaaattttagagttttctctttttaatggcatccaagtgggcctcttcaacatcaccaccttctgctggtctgagggctggggttgttacatcggcatgaaagtccttgataatggaatcaacgtcatcaatgtttaaaggtcgaatatctcccagtctcttaatcttagcggtaacttccttgcattgagtgtcagtcaaatgcaagttcaactggtcgacacgagatttgatagcattccagccagttaatctgttggcaaaatgaatatacctagtcaaaccgaagtcagatggtttcaaaatctcgtacgtagatgggttggctaaaatagccttcgcatgaataccagctttgtgagtgaaggcacagaaaccagtaatagggttgttgaaaggaatattcacttgaacggcgtcagcaaccaaggtttccaagtctcttagcttgtgtaatttgtacttggacaacacatactctctgtcagcagcaatcattctggccatcaaaccaccaagaggggtgataccatttctttcaccgatacccaaaacagagacatcaattaaacgagcaccaccctccaaagcggtataggcattggcgatggagcaaccagtatcattgtgaaaatgacattcaatatcacaatgtacaacagttttcaaagtacgcaccaattcgtaaacttgtcttgggttagcacagccaacagtgtcggcaataccgactctgttaacaccgatcttgtcaacggttctgtaaatgttcaacagatcaaccagatcacttctgaaggagtcctcagaggaaaatctaatttctattcccttagacttgacaaactcaataacctcaattgcctggttggtaatgtacgacatgtctttaccatgactgtattgtctcaaaaactgagaagtaccaatgacaacgtcaacaccatccacaccagtttcaactgcaactttggcgtcatccatgtgacatctaatatgagtcaagatcttggccttcaagcccaatttacaaatggcctcacagtcagctctagactgctcagatgctacaggggatgtcagttcaatatagtcgactccaaaatcatctaaggccttggcaatctcgagctttttctcagtggtaaaaaatgagttggcgaattgctcaccttctcttaaggtagactcaatcaactggaagttggagacattacttaagtaatcagaagggttaggcccgtatgggttagcctgaatgtgcttagggttctcctcactaacttttttatagccttctacaaacagtgttagaatatcatcagtcctttcaaaacaaactgtagccttcgtttgctcctcactacttacctggttctggagtcatattggattactttgacgacagaagattggttttattcaattttcccctcgatatactggccgtttctttttttcgtttttttttcttttccattttaaattgataagcgcggctagaatctatttcacctgttcacctaactatgctagatactcgtaactgtcaccgtctacgcggttcaaatattccttctcaattaaaagatcaatagcctttttgatatctccaacactaggctggaatctggcgtgtgattgttggaccacctcgttgatcagcgcagaatgcttgagtactttacgtgctttcatgatacgaacaatacaggcttgaaggaaacttcttctatcatcttcgatttctttttgagcatcgtcatgatcgtgcttttgatcaagcttcactccttgcataaaattaactttcattttcttggacttatattccttgacaactgtaaatttggtactggacttgcctgtgttctctgagccttctggagactgaatgagaagtttgtatttcaccaaaggagtaatgcagctttctaagtgctctggagtcaaattggttatttcatgaagttcctcaaagctgtatgtttcacgtttgttgaatggaagtaatatactcatttggaacaagttaacagttaaaataaatggcggtttaccaggcctggctaggttggccttcatttctccacgacaaaggttccagagccatttcagtcgtctaccggagtgcttttcagaataaagcttttcaaactgttcttttgtacctaatagctcatctggtagggtgaacggttgcttgaattgagggaaaggccatgctgtttgactaagcacaaaaatattcagatctgtattatctgattcttcttgttccttgaaccagtatcgcaagtccttggaagctttcatgtcggcgaacatattcgacatctttgtagtatactctagagaattaaattctttcaacttttgaatgatcgattcttcctcttcttccgaaaccatgttgccgttgatcagtcttctggccagtaagcgtctgtaatgagtttcaaatgcatctttatcggctataaacttgaaaatattcattaattcatcagctgacatatcagcggtagcatctgaatctttagcctttttcttcaataaggtatcaccatatctggccaacaactctggtgtcttcgagtttcctttgaatactgtggggccattattatcaattccgggcatagcgatagagttattgttgatataatctctgcacgcattgtccagtgattttacaaacaacgggttattcccaaatgccatgtaaactacctcattgaatctttcatacacttggagtagagttttgatgtatagttttggtaaaagtgcttgatatttttttgatgcagctcccatggattctgcagctgcttgcgactgtttgagttcagcaacggccttgagaccttgctgtttaacatatgcttcaaatttgattagtaaaggctccagcgtagggggtactcgttgcaacaaggaatacatccggtatatatcttcagtttgcttttgatcaagaagattattgaattcctcatacatcacttcaacatgtctctcgatcaaagcgttgtttaaaacatcagcaagcggtcttttggtgtgttcgatgagaataatgttagctcttgagttttcctctgccagtctcgtatcgacctttttcatatattccacaacaccattagtctccaagaattcatcggattcttctgtgtaaaactttagagttgcatctaagtaagctttctcaaaatcagttatgtaaacgcttaaattttgcttcttaagatcgttgatgtcaaatcccaaagagacaaatgatttgatggcaaatgaaatttccatatttagttcaattttatgcaacctttgcaattcgacctgtgtcaagatttcttctagcaatatctccaaattaggccgaaacataaagtctctccaggttaagagacacaaggtattcacatcataaatatctcttcttccattacttctctcctttttaacccagtatctgttcatgtaatcaaaaacattatttaaatatccagcaccgattgtaaaacggacccatcgacggacataaaattggagaaaagattcctctggtttcttttctaactgttgaatgtattcgatcaagtattgctgtaatttaagatagatttctcctcccacgagagacgcattcgtagtagagttagagcccgatccgtaagacgaatcctgcgttggggtcctggacttgttgatgcaatagttgtagattgcagtgtagacattcatgtacattttgggagtaaccgtggccactgagtcgcttccaagaatcaattggagtccaggttctacaaaagaccatgtagcttttagatcatcagatttgggtagtttctcagccattaacaagagcgacgaagacggtcaagagtaacgagcgagtttgtatgtaatggagagggttcatattgccaaagatcaaagttgggtggcacacgagggattagggaattaagggggggccgagctggatctggagagaacctcgcggagatgcatgaaatacttgcaagggagattgaaaatcgtatttacagagctatataggggtctatgaaaaagtccaaattttaactttgtgatccaatcatgcagaaggtgatacccttgccacaactctgaacagacttattgcaaacgtaatcacccatgtaatcaatgtaatgaacaaaaaaccagcgagaccctgttgtctatcacatagtggagcaacgacgttgtcgtaacttaacgtaacgtcagcttgacaaacccatcgcgtatcgtaaagggtattaaaagtgagtgaaagatccgctgcacagaatatgataaacaacaaatcaaataagatcaatgacattttggccactgggtctcttaatcctaacggttggccatgaaactcatcccacgcaatatatgacagataaactaatgcacacgattgaaccacaacggccatgatggtactaggctgttgatcaattgattcatcgttaaagtattttcttttcgataaaaccataatatggcaggctattgcaagagaaatgatggtaaagatcatggtaatcagacgaaatgacaaaggtatataaggattgctgaatattatcctttcaaatgttatcttccaagactctctcctttcataagtcatccagtatctagatcgaactttggccttttcctttgaagaatcaccttttccaaaaaagaacgctaaaagtgacattcttcctttagccttttccatcttaccttcttcacctagttctcttctcagtctctcatgtcctccccattctttctcaagttcgctattagagtccgtggaattgtctttggtcagcagctcggatggataagcttgacgagcttctattgtttctagaaattggcaccaatcatcgtatagtgtagacacgaatggatcagaattttgttcgttcagttcatttttaccatgataagctttggctatgcgatccagcacatagggagggaatggttgaacattatggttgtaattgttttgtgattctccaaatgggtctggagcttccaacgaggagcaattggagttattcctcttgctactgggcaaggcagcagagtctctcttgtgactctgtgtcttattattggacatttctccgtacttgtctgcggctttgtgttggagaaatgttgctgttaggaagagcagataccggtgagatgagacgaggcacgaactcttatgtcagcaattcttaagtagcaattacgcgaaactaccaacatattcatgcgccagtgcgtggagagattgaaagagcttccccataccagcaaggactttaactgagcgcaaccttcataacactctttcagtatagacccaatcagactacatgagtgtcaggccgtcttctgcgatcatatcaagtgctaggctgcaaaatattccagcccagttgttatccattccgattacaagtaggaaatcctacatctattataagcacactcattccggaagtggtcaaaaagcatcgttggaagaccgagttgttggatgggcgtcccggacatggatgaagctggagacaagtgatttgaaagtgaataaaaagatcgttttgtatgcacacaaattactagatcggattccttgggacgaaggctctctaagatctatacccgccagaaggacaattgcgaaagaatttgaagatcagttcaaagcagagaaacagtctgagtatgatgatgctgctattgggaaaatgattcctctcttttacccagagcaaatcactaacactacccgattgcataaccaacttgtcaatcatgctacaatgggaaacaagtatcacttcaagatgatggtgacttcattggtagtacttccatttacgttgcctttagccttagtgcctgtggtcccaaatatacccggattctatcttgcttatagggcatactgccatttcaaagcatactcaggtgctaaacatttggacctcctgcttggagagcagaatgatggatttcacctcaaatacgtccccgttcacaacatgttgaaatggtaccgtgctacaaaagatcaacagatccaaaagaacattgaaagttatcttgaaaatattgacaacgaagatgccgaagccgcagagttagtcttgctttcagaagaggcaattgaaactctcacaaaagaattggagctgccagagctaatctctccattgaaaatggcattaaaacaggaaaagtctatgctagcaaaacaaaaggaatctgatagagaaacataatatatactcctctttatatttataagtgcatataactatattatcatattatatcatattatatcataatgtcaggatcctagcctaccttcgcgcaatccatcttcaaagccttcagcaaaaagaagttgggcccctgagccctagaccttatcacatgattctctatgtctccacctcgcgcttaaattgaaataatcgtcgcccatttttcttttcctcctatctatcccattcatcattcatcatgagagctaaatggagaaagaagagagtcagaagacttaagagaaagagacggaaggttagagctagatccaaataagcggacaacaattgatgctaacgtctgtggatctatagctgttttgtgatagtttttttacttccatctttttggtgaaacctaattttgttttaaagagttgctattgtgagaaagttttaggaatttgattatatccacatacgtttcaattgtatggatcattacttaccgttttatactgaatatatataaacatgtccgttaactgactgtagcagaatttgcattctacatctcatcacctggtgagcgtgtgaccacatagagaagagtttttgccaacggaggatgagtcttggtacgtatgcaagactaccagaggctgatgtacgaaaacctgtagcactagaagcagtgaatcagtcagtccctggaagctttggtcactcttggatgaatatctgctttccttcatcatttcaactcatctgccgttgagatcgctttttctaaatagcttatgtaatctccccgggtaaccctttggctgcttcgctgctgtagcattcaaccattatctctaccaaactcaccctgttaatacagttttctacagttccttccattcatcaccggttctgtttgctacaacttttctctgttgtattattgagtaattgagaattgcatttaggtaaactcgttttttactagatttaaaatggtatgttgaaatacttcaatcctgtagtcattctagctattaacaccaaattaggctggtgcaattgaaaatgcacgcaaagtgctccataaactcagtttggattcccgtgaatcagactatggtcaagtttttgctgtctccggtcccgtcgtcgtggctgaaaatatgattggttgtgtaatgcatgaattggttaaggtcagtcatgctaacttggtcggagaggtcatcagaattgatggagacaaagcaaccatccaagtttacgaagagacagctggtgttaccgttggtgacccggtattaagaactggtcaacctttatctgtagagctgggacctggtctgatggaaactatctacgatggtattcaacgtcccttgaaaactattcaagaactttcagaatctatctatattccaagaggtattgatactcctgctttgtcaagagaggttagttttgatttcaacccaggtaaattgcaagtcggtgatcatatctctggtggtgacatttttggttccatctttgaaaactcattgctttccgatcacaagatcttgttacccccaagagcaagaggtaccattaccagcattgccgaagcaggttcctatcatgtagatgacaagattttggatgtcgagtttgaaggaaagacttactcgtattctatgatgcacaagtggcctgtccgtgtacctagacctgttgccgaaaagctgaattccgattatcccttgttgacaggtcagagagttttggatgctcttttcccttgtgttcagggtggtacgacttgtattccaggtgctttcggttgtggtaagactgtcatttcccaatcgctgtccaaatactccaattctgacgttattatctacactggttgtggtgaaagaggtaatgagatggctgaagttttgatggagttcccagagttattcactgagatttctggtaagaaagaacctattatgaagcgtactacattggttgctaacacttccaacatgcctgtcgctgccagagaggcttctatctatactggtatcactgtagccgagtactttagagatcaaggtaagaacgtttccatgattgctgattcctcttctagatgggctgaagctcttagagaaatctcgggacgtctaggagaaatgcctgctgatcaaggtttcccagcctacttaggtgctaaattagcctccttctacgaaagagccggtaaagcagtggctcttggatctccagaaagagttggatctgtttccatcgtcgcagctgtgtcacctgctggtggtgatttctctgaccctgttaccacagccaccctaggtatcactcaagtattctggggtttggataagaaattggcacaaagaaagcatttccccagtatcaacacctccgtttcttactccaagtacaccaacgttttaaataaatactacgatggaagctaccctgagttcccaggtctgagagataaaatcagagagatcctgtccaatgctgaggagttagagcaggttgtccaattggttggtaagtctgctctttcagatggtgataagatcacgttagatgtcgccaatttaatcaaggaggacttcttacaacagaacggttactccacatacgacgctttctgccctatctggaagacattctacatgatgagagccttcgtcgcttactacgacgaagctcaaaagtctgttgctaatggagctcaatggtccaaacttagcgaaagaaccagtgacgtcaagcatgctgtctcatcttgtaagttttttgagccttcaagaggtgaagaagagggaaaggctgagttcgaaaagctgttgtcctcgatcgctgaaaagttctctgaggctgctgaatgagatatataaaataaagatacactgcctatttgttttttgacaataattgaatctttcgacctgcatatgtctaactgctctcgttagtcacttcttcaaagtaatagtcgtaatcagtctcatcttccagcaagataccattgcagcaaaaaatgtagtaaatataattggtaaaccatgcccagggagatacttgtggagagtgatgcgatgtttcttctaacttttgcaaaactgctaactctggggcagtataaacggagcctgaggtatgcatggcgctcaatggcgatagagaactctgtaactgacagttacgtattagatccttggtattcattgtacttgggtaagatggctgctgcaaatcctgaacctccggggaatcatcttcactagttgtaagtttcccttgcttagaaatagtagataaatatggatgtttggtgatgtctgtggcttgagactgtggaggtctccaccgaataagcctctcttccataccactgatgaaccagtcatccaatgggaataatcgtgtagcttgtcgatcaattactttttgtcgaagcttagatatctttaaatattcttcggcattgaccagaacaggaggagaatgggggttcaggtccactatagataatgagatttttgaatctgtgccaaaatccgaactaaaatcagatcccatcgacggatagccgccaattgtgttgaaaaacaggtctttagaggatccgacgagaggcgtatccatcatgagaggaagctttgaacttaatgagatttgatcaagctcagattacagataagttggggatttgtatgatgcggcacatcagccgcaaacatggtttgagctaacggccgaaaatgttaccatggatatcgatactttcgtcagtcctaccaaaaactgaacgagaaaggtgttgccaaatgtggggtcgtaagttcctatcaaaactttttgatgaatcaagaacaatttgcaaccagatacaggtttaaacgggaacatcctccatcctcttcccttaaatggatgccagatgtctgcccataataatactcatccgttttcaccgccattatgagccacactcatttaagggcaactcacttgatgaagagagttcacatgcttcgattggttcaactctcttatgagaccaaataaatcagctatagtctagtggaaaatttcatcctgttttgctcttttcctcttgtcctaaggtatgtacgtttcctcctcacaccacactacgacatcttgcagatatagcggtcgtgtgctgattaacgtcgggtggtgttcatggatatctgaatcctggtggtgatcaacaactagtttgaacagaattgaagagtaaagactgtttctgatttgaatccttccctctgatcttatcagattatcattaataagtttttttttgacgtgccacttcagttttagaccgtcaacgtttaacatccagttttttgtccaacttcattcgaatcaccgttgtttgagagataattttcctaaactgctatttaacaaccagaattaaagagtattcaccttgcaaactttgttgaaacactcttacaggatattttacagctcacgggtcttgcagcattacagaattataatcacagaatcaacactataaccccccttagcaaccatggatatagatttggatattcaaatgaaagatgctgtcgaacctgatttggaggaccagcaatcttcgtcatcgtcggagagttttgactttcctatcaataatgtaaattactccagcaaaccagtggaattaacatcttctaatatcaaccagttggacagctggatagaacaacttaccgattgcaaacctttgagcgaagaatctgttaaaaagttgtgtagcatggccatagatgtgctgaagtttgaggagaacgtacaaccagtcaatgtcccagtgacaatttgtggtgatgttcatggacaattccacgatctaatggaattgttcaagattggaggaccatgtccagacaccaactatttgttcatgggggactatgttgatagaggttattactctgtggaaactgtatcatatcttgtcgctatgaaaatcaggtatccgaagagaatcactattttgagaggtaaccatgaatctagacagatcacacaagtttatggtttctacgacgaatgctttagaaagtacggatcagccaccgtatggaagttgtttacagacctctttgattactttccaattacagcactcgttgataataagatattctgtttgcacggtggattgtcaccaatgattgagactattgatcaagtaagagagctgaagagagtccaagaggttccacatgaaggtcctatgtgtgatctgttatggtcagatccggatgacagaggtggatggggtatatcaccaagaggtgctggttttacctttggtcaggatatcagtgagcaattcaaccatactaatgacttagaccttattgcaagagcccatcaattggtgatggaaggctattcgtggtctcaccaagatcttgtggtaacaattttcagtgcaccaaactactgttaccgatgtggtaaccaggctgccattatggaagtcgatgagagacacaatagagaattcctacagtatgatccaagcattagaccaggagagccaactgtcacgagaaagactcctgactactttttatagtcatattgctttaaatgtaagttttattgagagcttgggctttgtagtttctttgccctatcccatgctatatcacacatagcatcaattgcagcttgtctttctgcttttatatcgttcctgaatatcctttccaccatgtcgttcattatagctggcctagacctaccgttaacaaagacgacgtatcttaagcctgggaaagttttttcatatgattcgttgagttcgacaagccttgctgtctcttcagcacttgatcctgctaaggacttttgttccgaatttgaatgagacgaaagcgcagatcctcctttctgggggccgagccttgggtgtgctccaataataccgtttgcaatatgggtaagctcaggatcagctgagctgtttatctcacttagtaagctactgaatagagaatggcatttatctatcagttctttatagtttttaaatggctgttcgttggcctcagtatttatgggaaagagtttgggaataatatattgagtaagagtgtcacatggttcaaacaaatgagctaagagctggattttctgtgtggtagggagatttctgacagtgtctattggtggtagccgataagccattatacttgttcttgtagaaggaagcaactagtatccaaattaaataattgatttggtggcagataagctcggaatattccggtatgcgtgcgaaattcgagtttggatagataacaattgagggattgaatttatggagtttgcgttaactatgctaaagggaagattttgctgaagggtaaattggcagtaagtagggtgccactccggtagtaggtcaaaaagtcggtttgagagttctcagctgtaggcgaccttctacgaagtcagcggacacagcataagatgtgtccaatagttggttcaattttttgtttttcttgtgcttcattcacaaaactttctattcaactcgtgaaatatattcacgtttgttaagtaattgaaaataatactcattacttataatgaacgactttttctagtaaaaccgtccagcaactatagaaaaacacaatgtgaatggaatttacctaaagtgtaccattgaataactgaaattacaaaaataagcactactccaaaaggcttttgtcctgttctaatcctaagcaaagagatttaaaaactttaaaccaaagttttgaacttctgtaactaagtagtccgtgatagtttagtggtagaaccaccgcttgtcgcgcggtagaccggggttcaattccccgtcgcggagtctcttttttgtccctctataccttgcctgcacgattgttttcatacacggaattagagactgcggatcgagcaatttaccttcttcaatttatatccgtaattatttagcatctccaggatgagtacttctgatgacgacctggtccctgagaccgtccctggctacaaggtaggggaaaagaagacgattgaagagtatacaactttggacgctgaagatgaatctctagccaagtggaaacgatccttaggtttgggtgacacatcagatcaacttcccattttgccaggagatgccagaaaagtggttgttttagagatgatattagatattaagggctcagagccaattgttgttaaccttgaaaatgagctggatattgaggctttgaagaagaaggaaatttcttttcagatcaaagaaaagtcgatctattcgttgactattaaatttaagattcagcacgaaatcgttactggtttaagatacctgcagggtgttaagaagaaggggtttacagtggacaaattagaagagccttgcggttcgtatgttccaaatacagtaaaggaacccttttacatcaagaaattcctgccagttgaggcaccttctgggatgcttgctagagggtcgtactcagcaactagtaagtttgttgacgacgacaaaacaatccatttggtgctcccatggtcattccagatcgtgaaataaaggaatcatttattcatttacgttgttttagataacttatttttatctcctgtcaagctaataatagaccagaaacataatatgctcgtctattcgtcgtaattatcgtaatcgtcatcatctttctgtcataatctatttaagttctttttactcatggagattcactcttttcttcttcaattcttgttttgctttccttctgtggttggtaagtgtgcgggtgatactggtattggtattgatagtgatactgatattgggggattttaccggtttggtctgctttgagatgtgactgtgtttgataatctggattaggactttctgcatattgtggaggggggttgtaagggtactgtgggattggaggtatcacgtattgcgacatgtacggattgaaaaattgtccattggccagcgtttgagggcccggggcaggtggtatcgggcccataaagaaaggaggctgatacgttgcaaatggaggtaccgaactttttcgataaaatttctttctcttatcatatttcttgtagtttttcagttcattagccgagccggaggatgattcatcatcattgtcctttttgcctatcaaattttggaaagttttcgatttgtatttcgaaaatatctgactattaggcagctcattggggatattactgagtcttgttttagatagcctttcttctggcgaaatggccttttgcttattcttggaattctcttcggtattaactttggaagtattttttttgaaaatcaccatggaagacccgtctttggataatatatggcccaaattatagtacccagctatttgatgagttaataaacgataataactgttaagtgggtttagtttccaggactccacagcaggggtgtttatgaagtccactatgtctttttccagctttagaatgaaaaaccggtcgttggggttctcgttgaacagggaaacataaagtatgggagtgatttcgtatttttcacaaattgaagtcaattcatcatcgtcctctttccgtggcggcacatttgtgtgattatccggctccttaatcttctgtttctggtcatcaattgtcatcatcaactgcttttgttagtttgagagcaggtgcaaaatttactagagaaattgaactctatgattggactaattggaacttaccaaacttggttcaggtttgggggtaaagttgagagttttgagttcgaacgggttacatctcatgttggttgtcgcgtaattggagacgacgtctccgtcactgattagataagcaatggttcaagggaacaatagggagagagggaggaaggaaattggcagataaggaggtattgggtgagatggctggaatggagcggataaaacaaggtatggatgtagtgctaaagtagtttcagcagctaaaggataattacatgaatggtagggcataatcttcgtctcccatttttctttttctcagtgaatctagtagaagggagtttgcattcggtcgaacgagaagccatcttgaattagtcgagaaggatggaaattacacacactctatgactacagattgatctaccttttccaaatacacttcttttcttccattgaggtgttaaggtggtgaagtatggggcttccccaaattcacatcagaccagctctcgttccgctatttaaactatctttatctccgtgcccgttacgccacctagattggctttttcccctttcgcgatatcaacctctcaatggcaacgtgaacaaaccttgaagctaactgttgtagacacttctcttcttcagtttgaactctttcggtttcttcaattgttgagcgagctacgatatgactgattttgatgcttggacatccaggactctggaaaatgtccttgcaatttctcccgctcaggtgactggccccatcaatcttgatgaactagattccattctcattgagatactgactgagctgggtaccccagaaaaattaccattgagttatctaaacaactgctacgaaagatgctctaccctcaagcaaagggtcaacaaagatcctgccaaactaagtgcgatagataaaatcattgccaatgtcaccaattatggattgatctgcttccaagttcctggttttttttttgaccacacctccttagatcagactctagattatgtactcgagtttatcaaccgtggttttcttagaaagattttgtctaacgcaattgagaacgattccagcttggaagtgttgaatagcattgtccccaatttaatgaacaaacttttggctgtcgatatgattaatacgccttctcctgaaatcagcagatactattttagtgttatggatctactggaaactatccttgcatatccagcgcttgctgcaattttttctgagattgataattttcatccaccagatttgaaatctaacgaattcgaaactcgttctttgctgggaccactttttagatattcaccattactaccagagttagcgtataagaactatgaagcttatatttcaccgggttatgtggataatatgacctctatcaaaggcattcacgaggggtcacaattggaaacgaaactaattattgatagattgttctccttgactaacaagttggtccgtggaggtgagaaaccaagagctgcttttttccgatgggctgcagatttggttaacaaatcgcatctaagagttggccagcaggtaaatcccaaattggtcgcttcaaactctataatgttcaatataactatgatactcattaagttttccttaccgtttcttgcaaatgaaacgaaattaccaaagatcgacattgactatttcaataaaagacaaattgtggattttaccgaggaaacaaagattaattccactctacaagagagtgctgattattaccaggttagtgatgaggtgccgaactttatcagtgactgcttctatctaacactcacttatcttcattatggccttggaggaatctacaattgggaaaataggctgaagcaacaactcagcggcctcagaatggaaattgtaagaatggaggcgcaacagtcgaacccctcaggtttaaatccctttctggagggaattctgagattcaagctgcctaagctcaaaaagacctacaagatcctgcaatccgagagatattcaattcagatggtcaacagttatagggatttacagtctgagacttttgataccttgtcaggtgcaatcaagtttttcattagagtcattgacccatctcatgaatatccttccaaagagttaaagttaccttttgtggaattagcggttgaagatttagatgatccaaatgttttgaggcaaaaatcaccagtgccatttcggtattatcccgagttttttattgaaggattgataaattatttctatgctgtaaccaagcatggtatttaccctctggtttatagcaatcgtaatctcacaacttgggtgcaatttcttatcataattttgcgttgccctgagctgatgagtaatccacacttgaagagtcggatggtagaactactcttctatggaactctaaagaatactcaaggtggtcccggattcatggacgacattatcaattcggatcctttggtttccaataacattatgtatgctctgattgatttttttgttgttgttgagaaaacaggatcttcaaatcagttctatgacaaattcaacactcgttatcacattggtaccattttggagaatttgtggggaaacaatgtattcagaaaacagctgaaacggcaatctactcagaacgtcaagttttttgttcgatttgttgcaagaatgttgaatgatacaacttatttattagatgaatcgttgaacaaactgataagtgtgcacaattatgaggctgaacttggaattagaaagggagaacagccgaatggtgaacgtgacccagcgttgtctgaattaagcgatgaagaaattgaacaaaggcttcaaagttcggaaagtcaagcaaggtctctggtgggattatcgaataaggttatccagcttttcaatctcttcactaaggaacttccttcaagttttgtcattccagaattggttcacagattagcgggaatgctggattataatttagttgcattggtaggcccaaagtgctcaaatttgaaggtcagaaacccacaggcctacgactttgatcccaagagattattgttcaatctatgttcgatttatgttaacctttctaaggaagaaaaatttatagatgcggtggcacaagatgaaaggtcttttgatatcacatactttaggaaagccagacgtattttagaaaagcacgtttatcaagcaactgcaagtttcagacaacaatttattgcatttggggactcagctatggagaaaagaagtcaacagcaacaggaagaactggagatgggagatgccccagatgaatttttggatcctttgatgtatacaataatggaagacccagtgattttgccaagttctaaggtctctatagacagatctacaatcaaatcacaccttctcagtgacccgacggacccgttcaacagaatgcctcttaagctagaagacgtgatcgataacgtggagctcaaacaaaggattcaagaattcaaggggaaaaataaaaccagaactgaaccataattacaatgaatagttgttgtatacacatccatcagcatagttaaagtaaaaagcaccccttaataattgaaaattacagagtaacagtctatttaagctttgacagcgtacagtcttcttgggaaagcaactctgcggtttctctgtctgacagtttcatgagacttctcctcagcagtcaatgctcttcttagagctctggtcttcttttctctcaactgttttggaatgtgttctttaccggcgtaagattctctgacggcatcacgcttttgcaagttgataacggtcaaaactctggcaatgtccttacgaacagccttaatttctgggacagaagctttagtcagcttttgaaccttgagttgagccaactttttcttttgctcgatcaactcggcctccaactcctgctccgacttggctcttaattctttagcgttcaaaccggcctagaatagttagtatcaaagcaataggaccaaagaaaaggaagtgtggatgatgacgccttctttatttgaactgacaaaagtcaagtctcctgagttgattaaatcttgtgcgctttctgttgctgagtactgatcatcattcttgtttcaagtgaagagttattgactgtatctcttcgaatcatagcacattcgccatctatcaaaacagtgccggatcattacaacaaattacggaagttcatcagtccgggcttgccatctcttcattacttttcaaactgtatacataccattttatattagttattgatgtaaggtagagaagaacttttttcactttttttttctaagcgatttcctacaaaagagccaggacgaaaatccaagaatgtttgatacagtgcacgacattatgaaacttacatcagtacattacttagacaaaccaaatcacatgactactttaagggcataaaccttatagtgtttcgagatttcaggcctactattataccgactaccttagtagggagtcaatagattcatgtagattaggtcataatgtatgaagcaaatggtatgataagctatctagctgttgaaatcggcgttgtcatgtttattttccaacattgaccttgcatgtggaaaatttttgtagagcacggagataaaccggatacgtaacagcatcgttatcaggttcccaatagatttcacaaagacgaatgtgccatggaggataactttgcaagttcaaatatggctgaaatagaattagtagatcaggttcttctcccaccagctgtttaagttcatcatcaatgaactttacagttatatcctttggtgatatctcgttagtggttgttagatcagccataactttagtcaaatccacaattgtagctctcccatcaacattagagagaagcacaatttggaggataggcttgtagctagtattcttgtatctttgttggtctatatcttggtccgaagcaccgtagtaaatggcattggcatgtgggacctttatggagaatgtaggcacattgtcggtaccgtaatagactgccaacttcttgtagacggatctacgtaactctgggatgttgttctttagttctcctccatactcataaatagagagatacttaatcccactagctactacccatgcacatacttctgagctgtcactgattagccccgatatgccaccattctcagtttcctccggcttcagattcaaaatgacactgatccgttttgggatcttgttcaacttgctaatatcagcagaaatgactgagggtgatttacttggattgtaagccaattcaaagaaccataatttagtcctattgattgaaaatgtaatgagaccaaaaatgaaaatgttgaagtataatagcaccagtaatccatggtatacgtagaaacttattagctcgtagtaagatgaattgggagtaacattaggagaattgggcgttatcagcgttctccacaaagtattcactgtttggcttgatttattcgccgtaaacgacgggagtgttggtgttttattcgaatcttgattatcagattctactggctgagttccgttttcagtcttggaatagtcttgttcaataggcatgtgaattccttgtttgaccctaaaactacctaaatattagggctacaactcagatgaagaacagggagcaacgtggctggtttatataaatgcgtggtattgaattggagcacctgaagctttgtggagtattaacttttgtgaatttattgttagttccctgttggcgggaagacgattctggtagtggctcgatagttgggagcatcgtcactgtttcatgagatttcagacatgttctaagattacgtaatattaactaatcagatcgggtaatatgcaaaaggttaattatataggttatgcctgcatagtgtatgagttttgcgacgactcatcggagtcgttatcgtcctgatatccttggtaccgctgtcgtattgacgattctgtaggtgttgtttgaagattattgatgagatctttcagctcgtcgctgttgctgtaattgtaagattcatgcattgggtcgttattgttcatatgattctcatccgcttcctcgtgaattccatcatcttcttccggaaaactgctagatgggtttatttcgaatggtacgtggcttgctgtgttagttgatggcaaaaaattttcggaattctcaccgtagagggctgaagaagcgaaggctggtaatggaacagtttcagcttcttgatcaaaatcggtcctatcaatcgaactagaagttccgtaagacgaagacaaattggaggatttaggtttccttggagtgtcctctccctcatcctgatctgggtcaactacttctcctatctcatggtcccgcaaattgtttctttctagtactctcttttccaatattgacttgaactcagaggatttccaggcaaacttgctgtgtttgtacattagatcaatctcttccagaagtaaccctttggtttcatacacacagaaatatgtgaaaattagtcccagaaagttacaaccaccccaaataaagaaaatgttggttcccagcgctgctgtgtggttaccagtgtccactaaatatggggtacaatatgcgaacacaaaattcacaaaccaatttgtagcagaggataaagccatcgacttttgtctcacagacaaaggaaaacattctccagaaacaacccatacacatggaccccaagtggaagcaaagaatgctatgaatgagcacacaaacgcaatcattactttattgacaatcacggaatctgccactgtacccactattccaataatcaaattggaaacagacattccagcggctccagataacagtagttttcttcttccaatcacctccactagcattattcctgggattgttagtacaacattgacagcatacgtgataaaggacatcaaatatgaggtgtcaacacctgtattcataaagaagttgacaccatagtagaaaataaagttgattcctgaacactgttgtaacgcctgtagaatagtagcagtcataattctaaatccctgcttatgtctacttggggatgatctgaagcaatcaataagacgagcttctccaaaacttttttcatagtccctgctagctttaatctcgatgagctcctcaattaactcctcactatcccatggaaggcgcctcaatcttgataaggacgcaatagccttatccagttgatctttactgacgtagtaacgcggtgactccggaagcacatacatccctgtagttaagagtgccgaccaaaagaattggagagcaataggaatccgaaaacttctggaatcattcaagtcgtgagtcccttgagcaacagcactcgagcatagtagtccccaggtgattgaccattgatacagcgagataatggaacctctgatgttctttggggaagcttcagcttgatatagcggaaccacagcagaaataatacccaccgccaatcctgaaataaatctgcccatagcaatcatggcaatgttataggccactgtttgtatgatggtgcctatgttaaaaaatatgagcgtggctataataatagaccatcttcttccccaactatccgatgtcaaaggagcggataaagcaccacaaaaagcacctagcgataaactagctgtcattatagaagtctccacagctgtaaacctagcctcattgcttgcgaacttgcttttgaaatagttcatttccagtaaactattaatgacgcctgtatcgtatccataaagaaaccctccgactgccgctgttagacccaccaaaaaagccataacatctgctgacttgtgatgatctccggggacatttgtgatcctatcgtctccttgcgattctgtatcattggagaccatagagtgcaattcctgccatatagtatcgtcccgatactcattcctgtaggcctcatagtctgaaataggctcagacattactgactaaggctcaaattttcgatagaaggagatgctaccccaaggctcccactattggtctataggaaaaatttacgaagtttgcagtaaagctgattccaggagttggggatctagactatgtcatgacaggatcatgtgacttaaagaaaaaccaaatttcgtttactccccacatattacatttaggagagcttgcaccagtcaaggtttttaaataatggattcagtcagttaaaggagagaaagtctggatatctttttagattactagtaggactgcccttcaaggcttattcaatctaccgttctggaccctgcttttttttttgctccagttaaatctccaacaagtctcgtagcttgaaatgacagttgatcgcgaacggaacatccagcaactgccttggatacttctcgccactaaatcttcaccaattcaactccaatcaactactctcctctttctctaatcatgtcaagagacactttatcgaaagcagccaaagatttcactgccactttagatgagcaacttcctcaaattaacgctttggcggagcaggactacaagggtgctctggacaagctacttctcctggagaagcaaacccgtcaagcttcagatttggcttcttccaatcgaatcatgatatcattagttgatttattgactaaacataatgactggaagatgttaaacgaacaattcagtttactttctaaaaagcacggccaattgaagcaatccgtgactactttgattcaacaggtcataggccatttggatgaaattactgatattgatttgaaaatcaaatccatagagaacttaagaaccacaacggagaataaaatttatgtggagattgaaagagctcgcgtaaccaagattctgtctgatattttgctatccagaggggatctggataaagcaacggagatactttgtgagttacaggttgaaacttatggttcaatggagttacaagagaaaattgagttcattttgaatcaagttgaattgtgtaacaagaaaggtgattatcagtttgccaagatcctttctagaaaggtcttggtgaaatcgttggagaagtttccggagttaaaactcaagttttatcaactaaaaattgctatcgctaatgatgagaatgattacatttcgattgttcgttattacctttctatctacgaaattcctttcattcaagaaaatagacaggaatatttgtcgacattgaccaatgcagtctatttcataatgctatccaagtattccaatctgcaatctgacttgattagcaagattgcagttgataagaatttgcccaagatacctactcagcaacagttaatcaaaacatttacgactcaagaactgatcagttgggaaagtttccaacaagcttatgccacaattttattccaacatgaagtatttgatcagagcacaaccaaaggcaagcaacatttggaggatctgaaatctagagttatcgagcacaatttaagagttatctccacgtattattcatgtatcactttgaaacgattacaggaattgttgcaattgacgcaatcccaagtggagcacaacattaccacattggtcaacgatggaaccatatacgccaaggttaacagaccctcaaaagtggttgattttgtgaaaagaaaaacggaaaacgaacttctcaacacatggagtagtaacgtagatgagctcttggaacatattgaaactattgaacatttggtaaacaaggaagaaatgatgaagtcgttgacggcttaatcaggttcgaatcgttgtcttcgtcttcgtattaattgggactccagaatgaccttatctcgtccaagagctgatatcttttcttgcaactgtccaatgatagacttgtatctattcagttctgtgtttttgggttccagttgatcttgtgaagataaaaggcttgacgggttctgagtctttaatatattgtttagaaactcatacagttccatgacgaagtcagcgttttgctggcatttgttcttataaagaagtaataatctttctgactcttttgcgctgtctctctccccagcttgtgtataaggggacctatcttccaacctaagaagactctgtttatttacatccttgtcgttcaaatcaacgttaagattccgaattaaaatggtgtttatgtttccaacgatggactttatgattttggcttggtcaaaggaaaaattcacttttggttcgttttttgttgactctttgacttttttagcagtttcattctcttgaaggattttcagttgtccaagcctgttcttgacggaggttcgtaggacctccacagcacgagttgcttccggattgtcaagctcaagcaataatttgccaaatgtgtcataagcttgcttgtgatattcaattgcctcttgaaacttgcctcgaactgtggcatgttgagctaacgtttcgaagtcgtaagcttcattgagcaaagtcataaggtatgtaatcaggtagttacctatgcgtgattgagagctcttatcgcttgacatttttcgagactaggaaagggggattggattggcagaaggatgaagctgatatcctatatcttgacaactgctcactgagaggagttttcgatcatttatactgataatcggatttgtaccacgtatttatccgtgacagttggccaaagatatctatgtgcttgagctttcctttatagaaagcatttgcttatataatcacacagtttacccagtatctttcttcaaattcctttttcattaagtttagattggtctaagcgtatgtcaataaaatagtaactatatggagctacttagtgtaaccctggcttttgctttcgttaaaaaaaaataaaactttcagctttcaagttttcccgcctcagtaatctccctctctctacgattctcaccttttaagtggcctccaactctccgttctacttccaacaaccactcatttatccacttcacttcatgaatatcattcagttatgctagatgtccctgatcaattgaatcaagaccaattttggaacttgatcactgagatattatgcacacttcagaacgagtacgttacaggtatgccagaggaagtcgtgaactcattgcttgttcaatgtatcacgttggccattcattgtgaaaataaaaaggcccgtttctacgagaaaagtagtaagtttctgattgattgtgactggttcatagacaacatggaattttgcacaagaaaacttttgagcttgttgcaatacactaatgataacaacactagaattatacaactattgcaaaagaatgatgatttgacctataaagattccttggttcaaaatatcaagctgatagaacatattggctggatcttgtactacttacacgatcaggaagcattaagtaagtttcagtggtttgacattctttcgtctacccttttaaatttctacattattaagagtcgtatctccttagattatgagcttgaattttcgaactacctcttaattagcattgattattgttcaagcttagatgttgaacaattgcattttataccggataggttgcttggaaatctattctcttccttaatgttagtatccaggaatgaagattatgaaaatttcctccaattcaagttaattcttgcccttaatgaacagtttatgatacaaagtcacgagctaatttatgacaacgatgcccaaagttctcgatgcgagaataaagtgtttctcttcatgattcaagatgacaacttctcaaattttgtggaatgtttaatgctccattttaacagagaagatgatcatattctgcaaatactgattcttaaagttttttacctaatatttaccacatcaatgacttgcaaatggatttatttgaatgacttgaaagtattagtggatatatttataagagagcttcttaacttatccatcaccaatgaggccccactaatcaacacatatttgagagtattatatcccatgctttgttttactcagttatccgacgtttgctacaaattatccaatatcaaagacgcacttcaaaatctaattagcaacgaatcatgttccaagaccatgaagcgattgactgagagatgtttagacctcaaattattctccgaggaatctgacgatcaggaatcaattgtctcaaactccacaacttcttctttcagacagcctcctcccataccgttggctaggaagtttcaaaaaagtatttacatcactgacaataacagttcttttgatttggcttcttccaaggtctctcgaactccacaataactagtcaatgaagcattagtacatacaaacgatatattctgagcattacttctacttttctgtgagaagttttagtagttcgtggttctgtacaagatcttgtataactatttaaataacattataagctagcccaaagggagaggatgacttggctgctatacaaaccacataaccgttcttctgagattctagctatcccatcaggccttcgccttccactatatccatagcttgatgggaatcaatccgatttcttatcgagtatctgataagtatcgctttttcgagtgtttctgacctcccctcaaaatccatatcggttaaaaactctctgcgtttacttgtacctatattttgattcttgtatttacaaccaatgctaagatttgtcaaccggtgtgttttgaagccgtatgttaggttcaattcgacaagtgttatatacaacaacaacactcatgaagactacaggttacgctctgctttggagaaaataacgatcaaattggcctcttatccgttgccgcaaacaaccttgaacgatctgctaaggttcaacagcaaggtgatcactaaagacacagaccagatgattttggataatgctaacgatacgcttaaggatatgctcgccttgacggcgaaaaggataagggaactgcgttctttgccgtacatctgcgttcttaatgcaaacattggaactatatatgacacatacttagaatcattgcaattgctgctgaaattcatatcagatattgatgaagacataaagttagaaagtattcaagacttcacaatcaaggacacagcccataatgtccagttcaataaaactttaacccagatcaccgacttgcatgcagataacttggagattctttccaaaggttttgaggaaattgcccatttgagagtcttaaaggatgaccgtgattttttggatagccatttgaaggaaagaatattaatgagactcatatgcaatcaccatgttgcattaagtgagcagttgatcagtaatgagaaatctgatttgatcggcgtagtcgaaaaaaatcttgatgtcattgaaattgtcaatagaagttttgaattcgttaatgatatgtgtttactaaagtatgatgaaaaaatctctatggagattgatactgtcattcttcaagatgatatcaggattgaatcccacaacaatgaccatgtcaattcctcaccaattcatttcccttacatctcttcacacttacaatatattattacagaattgctgaagaacagtgccagggctcatattgaaaatcacgtaacaaaaccaatcaatgtcactattgttgccaataagccgtatgtttgcaataccgtaggtgactgtcatgtttcgaactaccttgagattcgaattagagatctgggcaaaggtattacaccagaagtgtttgacaagattttccaatactcatatacaacgtttgtagcaaatgagggtgaagcctacaaaacattgaacaattccggccctaatgctaacgttataagtggtatgggatatggaatgcctttgagtaaaatttatgtggaattattcggaggagatataaatgtccagacttatttaggttggggtacagatgtttacgtcaagttgactggtccagatatggatttagttacatgacagtgaattctgattcgtatttatcactttattagcctatgtacaggtaatgatgcattttttaagttagttttttatcttcaggttgaaagaaacatctctagacacatgtgaaagtaatcctgcagctctagcccttttgatggctttagataataatctttgttgcttgttacttaacccagtaacgtccttgtgcaaaatcctaccaccagtggttaaatatctactcaaaatctctggtcgacaataatagtccaatggattgactcttttatctaagaaatgactcctattctcaatagctgcattttcgaatctgtgcttcgtagcttgttgagcagagatggtagaaaaatcgattgggtcataagtttgacgttcttgaaattctctcaccaatcttgggtgaatgttgactttcttagtttctacttcttgggccagtttaacctgagctctcatcttggtggattctttgacccatttgttggttgagtatgcacggaccgtcctcaacatgttgccttacttggtacaacccgcggaatcgaaaattttgagatgttaacatgataattggtcggtacacgaaatagtcgctggcataaagtttagagcttacttgatagccatttttatatttgtagtgcttcagggaacttttcttgtggtgtgacaggtacaataacttcttttccgatcccaatcggactgttcttgttttcaaccttggtcgacctatagtaaattagttttacgctagccatgtcagttgagtggtacactatcacataagaaccttatcgtagatatcagtggccagaagtctatctactccacatcccaatgactttggatgatgatgaaaaatgccccctgtgtgtccagtcaatagaaacaaatgaattagactggattttgtgtaatttttgccgtgtctggttccattgtaaatgcgtcgatctaacaaaacaagaaactgacagaatttcagtgtatcattgtctaaagtgtcaacggaccaaatatgcaggcccttcagttatgaaacggaaatccaaacgccaccagcccaaagttgactatgttgcattgaatgatggtgaccaggttcgattcattaacaggcatcctcacattagtcatttcgaacagtttcaaaatgacagacctattcataatttgatttacatggtgagacctaatgatcgcaagacggagaagaccaatggaataatcaacgatgctactataaatgaaataatcaatgaaacacagcttaccaaaccaatattgataccctctgcaaaccctcaccttaatccagacccggagcttaaacgagtataccagctggattttgagtttcccaaggatttaactgtttccgaagtgactgagctagtaggaaaagagacacctgttgaggtaatggatgttttaactcaagagaattcttcatggacaatgcttaaatggagagattactataacgctgaccctaacagtagagatagaattaggaatgtcattagtctagaggtatcagattctattcttgaaaagctcatccaaatcccacgttttgtgaaggatatagatattgtcaattgtttgtggtcatcttcgaattttcaagaccatctcaataaccatgcgataaatgtatctaaaccgaaggtgactaaatactgcctcatgtctgtgcagaattcttttactgatttccatatcgattttgggggtacctcagtttattatacagttctaaggggacgcaaaacgttcatactgtaccctcccaccaagcaaaatttaaaatcttatgaacaatggtgcaatatgccagatcagaataaggtatggtttggctcattggttaaacctcaaacaaaacctgtatttccatctagttataacaataatggtattaaaatagaggtgatgcccggagatttacttatccttccctcaggttggattcatgctgttttcacgcctgaagattcccttgtcataggcggtaatttcctaacttatcttaacattcctacgcatttgttgatctacgacattgaatataggacaaaagtccctgagagatacaagtttcctaacttcaataaacttatttggcttctaggatactttattcttaacggacatgacagcgggaaatggtcgtcatacgaaacacagcaaagtttattaacgttctatcaagctcaattatccgttctcatgaccaaaagtactgataaatcaatcacaagaattaagtcgattatcaagaactctatcccgttcaagctaatagggagtatagagggttttttggatgagtttcaagattctcttaagtatttgagaaaagatcaaccagaaggaccaacaccgaagaggataaaaatgaataattgagtactatctatatcaacgaaatactttttttttatctgaccctatgatcagcttactaagtcaaagactatctttctaattaagaagtcgcaatcctgaagacgtagctcctatttgggtaatctttgtgatgctgcagagttttccctcctcggagacttggtacttggcaccaactaaggactcagatgcaaatcttgaacctttataaattggagtgaacgttccagcacaaatgtcaaactctgcgtaaggatcgaaatctatctcaatgctatcgttagcaatctgatccgactttagcttgattttctgggcttgctcggctctggtacccgaagtaactaacttcaaaaattccccggagaagtaacttgccgaaatgaaattcttatgcttgaatgactgcgtcattgctacttgcagagcgctcactctgtgtgcaggttgtaactttgccctggtaaaataggccgctaactcgagactacgtttgacttgatcttggggtaattgacgacgagcaagctcgattgaaagtcccaaaatgtactcacgacaagtttgaagaacctgaaacagtttttcttcctcctcttgagttttaacagttgaaagaacaactgtgtagattatagttctgaactcctcgatagcctgttgaagcttagcagcacggaaaagcttgaatccttcttgaagtctgaattctaaagtatccaagcctggaataaaaggaaggacttcactagcagaatcttcttcagtatcagcacggatgaaacttggaattggatccaatccttggttacctgctaagtacagtttggaggcttgataaacatccaaaaacctttcacgaagaggctcaaattcgacaacaccaacctgcttattgagtatttgagctgctcggtcaaattgtccagcagcggcataaacagcagcagtgcgtccattctttaaccagtttccgacttcaccagcaacaataggaacatcttcactatcaagagtttcctcaacctcatcgatatcaacatcaaggtcttcgtcaccgagatcccagccatcatcttcttcaaggtcctgggcgtcttcaaagtcaatctcaccaaaagaatcaacaggagctgtctccaggcgagcttcttcttggtactcgtctttcaattcaagagcgtcaacttgacccaatatggcttgttcaaaaaatgataactgagcttgcttcaatggccagtcattaacgtttgggatcttaacttgcggcaaagaaacaaattttttctctgtaaaaggtagcttgatattagcctctgcaataccagaactttcagctatttgagacgcaagttcgtctaagccgtttgatttggcagtagcataggccaatggtgcaaggcctccttctaggtaggccttgattctcttttcaatatcattcaagtatatggaattttggacaattgcagagagatcacctctgtgttcagatatttgtaacatcttagataatttcgtaatatcacctgtaattagataaaaaaaggataatctgtccaattgtttcaattgctggaaaactagttctacaatcttaacattgcactggcccagagcttctcttccaagtttgctccatggaactgcattgttcaatttctttgcttcctcaagggcgatatccaggtttccacattctaaagatagttcaaatctagtctgagggtcctgtacgaattgtaaagcaatttctggataaccttttttctgaagatatccaataatattttgaccaaccaaattagagttcttgatgatacgtaatacttcagtaaagtttttgtttaccaaagccttcttgaatcggtactctgttggatcaattgtagcaacttctacctcaccgtttctattcaagcagaaacagcttctaccctgaactttcgtgatgtataatgtgctagccaaagttttaatgataccgttgtccccattcagtagtgtgtacttgatgtggttaagagtcgaatagatcagaactccagattcatcccattcagcacttttgattctaattgtctcgtgcatagaggtaacgagttcaagtttcctagtagcaatagtgatggtgtgctttgaaagcaaagcaacatatctactatcagcagaccatgaaacgtatttgacattgttcacctgaatttctgctagttcttttctttgttgaacgtcatagtgaattacactgttggatcttaacaaaagtacagttcccggtccagcataaactacatctttcacagtgtaatccaatttaatcgatttagtgacagagttgttcaaatctaatacttccaaagttttagtagacttgacatatgtcacaaacctgttacgggcaatgaaacaagcaaagtttgcagttccctcacggatgttggttggttcaatagcaccagtaacatcctttggcaaagaaaccaatgcgtagtaagcgttatcagcgtctccagtagttatcaaaattgaatgttcagcaggattgtaagacaaagtcttgaagttcgtccatggtttgccaatctttttcagagacagcataggtaagctgacctttttggtacggtagtcataaacttggacctgcttttcattgttgataaaatagagagaatcctggtgaacggagtgagcaggtctttctctgtcaagcttgaacaccatgacaccagaatcatgacatgttgcgaataaattgatttcggggtgcgctgctatcagccaaaatctatcattgtcacgcttgaattgttttaccggtgtacgtttattcaagtcccaagttcggatggttttgtcttcaccaactgaaataatcaaatcctgtgttggatggaacaaaacacatggaacgttgttggtatgacctctacaggtatcaacttcccaagccttgtgttcactcattctccatattttcactaatctatcatcagcaccagaaacaatcaggggcaaagttgggtggaagtcagcccaattgacacctttatcatgaccttccaaaacatacttgaccatagcatcggtgttgccaaagatatcttgctgaggcatattttgtctagcaaattgatcttcataagtgtttctcatgttggcaggtgcactgtgcttctttctcagacctgtaatatcccacacacgaactgtttgatccagagatgcgctaacaatcaaatcttctgatggatgaaatttggcagacataacatagtgattatgaccagtcaagcaagcaatctcctggcgattttgccaattccagattctaatggtttgatcgtcggatgcagacacgatccatggtaaatcatagtggaaaaagacagttctcacgtaatccaggtgtccagaaagtgtaaacagacatttcctggtttgcagactccacaccttaatagaatagtcatcacctcctgaaacgaagtatggttgagtaggatggaagtcgacacctcttacagggccgtcgtgatcttcaaaacgatcaattaacgtacccattcggtaatcccataattggatcgtcgacgagtgcagcgaaacaagtatccaaggccttttaggatggaatgctacacccttagccttagaagacttggattcgaatttggttagcatcttcatcttgaatggatggtggatagtcgtagtttgtttgacaaatggaacacttgtcgcgttgaaacatggggttacccggaacgaaaccgcaagaagcgagaaagtttacagggacaacgagagaacaggacgcagaagagttggaagtagctcaattgtactttatctagactttctttgggcaagcaagctctcgcctttactaccccaatgttactcaagagtttagtatcagagatatattccaatgtctcttatggccttagacaaataatttaaattgtaattttactagtttactatcctaaaggaatcctaatacagatgcaaaaaaggaaatagtagtaaggaaaccagctgaaagagaggcagcggcattatttgacgttgctgatgaagagcctgaagtttggctcatattttgaacgaatccggaagctgcggaggaagtgccagacgaagtagtaggagacgaattattgttatcatcatcatcatttgagttagaagtggaagtggaagtagcactggatgtagatgaactgccggtccttgaagaacttgaagacgatctgctgctgctgctgctgctactgctggattcgtcatcgtcatcgtcttcatcggggtcaaagccagtgtcgtctaaagactttattttggtgctgttattagtaattatgatatccccttggtcaaaagcatcggactctttgaagtaatatgccaattcaccatcttcctcggtaccatctgggacgtcataacactcaacagtcagctctttcaacgtgtagtaaaagtatcctgggtcttggatgtcttcggaatcccagtcaacgtttccaccagcccaagaaactgtacctatcgcattggattcagcaccagccggccagatggataactgaaccctcgatggagtttgaggaaacatgtatttgtctgtagtttcgttataagtgtcttcctttttcagtgtcctgacaacgtcgccgtcaatagaccaggttatgacgtcttccttccagtcaatttcataatcgtggaagtattcaaaggaattgacgtcctcctctagggaaacattacgaccgttggtatagttcaagacaccctggtagtagtagttcgtttcgacttgacttagattataaccaacaaattcccaatcgatttcatcatgcacattggagaataaaatgaaagacgtgacaacaccggcacctctggaagtcttaagagtagctgtgatttttccgtaccacacatagaaggtggaagacacaacggtaccataagactccttgggcatggccaacaatactgagtcgtcataatctattagataaccgttgtaaacccagtcggtttcattagcatcaccaaggtagttggtatcaatttcgaaagcatcagtgctagccttcaaatccacgtcacgacaaactggcatgggtaaacatgcggacgcgttgaaagaatgtctagggtcacatcctcctagacaattcacaccagtcccacatactccatattgactacaacatggtttatcttcagggcacttgttgtcagcatcgcattcaatgacctcgtcagcgagtaccgaagaagccagcaagagtaataacgaaagcactggtctcatttcaggcgaaaataatagcaacgaacgaatgaaaagttcctgaacggacgatgagcggaattaagtatgggtataaaaagggcgtatgtggggactttccgcttctttaatgtgactgaaaaattttagggtcacagtgccgtccaatcaaggcaatgaatggcttaaagtggattcgatcagctaaaaaaaaacaaatttgacgtggaaaaagggtgacacccgttaaagccacctaaatcggtctccatacctactacctatatgtgcagggccgaaattatgccgatatgtaatacactacatgacagagatctcactcgcaactaatcccttttcttagatctttttcctgatggacgattctggtgttctttgatctgtcttacagcttcgttgtggaacttttcaacagtattatgaagggatagaatttcgtctctcggagggacatcctttggaagtttcataccaagaacactctccactctaaggattagttccaagtcatattgtgtgaccaatgagattgagcgaccggaccgaccagctcttgcagtacggcccactctatggatgtaggctttcgagtctgtggggatgtcaaagttgatgacgacatcgaccataggaatatctagccctcttgctgcaacatcggtagctaccaggatcgttctttctctggccttgaatttgtttagggctccaagcctttgtgattgatttaattgtccatgtagtggaatagcactaaagtccatcagtcgtgccaaaagcgcagttctctgggcatgggcacaagtcctggtaaatattataatggatttgttttgatatttgttgagcagatagatcaaaaaggtgttcttataaccgtctggcacaaccatcagtgactggatcaaagagtcgacagtactgtatttggaagataccgaaaccttgatcggatctactaacgaagctctctgtaatttttcaattttattggtcattgtggcagagaaaagatatgtcgatctctctcttggtattagtttcaaaactttgtcaatcgctggtccaaattccaagtctagcaacctatctgcttcgtccataatcagatatttcaatgctttcagagaaaaccccttagtgttttccaagtggtccattagtctccctggggtagctacaatcacatggggttttctcattagatccttggcctggtcaatcatatccataccaccgacaatacaaacagaacgtaatcccatgccacttcctagagagtcaaaggtttccttgatttgatatgctagctctcttgtgggagccaagacacagcaaaagaatggagttgcctgctcataaagcgattgcaaaacaggaatagcaaacgcagctgttttaccggaaccagtctgtgccaacccaattatatctcttcctttcaaagcgtatgggatggattcagcttgaattggagttggcttggtgtatttaagcttctcacaagcctctaaaatttcagggacaaggccaaagtcgttgaagctttcatatttctgttctggttcttcaactgtatcgtctattttatcttcttcctttggttctagagtttcgtctgcacctacagtctcagttttttctggctccgggatcttctgagcctctgccttttccttgattttacgtatcagctcatttgtatttgacttcgatgagggcttcttgaccttttgaaccttcttggttacactgggggacattgttgctttgcgaagaatgcgttcaaggtgttaaggaagataaaaaaactgcagagaaaatttctgaaatccaaaaaaattcatagataggatcacgtgatttaattgactgatgaggtacgtttaagtacccctggacattcgaagacaagcatgttatcaagtaaggaagtaagttcatagaggttggacagttactctaactaccggagcttttcaactcttgtatccacttcgttcccatcttttatctttcatcatcaaaacacttgacttgtcacgtgattggattgggaaaaaaaaattcaagcaaagagaataattttcttcttcaagaatactaatacacagaaacatggccaacaaagcagctcctctcaagaaggaccagcaaccggtagaggaagaagatgttaatgttccaaagtccatgatcattagagttggaagctcttttcacaacccttcgctgcaacaattgagtttggatttaagagtattgatgcaacctcatactgcaattaatctgagagaaagaagaaagaactgtttaaaggattacgttgtcatgtgtggaccattgggtgtgactcagcttatgactctgtctcaaaacgaaaagaccgcaaactgtcatttacgtcttgcaagtatgtctaaaggtcctaccactacttacagaatcaaagaatacagtctagtgaaggacattgtgaaaaccttgaagcatccaaaaatggtgggaaagagttccaccatttttcaaagacctccattattggtgatgaatggatttgccaatcctaaggtcgctgaacctcatgaaaaggtgatgataacccaattccagaacatgttcccaccaatcatgccagaaaagataaacgtcgacagtattcgtcgagttttgatgattaacaaggacaaggaaacaggggagattaatcttcgtcactatgccattgataccaaggtagtcgatgtaaataagaatctgaaaaaaatactgaatgctaaaatcaagaagaacaagaaaatgccaaatcttggaaatatcaaagatattagtgaaattttagaagatagtcatcatctgggttacaccagcgagtcagaggttgaagatgaagagtctttggtgcaggttgacgagactgaatcactgactaaggccaaagttattaagaacgagggaggtgccaacaatattagaaagaaggccatcaaattagttgagcttggacctcgtttgagaatggaactagtgaaaatcgaagctggggtctgtgacggagaagtgttgtaccatagatatgttaaaaaatctgactccgaaattatacagcagaagaagaggctgtctcagaaggaaagtgagaaggcgaagcgtagaaagatccaaaaggagaatgtggacaagaaactggccaagaagcaagagagaagaaaaagacagaaggaaaagtatgaagccaatggttcggctgtgcctgagaatgataatagtgccgacgagagtgacgaggaagttgatcttcgccctgaagactatgaaaatgacagtgatctttacagtgaatagatatacgtaggagtgactagtataaattgataatatatcaggaatatcagtagggatttgatccttcgagccaaggcgagggtcagttgacttttactaagtctacctcaattcgcttcttacccgacctcgtttctccacattatctaattttatatactttgttccttatctatagatagaagccttctttgtttccgattcaaattatccaaccataacccaaccatagaagatgaacgtaccggcatggcagcctgacagtgattcaacacagtgtcatatttgccactcaaagttcactttgctaaagcgaagacatcattgccggaggtgtggtcacttggtgtgcaatcgttgctccaataacttcatcaagtatttgccttccacctacgttgtttctccaccctcacagatatttttggagacaccacatgtgcctcatcgtacatgcgacaagtgtcatttggaagtaaagacactaaaacgatgcctgctggaaacaaaccagagttccagtagtgtaaactcttctgtcaacgacaaggaccgtttgatgaacaagtctacctcatctttgtcacatacctgccctgtgtgtaacgaatcattattgacattctcagatcaagaaagaatagaccacatagaccagtgtattcaggataatgagtttatcggatctcccaagggcactcgcacactcaatagaatgcttgtctacaactataaagatgtcaaggaaaccccaaacgagtgtgtgatctgtttagatgacattgtttatggtgacaaggtaggtcggttggaatgtctatgtttattccattatcagtgtataaaagactggataaacaagaagggtgtctgtgaatgtcctgttcacacaatacactactactaggaggaatcattttttctggcgatgtcgtgcgcaggcgttttaatgacagcatatgtttggtggtgccccccaggtaccagttcacataaaaccgtgtaaaggattcaaaagtttattagtggatagggattgctagatttggcaataaaggggtgatgtttggatgtttgtttcagatattgttaggtgctaaatattgcgttctatttgtctagacaagctagttgagaatatactaacgttaaacaagtaacggtggcgtgggctcagcgaagatcaaacaaagtattctgagcccagtggggtctttcaagtgttctttcttgtcttcgaatcccgggaaggggtatcaggttaactcgcgttttgaacagtacaatttcgcgttacctgtgctacgaatttctgtaaccatgcaaggtgataaattgaacaagaaatataaattaccgccaatctgtggatttgccggcttgtttcacaccttgttgatatggacggcgtatggctggatgatgctcatgaagctcagaataatgacaaatacacacagggtgaagacagtaggataaagttcccctggttcaagaaaagatctcaagaaaagaagattcagatcagtaatccctttgggtttaatcatgtattgcacgcagacaatccaactgctgaatcaaatgtcaccagaaataatagcgtgaacgaaagaaggttaacgacaagtacaacaaatagtgttttcaccagatcaacttcgatctctacactggccacaacgcatcatcacgggtttcctcgtcacgaaaagaaaccaagcttacagtctttggaaaggatcgaagatcaagtgaatggtttgaaatgcgagaataatctttacaatcttcccgtgcacggttcggactgggggttgacacttgaagctagacagaaggaatgcgatgctgaaattgctagattatatgaagaatactacgagtttgaaaagaatttgaacggtagttcttatgacacgacgattgcgtcgttgaatgctgctgatgttacgaaacgttcaaggatatagagttatagggatgcttaatttactggggtaattaattcaaaggaagagcgatggcgcgtgtagcagagtgatcgcgatcgcttttataggacacatcggactgaaacttggtggacctcgcactgctacaaaatgacattggagcttgatatcaaagtggaggagttgagcataaacccagaaagtggtttgaatcttcctttagattgggagaaaccggtgattcctgagaattacaatcaaaatggaagccagggtgtgagaaaggaaatagatgaacaatctgcaaagcttattcttcttctgaatttgatagatgaatatgaaagaaatcttgtagggatatgtgacaaactggaagcagggtttctacaactatctcgagccaaattttacaaccccaacagatttgactcttcgtactatgatttgcgggaattgaaagcccaaagccagttcaaggatgggaaattgtctatgcaggaagcaccaaaacctggctccaagtcagaggaaaaagaaaaggaaaaagaggccgaagtgtcaacgttgaggaatagacatcaaaaaagcttaaaaaccgttaaggaggaaaagcttgacgaaaaatcgaaaaactcctctttcaaagaccccataaaaatgtttggcgctatccttcccgcttctctgtatgaatcacaagctgctttcaaacaagctttaaaactcttagtggaaaagaaacgtctagtagctgaaatgagcgtactttttgacaggattgaagaaatagaaatggaaaacgcaaaggcagagtcgaaggataaggataatgtccaagaggatgattcacctaaaaaacacaatgagcaacaaaccagtgtgtagtagcacaataaatcaaaatgaagaaacaccctcttggtgtctaatcttccaattgtatcttgattatagcattcttccatgaacttacctaatatatgatgattccccttaacatagcttttatcgcgatctttgaggtacaacctatttactccactaatcaacttttcaacaacccataaatggctgatagattgacccaacttcaggtttgtttggatcagctcatagaacagttttctgccactattcattatgttgatcagcatcacgattcagtcaacttacctgagaatgatcctaagatagtagatcccgatttgacaccagacagtgaatttgattttaaaaacaccataaatgaactttcatcggacattttattgaaaacaagacaaattctggccataatagactctcttcctggagtgggagtttccaagaaagagcagatgtcaaagatccagaccctgtcagaggaattatgggcaatggaaaccctgaaacaggaaaaaatcgttcaaaaagacgatttgttagattgggtcaacaacctgataatgaatttgagtgagagcatagcaaactctagagattagaagggatccaatccacacattatagataagcaaaagccaatcatattaaaaagtaaacaaaactaacaagaatatctaaagttggggttttccttgtctgtcaagtcagcaaactccaggtgctcattagtaaccttctccagcttatctttggcaatgtttcttctccagtaaacatagtagatagcagccaagaagataagtcctgcaatttggttgaccacaatggcaattttggctccactgtaagatggagcttgggaggagataaaagtttgaggtccgaccaagttaccaacacaatatgcgaccaaatatgtagcatttgttgtcacctttttagtgtggccggcagtgttggaagcaaaacaagacagagcgcagatcataccaatggggaaaatgtacaaggtgtagtatccagcaagtctggctttagctggtccagcaaaagccagcaaacacgaacagatcaatgtgatactctgagcaataagagcgatgatcattctatgcttgaaccatctaacagtgtaggccaatgcaatgcagcctaccacttcaacggcaccagttggcatgttcatcaatagtgtagtggtcttggaatatccaaagtcgtcagatagcaagatggcactgaagttggttaaaccaccgttagggatgttgttggaaatagcaaataaaacaaatagccatgtttgaatgtcagtaagagcctctttgatttgataagtcttaatctttctgttaccgaaaccttgattgttggatcggatacgttcaacgaccaagactttctcctctgcggtgaggaaccaagcttgggtgggggtgtctggaacatggagcatggtcacaaaacccaagaagatagtaatacaaccagtgatgataaaaaccagtttccaagcatgaatactatagttatctctaatggccaacccgtaagcgataccacttcccataatagcaccgacaccgttgaatgcaaaccaacatgatgttctaagaaattgctcctctttcttgtaccattgggaagtaataatcacgaatgcaggggtaacagcactttccatcatacctagcagagttctcaaagcaataaaaccagcatattgcggaacggaatgtagacaaagaagaacaccccaaataataatgaaagttccaacagtcttgataacaggaagtctttgaagcatataagaagcagggaaaacaaaagccaagtatccaaggtagaatgcagttcccgtccaggaatacatgtcacctaccatgctcaaatcttctctcaaacccatcactgaagcgtaggagttggagactttatccatgaactgacaggcgtacaaaatacacatcagaggacccaagcagagatcaatcttccttagaattcttttgttggtggcttcatcaatcacaacaccctcggcggcatatcctagagcaatgtctgcatctttttcagtaagaacaatttttccagttccaatttggtggtcattagaagacaccgagtttacggtggtatcgaaggcctctcttttttcttcagtcatttgattgtgatgtgtaagaatactgaattgagcccaatgagggatacctcaaggttttatatactcctatccatcgagcgaatgtattcagggctctgcagcaagatagtagacgatctaattaactgtagatatgactctgacccttattctatctaatgcagcctcgccagccatatcagataacaccatctactaatagtaccacatcagattatactttttcggacttaagcattccttatggggttctgttcagccatgattggagcaattatatttttaatgatatgtacaccacgataatctcgtttacctttataatgcactacggtaaagtcatcaggaactagcatggttcagtaggcattaaaaaaacgcccaatgagtcggcggtggaaatgcgcactgcatgagtccgccgcaagtgcgaaaaagcttgaccgtacagatagtactcgtttaatccgttatcttaacaacaacaaaaagaaacaaagatactaaaacctgtaatgttctccgatacacactccgccgagtcaaaactcaaaaggagataacgacaggccagatatactactgaaattgatcgcaagggatgtcccagtttggtaatagtctcgaacccagacaggtgtctttgttccactctaacccataaacgattggggcataccagtagaagaagaaacccgaaagccctaatattgtcataacgtagaagaatcctacgatttttcccagtttagcccaaacatattcactgagcacagcgattgatatgataccaaaccatagagatggtatgtagtggtgcagaaatagctgtcgctccatcaaaaaagatggagcgaaatggaatagccaaccgacaaagtagatgaaaaattgggaatcatatttagctgaagcatcggttactgttggagcatggtttggcttccatttccagagctgaacaagcttgaaaacaacgaatactccgatagtaaatacaattccccaatagattggcaagttacctaacaagtagatcgtccttcctgatcggttgaaatagttcacacctctgtcaagaacgggccaatcttcgggtctagagctatacttgtgagaggcagtcaagcctgcatttgttttccacattttttggtgcagctcaagaaacttgccaaaaaatcctaagggttcgactttcacttttgcaggatatgtttggttgaaaagtgggtgtgtattctcttcaatgtaccacagagaatttttaaggactggcgactcgatacaagtgacctccaattgaccaaatccccagtcttttggcagcttcacacgatgaccaaacagagtacatttggtacccttatggaataattgaaacacagttccgatggatttaacctcatgctttgcatcttcatcactgtactctttgataatcttcacctcaaagttttcattgacatcggggacatagtctttgtctcctataatactgacctcattgttgtactcttgctcactaattggaggtctagaatcagagacgtgcaaatatccttgggttttcttgtgaaataatcttataacatctctgtgtcggaggaaggatacctcgccgaatagttccttgtcagatagcttatctttcttttcaatagtgaaaagattattggagtctttgtatccgtatagggttacctgttggttgtgcgatttaggatatgtgtggttgtgggagtgtagaaactctcctgtaccaaggtgtcttatcgaaacggtggatccaaaagacacgttagcataaagattggaaaaatcagttccgtccaaactggctttgaatctaggactcactgtacctgaaccgccactagcttcatggagaaccaaaaaatggattgcaaacaccccaaggtaaatgatcactggtaggataataagaaaatacgctctgtacaagacatgctttaccacatcacgatcgggaacgcttaagtctccaattaaccaccacaattggtttacagtcatgactcctaaccaaccaattgtgaatattccaacccatttactactgacactgagtcccaaggacacaccagtgaaaaatagatatcttatccagcctttgccaaaaggttctggttcattgctgaatctcacaaaactgtatactgtgagaacaatgaataaaagcaatggagaatctagtagaataaatcttgattgagctaccaatgagttttcaatacaaaccagtaaagctccaaaaagtgcaataaaatgtcggcatccgctgtatctaaggataaagtaagaaagaataacaatcaagactccacaaattgcgggaaacgatcgcatcaaaacgtagggtaccaatttttcaccctctttaccaatgtagttatccccaatcttgttgaaaacaaaatctcctctgtaaccacctaaatagcctatggcggcgtaaagcatcttgactaaaggagggtgcacatccatgaagtatgagctattgatgtagtttcgggcatattttccaaaatggacctcatcaaatacaatttggttggggtattgaatattgaagaatctcacggccactgtgaacgcaagaaacaaagccaattgtattttttcaaagccgcttagcgttataggtttcaccaatggcttggtaaaaaaatagggtctttgaatgccctttttgtactcaaaggcggccatgtattgttgtgctatagtactgtggtgtggtgtcctttggtaggtttgaccaaatatctcaggagtcatttcgcgggccaccaaccacatatattgaggaatcagttgacatagaagaagaacaagtaagagggcttgagctagaatttctgtaagattatacaaaactaggcagtctaataagaagaatgtcataattcgttaaaaaaggtgatctcaaaatccagtacacgtaatatagtaatctcggggagtttcatccctcacatttatctcagacagcatacacatctccatcctggtcttgcagttcgtttaccaaatcctgacagtcatcgttgttgaagttccatcctaatttacgggatattcttagggtcttcagacacggcaaccttccctcagagagagcaatggttaaatcgtcgggatagattttaaacgattgacccaacatgccagaagagtctaaccagagagtcttcaaaggccttggtgcctccaaagcaggaagcaattcttcgtcaaacacttctcttgtaatgtaatcaatgtgaatgtagagaaactgtaaattggggcaatactggaagatcatatccatcgaattcgttcgcaacccaggcattgggtaatgaatatacagatgcgtcaagttagctccaactttgtccagtacatgataaattccatctgcgtgtatcgaaggacaatgggaaaactcgagataagtgactgactttggaaggttggatctcataagaaactcatcggaaataccgccacttaatctaaggtaccaaagtttcttgggccaaatgtgcttcgtaggttcaaaagagaccgaagaccgaggaaacgacagttgttccaacacagggagtctctgcagggaggtgaataattcttcaagattcatagtttctgaaactagtctcaggtccagtatccgtagttgagaacattgccttaaacttatcaatggagaaaatccaaatttcgattggggtgcaataaacgttgttaaattctttgaacagcgcctcagcaatttggatataaatgaattcttccccgattgaatgatagtcgaaaggtctaactctctaacatagtcataattcttcttcttcttattgctgtcaaatatactttccatgaaactcatgaaatttggagatgtcagtttaggtctatggtaaagttcaggtagcagtatgtggtacaatatcttattcaacctcaagtaatgcaatgggatctgctcgttcttcccatagctcaaacgcaatatcattataataagttccaaaggcaatttgagccgattgtcttccttctttttcatggtctccaacttcaactggagaaacctttggaacccgttgtcctgatataataaggcaacttgcaatatgttaaacttgtggaactcactctccggccaatacttgcaagtatcaaatactcgctcatatgacatgcaaccacattgatcacagaacatggtactgttaatgtagacgcatttgccacacttattgattgacagctggtggttcacaccctgaacttctcctgttttactttcttcatcttcatcttcctcttcttcgtccttatttgctctgctgtcggtggctgccccatacacatacttcttatagggcagcctttccttcttgggtctgcgtttattagctattttgtggcaggagctctactaagaagctgtaatgatctaacgggctgacttttttcttgataggtcagtggtttcgctaaaggaagaagaggagaaagttcaagtcagaataaattcgtctcgttagataagctcgaagctgatctgtggtacagtaagagaagattagaggagatgttggattgagcttaggaacttaagacattttgttagcaagcttcgatacgaacaataaaaagaagctgatggagtcatcatagcgtcttctgtggtttgtgattaccaggctttctgaagaaccttaatagttagcgttaggccaatcattaataaccttcttgggaatgaccaacaccaagagaatatgtgaatgggtattttgggtattgaccatagactgaaactgctagagtgttctatttgttgttctggtaccgattttgaacatccagtgtcgttcgtgctcaatgaaggttcttgataagcaattgttttgatagcttgttcaagatggctcaatcgttcagtcagttcatgcaaacttttgagttcatttttatctgtcttcttttccagattctccaactttttgtacacatcagtgatgaaaaacggcatctccttgaaacttcgataggaaggtggttcagatttgacaggttccgaaggctggtttggctcatcgcatatttgggagatataatcttgaacatttttgtgaatttcttttccccattgtcgtatggaaaaagtcgtcaagagaaactgctctgaattgtacaatagatcaggcagaggtctagattccataaagtaacgtttgaccaaaatgaaacaaagaagagctagccctgtcgcaattattccccagccaaggaacaatgctctagactttctttgtctagcggccttgaccttcaagacaccgtcgtttcctctcatctccaggtacacatcccattgccaccttattgtctggtaaacggaccagcctattaccaataagaaagcaatttccagacactcttgcaatcttgaaattgccttctgaggaataaggtacgctactaccacaagagtcactatcaatggaacaaggtattcgtttgtatcattgagggtaactatttccagtccaaatctgatcttaggctcgcttctgcccccgatgaaactgaacttcttttccatctttgaattcggcaaattggccccgttcactgcagttttttccaccagccgaagatttctcggataaaacattctctaaactgataagattagatcgtagatctatctgatttagatcccaatgagattcgcggggttatcactatttatttctaactaagataactacacgccgaataattttagtaggagtagcggaagaatgggttttcaatatcagtgaggtccatgaactcgtagttgcatggcatctccacgcgctcctttttttctctctttgcattttgttttttggagatccatcttattagcatgcaagtggggatacagacactggttaagactaagagggctattttggctgggtagtaattaggagcatcctctattctgaacatttgaggtccaatcagacatcctagggcaaatccaatcattgtgaaacaattacgggctaatttcttggtgtaacctgcagtattggctccattccaggcaaaaatcatggagattatacatgttcctggttgaagaagatagatagcaagcaattttcccaccttattcttagggttatcccctaaacttagaagcataatgtaaccaacgattgaaggaacgagcaacgagattgagatccaagttcggtggccaacctttgacgaaagataagttgcaccgagaatactgataataacagcaacacctactggcatctgaaccagagcactttctttagaggtgaatccaaattggctaataatggtgacactgaaagttcccaaagctcctgtagcacacatactcatgacagtcaagaaaaacattggccaggtgtgaggatctttgaaaaataactcaactagttggtttttcttgaaatgtttagtttcggttcctgtttggttctctctaatgtgttctaacactatcagtttttcatcctcagataagaatctggcactcatcggattgtttggtaaaactatgaacgttaccaatcccgctaaaaaggttatcacacccattaccagatagtatatctgccaactttggagcctagcattagtgacatgttgaaaggcaaatgatagtagtccaccgacaatgctggcagtaccagattgaaccgaccagacaccaactcgcctcatttgttcgttcttggtataccacattactgaaatagagaccagtccaggtacaacgacagcttccaacgcacccaatagagctctgattaccatcaaactggcgtaggtgtcgcatgcagcatggcaagccaccacgattccccaaagagtgacacaagtagcaattgttgtagcgggagggaatttctgtaatgcccagcagactggggcttcaaaagcaacttgagctacgtagaagattgtactcagattgttgaactgatttcctaccagattatctttgatacccatcacagcagcatagttcaataagaacttgtctataaactgcaagaaatatattgctgacaggattgtcatgactcgaatgtcaatcttaaacttcagtttggatggaaggtcagttatcgactcagtcaggttgatattctttttcttgagatacttgaaggcctcatcttgtttaatcaaagactcatcatcggatgagctgttgcgtttctcgtggtccatttcgctcgctgaagaacgagcttagctgaaatgcaccctcttatattaaatcaagaaaattatccaacacctatcatggggtaacctgagccgtaggcatctcgtattgccctatttggacttaagggtgagtcagctacatatagccgaaaaagaaaaaggggaaaaaagcaagcatctgctacgaatagccgggcagactgaatcaaaaatgcattgaatggagcctacattacttttaacttttccagtccacactagcgatagattcaaattgatgattgcattgctctttactacatgatgaatcaaacgactcaaccccttttaggcaactcaccagtcagaaactcttggtagggagaggaaaaaatgaaaaaccgtttgtcacgtgatagggctgaagcctactttgtgccgggtaacttttttggatgttctcccacttaattctttttcagaggcaaaaatcttttctgcatcaagtatcctacaccatggttttagtccaagatttattgaaccccaacccagtctccgaggccaagcaacacaaactaaagactttggtccaagctccaagatccttcttcatggatgtcaagtgcccaggttgttttgagatcaccactgtcttctctcatgctcaaaccgctgtaacctgtgattcatgcaccactgttttgtgtactccaaccggtggtaaggctagattgtcagagggatgtgccttcagaaggaagtaaaagaattattgaagatggttgaaagaagtggaacgatcaagaggataacgtgtaaatggtcaaaatcactatcgttatttttgcatagtcatgtacattaatgttcaagtgaagtgtaatattagagatgaactgtaggaaagttggacgtagccagacttttgtctgttctagttgtaagaagttgctattgtagttttctttggtcgtgtgagtattaatagttgatccttttgtctgtggtttagttgtaaaaatgtcggattatgcgttcgagtccaagatactgcattaattatcaagcaccgtttaatcctgcctcgtttgtcgtaaagcttatccacccctggatctcgccttttttcgcaccagcccaattcgttaatggaaccgtccgttccatttagagacgtcccgaaccagcagttggttatatgaattcgaacccctggcataaatgtcacatgaattcgtcatcacactccgatatcgtagctgtttcagcatccggatgccaattaaacacaaaggtcgcctaataggggatgaagcatcttctccacggagtctccagctctaaccgtgacgcgtctctcactactttcgaactgtcgtgtcctgcttgtctttttagatattacacgcgtcagtttgataacgcgcgtcttttaaataaaatctctagcttaagtttttcctttataataaaacacccatccaagtaacgttcctaatatcctctcaaaaaactaacaatgtacgttttcaaaagagacggacacaaggagcctgtcagatttgacaagattacagccagagtttccagattatgctacgggttggacccaaaacacgtcgatgctgtcgccattactcagcgtgttattagtggtgtctatcacggtgtaactaccgtggagctggacaaccttgctgctgagactgctgcctatatgaccactattcaccccgattatgccattttggcagcaagaattgctgtttccaatttacacaaacagaccactaagcaatactctcaggtaaccaaagagttgtatgaatacatcaacccaaagaacggaaaacactctcctctggtttctgaagacacttacaacattgtccagaaacacgctgatgagctgaactctgctattgtctacgatagagactttcagtataactactttggattcaagaccttggaaagatcttaccttctgagaattaatggtaatgttgcagaacgtcctcaacacttgattatgcgtgttgctatcggcattcatggtgatgacattgcaagagttattgaaacttataactttatgagtcagaagtatttcactcatgcctctcctactctgtttaacgctggtacccctcacccacaaatgtcatcatgtttcttagttgccatgcgggatgactcaattgaaggcatttacgatactttgaaggaatgtgctttaatctccaaaactgctggtggaattggtttgcacattcataatattcgtgccacaggatcctacattgctggtactaacggtacttcgaatggtattattccaatggtgagggtcttcaacaacactgctcgttatgttgaccaaggtggtaacaaacgtcctggtgcatttgctttgtacttggagccatggcatgccgacatctttgccttcattgatattcgtaagaaccatggtaaagaggagatcagagctagagacttattccccgctttgtggatccctgatctgttcatgaaaagagtagaacagaatggcgattggaccctgttctctccaagtgaagctcctggccttgccgacgtctatggagatgaatttgaggaattgtacgaaagatacgaaaaggaaggtcgtggaagacaaaccatcaaagcccaaaagctttggtacgccatccttgaggcacaaacagaaactggtactccattcatgctgtataaggatgcttgtaacaaaaaaactaaccagaagaacttgggtgtcattaaatcctctaacctttgctgtgaaattgttgaatactcttccccggaagagactgctgtctgtaacttggcttctattgctcttccagcctttgttgaaaccgatgatactcactgctggtacaactttgaaaagctgcatgaaatcaccaaagtggttactcgtaacttgaacagaattatcgacagaaatttttaccccgttccagaagctaggagatcgaatatgcgtaatagacctatagctgtgggtgttcaaggtttagctgatgcttttatgaagttgagaattccttttgattctccagaagccaaacagcttaatattcagatttttgaaactatctaccatgcagctttggaagcctccaacgaattagccgtcgaagaaggagcctacgaaaccttccaaggttctccagcatctcagggcattttgcaatatgacttgtgggacaagaagccctctgagctgtgggaatgggaatcactcaaagccaagattgtttccacaggtttaagaaactcgttgctagttgcacctatgcccactgcttcaacttcccaaattctgggttacaacgagtgtttcgaaccttacacttccaacatctactcacgccgtgtattagctggagaatttcaaattgttaatccttacttattgcgtgatctagtggatttgggtctttgggacgataacatgaaaaatcatatcatttcagacaacggctctattcaaaatttgcccaacatacctgagcaacttaaaggcctttacaagactgtttgggagatttctcaaaagactattattgatatggctgccgatagatcagcctatatcgatcaatctcagtcgttgaacattcacctgatggctccaactatgggtaaattgaccagtatgcacttttatggttggaagaaaggattaaagactggtatgtactacctgcgtactcaagctgccgctgctgccattcagtttacagttgacaaggttgctgttcttcaagcttctcttaccaaagccaacttggaccaattgaacatgagaaagtatcttgccaacccggccactgacagagttactgagacatctttcacttctgtttctagtaaagaaaacactccagatgttgctgcagcagacactcaaccaagttccttagagaacagcgttgccaacctaaacattcaggaaaagcctgaagaagtaacagaaaaggcgaatgaatcacaagccgaacctactggagaggatatttttagttccaaagctatcgcttgcgctataaacaaccccgaggcctgtgagatgtgttccggttagtttgagcaatatttcttgcaagagattgtatagtatggattccagggttttttatgtctaagtaatagtttaaagaaagtataaagcgacgaattgcggcagcaagatcatgcaaatcactgtggttaagtacctcaaaagctcaaatcagccaaggaacctttgcttgccgctttcaaatattacatcattgtaaggattgtatcttcaattaatatttttttgtttctcaactgattctccgatctcgcactttcatgcaacaagatgattcagagataatgataactgacaaatgcaggacaacttgaaccctcgaacccttgatctgactgcaccttttttttgactctactgcccgacatataaagacatcatcggacccttagcatctgttgaaccctgcatttaacatttgaagaagggaaatggctgagcagctttcttctggtaagaaaatcattttgctattcaaagagctatcatggctggataggttgttaacaccaactatcattttgagtatcattataggaattttaatctccgtctacgttccagatgccagagacaagtttgagtccgatgctaagctggctggtgttggtgttcctctggccatagggttgattctcatgatggttccacctttgtgtaatgttagctgggaaagcattcatcatatattgaggcagaaaagtgtatatcgccagttatttatctcactgataataaactggattttatgcccatttttgatgctggcgctcagttggatggtattattcaatgaaacagaatatcgaattggtataatcatgattggaattgccagatgcattgctatggtacttgtctggaatggcctcgctggaggagataacactctgtgtaccatcatcgtggtaatgaacagcatcatgcaaattgtcttgtttgcgccatatcagatatttttgtgttacgtcatcagtgggacttccaatgtgggatcagcttcgtattcggaagtagcagaaagtgttggggcgtttttaggtattccattgggactaggattactgattcgttttggatgtcttgcagtgtttgggagggaaaaatacgagaagaaaattattcctttcattgagccctggtctgtagttggtttggtgtacattattattgtgattttcattgctaagggccatgactttattcaagagattggtcgggccttcaaatgtttcatcccgctagtgctttattttttgatcacttggtttggtgcattttggctattaaggtttcttaccaactattttaacaaaagggacttacgacgtcaatataaaactgaagtaggctcgagtttggactgccaagattcgtcagagctagagcgatccaagaagcttggttatgcaagctatcgggtaacgatcgctcaggcgtttacagcagcttccaacaattttgaactaagtctggcagtagccatttctgtttacggctcaggatctaagcaatctattgcaacaacatttggacctttactcgaggtgccagttttattgatcctgacaatcgttgccagatacttcaggcaatctttcatgtggatagacactgaggatgaaaatgggagtgaagctgaaattgaaccggaaacaaaggaaacaactgatattgagataacagaaataggacagaaataaccaagcattgataaaaatgctagatttgtattattttctttcgactgtgtgtataggtgtatttacgagcagtgagattattcaataatgtgtattatattaatcttatcaaaattaatgacgtacatgataaaagaggacgatttttatggctatcatcagcatcaatgacagtttatattttaaactcgccgatcccatgaacaaaaaaaaaaatattcacttcaaccaaatatctatgcgccaaacgcctgacttgcttcactaatagtgttgcatgcggtttaaaacgtgatttagtctatcaataagataaactctcattctagtattcttctatttcgggaagtacctatgatatctaaatatttacttctctagagtttgttctatttcactcaagattccaactccatcgacatactgcagccacagggaagagtcagcttccactggcttgacattttctttccaatggaagtttttcctcaagaagtcactatacgggatagctttttcagtttcgcagagatccgaccaaacggctttgaaagctccgccaatggcacaagcatcaccaaggttgatttgatagtttccctcttttgctcctagaacttcagaaaacttgcgcacaattgacacattctgtgaagctcctcctacgtaaaacgctttctttggatgagagatcaagtcgggaagacgttgatctttaccatcagcagagattttggggaaatttgataatctctggataacttcactctcttcctcttggtcagtttcatcagatccatgatagagtggacccgatcgaagacggcatgatagggcttgagactcaacaatggaaacaacatcatcttcaatgtcccaattagctgtaactaacttcttactttttgcatcataagaaaaacgttttgtttgggcaacacagttaggaataatctcacctttgggaaagtaaacaccaagttcctccttgccatgaagaggtttggatttgtctaagatttcattgaatttagtccagtcgttaggatcagacacgttgtattttttatccaggctagtctttatctggtttctagctaatgctccatttacgtaacaaagcatcaccatatacgagcccggaactgttggatgtttgaaaacatggtaattggaattaggccaataagtctctgtaaccaaaaggactgttgtagatgtacccaaagaaacaagaatgtcatcgttatgcagtggtaaggaaagaatggtagccaagttgtcacctgtaaaggagaatactttgctatcttcactgaaaccatatttttccacaaaatatgcagctatagtgccaattgaacgatacccgactggttccaaatcttgcagtttatctttcagcctagctacgccttcttgacgttcatgttcagtggccccgtcgatctctggatcaacagctgctgtaacagctaacaagtcttcatcatacctcgagttctgaatatcgtagatattcattccacatccatcactctcttcaattttagttattcttccgcatagtagagaacttagaaaactactgattaaagaaattctgtatgtttccttataaagttctggatttacgcgtttggccaattttctaatctgagatcccgtaaatcgataatgagccctggatcctgtaatcttagacagattctcaggagatcctgcttttctttcaaatatttccagctcttctccggttgagtgatcttgccaattgggagacttttcgaatgtgaaagccttcggacacagttgggacttcaaatctttcgatggagagagagatgataagagatctggggcatctttagaccaataaactgagccatgctgttgacaagatccagacatccctttcacgatgccaaatggaaacttgtccttctgcatcttagaaaagatcagatctaacgcttcgacccacattgccactggagcgttgatctctccagtctcttcattgacataaactccattattgattccataaacactcaactcctcatcgaaatcaactctataagtcttgaaatgtgtcaatgaacgcccttcgaaagaggtgattttcaattgttgggtacttagatcaaacccaaggtaaaggtcattcggaactgattcggtcaatgctgaatctctattttggatttctttggtaaccatgttacagggttctttttgtagaagctaaaagggggaataaccaaagaagcagtcaataaaccaaaagctgcgaaagtgtatacagtgtataagatgttgtcactcaaaaatcctaccagaaaactaataattgcaccaaatgtgattagttttttagtgatcctgtttgcaagttcctgtcctttaaaatcgatgttgccttcaaggtaagaaaatgacattggactcgggttggagatataagagaaaggcgacagattttggtggtgtgtgcagaattgagtatcgacacatacccacctaaatttcgagtgcataacagtctaaaaagaaacctagggtggggtgcaatgctaagagaaccttacaattttattattatatatgtctccgtttactctgggccgtcaatgatagccttgatagccttaccttgcctaacagtatcataggcatctactgcttcggtaaatttgaacctgtgggttactaatcctttcacttcgacttttcctgaagctatcagttcaactgctaagttgtaatcgttgtaacagtatctgaaaacaccctttacgatacattccttctcacatataagtcccaatgggaagttgttatattcggattttcccattccgacttgaacgtgcactccccttggagccagtgcattgatacctgccgcaatacacgattcaactccagtacaatcaatggaaacgtttggatgctttccttcaaatgattccaaaagattatccataccattctttgagttgaaactatgcgtggccacttgtaaggtgtcctttgcgagtgtcagtttatcatcgaaaatatccacgatgagaacgttggttgcgccgtaagctctagccgtagcagcaaccagcagaccaacaggtccagctccaaaaactactacactgtctccaaaggtaatcttcgcaagtcttgcagcatggacagcaacactcaaaggttctactaatgcaccttcctctaatgacacatgttcaggaagcttgacgcagaaatcttcaggaagtaaaaagtagcgacatagggtaccatcaataggtggagtagcagcaaacgccatctctggacacaaattgtagtgtcctgatttataggcattgctgtaacgagacgggatacccggttcacaagcaactttgtcacccaccctaagcgacttaacctcggagccaacttcaacgacaattcccgcagactcgtgcccaagaaccatcggtgactcaagtttgaatgatccacagcatccatctgtgtagaaatggacatcactaccacaaattccggtcttcttgattgctattttcacatagtgaggatcctcaatggctggaattggtctatcttctatgacaatctcattaatccttttaagaataacacttgggttatcggacatgttggataatagtgagtgtaatgaagcgggaaagggaacagattattgggcgggaagtacgttttaaattctttggtggaactacaacggattacgtggggtacatacatttgggataagtttttccggtgtgcatgattttttaatcccgcgcaatcatcaaaagttgagactgagagcattctgccccgccattaataatatacaactttttaacactacctatctaaccttgctcttccgccttgcatcattttgtcctctcttagcttacccgttcggtccatcatcggccaattaccccaaccgttcaatttgattatgttacatgtggcattgtcatcacctccaacgcactccacgaatttaatgacttctttggcagcctcatgaggtgttcctctcaaaagtcctttattattggtagttgtcatgaccaaatctacaatctcctggtctgataagtgatctgtgactccatcggttacaagtgctaaaaagcactcattccctccaaagtctcgtatctctttacttgcaatcaaatcagaattttgatctttgtatgcttgcagtttagtcgaatttcctatgaggtattgggatatttcaggctctgcggacacccccttgtttttggctgtaagatctccaaacgatctagtattggcaaagttgatgaacctttcttctccaaaagaatccgtcatcattaaccctgcagaaaaccttgaaagacgtctgctttcgattggattagaagggtggtggctatgtgttagtgggtgggccagtccgtttttatcacacaacactactcttgtatctccaacatgagcaaccactagcttactcaacgcgttctgttcatagaagaatacatcatcaaagggcagattgtcacctctgtcattacccgttttcacatgagagaaatcggtagcttgaagaacaatgccagggtttggatctaaagtgtaaagaaaaacgcttgaacaggtcgaccctgagtggtgcccattcttttccggatcatgttcgtgtgttaggaattgataatctgtgtaaagaaacgataagtaaacttgtaagataaaatagtcatgactgttcagtgattccatgatacttttcgactgccatataggcttgttttcagaactattcgtgtacaattgtttgatcgtattcttttgattgggagactcataattaaagtctttgccttcatcaagatcacatttcaaaacttcagagagatggcgattcaatcttttgtaccatctacgccaatatccaccaatagacttgacatatcctttgaaaagcttctcgattgacccactgcttatcttataattttctatgttgtcacttaaatgagtagccaaatatcgactacactcatcccctccatgtccatcaaaaatgttaaagttaaacaccttgaccattttaccgtccactttatcgttctccttttcaaagggaaccaacttatcgtcggctctattatctagttcttcatttgcatcatcaccaatggcaatagtaacctcagatttgggcgggaaagctctgtttatgattgccacattgaaattgtcttcattatacaacctgttacatctagaagtatagtagccataattggacggtactttgctcaggtttacttttaatgtgttcttactaccttttattcgaacgctcaagtactgagacaaacggcgaacctttactgcgtttgccattatccttgaaatggcccctttctcgtagttttaggtagttttaggttaattggtggatgttgaaacgcatctttctcgaaagggattaagatagtaaatttcggagatttgcatctccggccagggaagtgttgaggagattcaaagatcggagttacgaatgttacatggagcaaaggaaggagcatcggcaaaaaaagagtacattctatagttaattgttaattcaatcctacacatgagcctgtcttactctaagttctctttctatgatctgtttagatctagcgattatgctgtcatctcgattgagtggttcagattcatcaaattggaggtcgaaatcatcatctaagaataggatatttcttatccactggttcaattttccgtaaacgttgtatagctccagaataattggcacaataataagacgcggaagaatatcgttgataacttctccggccttaattaatttgatagattcacctaggaacttttgaaattgcgacgaatcgttggaaagtagcattgtaaaattgtaagaaagtgggatagtcaacctagatgcatatgtgagaaagaaaataaaacttgaaggattggagttcccgtgaggagaaattttgtagatgttgaacactttaacttgagtcaaggtcaatagtgtgacaactaccatataagataggaaacagaacacggtcactgaatttagtcttgtatggaagttcaaattgattatgtattttaaaagagaagctcttgttgagtggaatgtttccgattgtacaattaccatggagattagtaaacttagaacacctgccaacacatgaacatggtatctcaaatgattgtagtaaacataattaaaacggggaaatttgttgaatatatgatctggttgatgttggaaaattagtactgaacttcccgaattcttactgtctaatatctcttcccatttcagggcttcatccatagtttcgctgaattggttcagagcttccaaatatttatgtttgtaaatgctcaaattctctgaaagtttgaccagactttcagagtcggcaccgtctatcaacacagaatgattggactctgttctgatactggccggaattttatcgattaaagaatccaaccattccgaattttctgggtttctcggatatttcattatcttgtaacaaacatctttgtaattcaacaagtgatcgtgcttggaggtggaaagacttggaattttgaggtaaagttggttgacatccacggaactgcgtctataaatagattttggaatactaatcaacccatggctcatcatccacagtgctatggtcagtgagtagatatgtgaacaagtaattacaatagacttcaagctcttaagtttgaatttccctgttagcaagcaataagccaaaatagagaaccccactgttagcaacgccaattggtatcgaatcaatttgttgatactatctgtagccttatctttagcatcataataaccggatcttgtgtaatattggaagaacggcaacagagcccatgtcaacaaaaaggtcaaccaatagttcaactgccacatccgataaatgatcttgccctcagattcagatccaccattatatatgtccaagggtaataggaacacaattgacaatggcagataaattgagagtgtcaaggtcgccagcaatgggagtgaaacttctctgtaatcaatgtatcgacggatgaagagaattgccaacaataacgtggcaaccaatgaaaacgtcagccatatccacattgttttgatacgaaggttggaagggaagggatggggcacaaggttatagctaataccctagctagcactctattcgcgaaggaggaacgacagatagtatcagaagctgtgaaagtgattaaaaactacatatctggccaggatagacttgcggctataaacgttcaagcagtaaaataacactaggttgtcaaaaacaaaaggcaatctcaaactgaacagctgcagattaaccttcaaatgagtaccggaatatttgtttctttggtcgtgtgttcttgttcagtaataacgggctagtctcatcgatgtattaaaattctggggtctctggcaaggaaataaaaaaaaataagatcatccgaacgaatgaccatatatcaagtacataaagagaaattcattccaccaagaacttgtactttttcttcgtaactgaaacgtcattcaatgcctcatcatctacaaaccaagcaactctacttgcagcgccttcgttcacaatactggatggtagacccttttcgggtctttccatgatggtcttcagcacaggagcctttacagcaccttcaacaacaaaggtgacctggtgtgaatgacaaatgactggaattgttaacgtgattctggttttgggtcccacaggtgcattctcaactggaacgacccaagcgtatttctctcttaaagtttctccatgattagggaatagagaagcaatatgcccgtcgggcgcacaacccaacaataataggtcaaacatgggcagtttcacggagtctttgttagcaaaccctttaatgagagtcttttcgtaactatcagcacattcttgtggatcattgatcagggattcgtctatgtggtaaatggttggtttcttgtcttctggcagaagatcaaaaagctttcttttggctaatccataattcgactccggggagtcaaacggtactaatctttcatccgcaaagtaaacatcccatttatcccataatacgtcttcccgttttagcaatccttcattcaaaacttgaatcagggaacctccagatagagctatcttgaatctcttcggacgagtatcttttttcttctttgtggtaactttggtcgttgattcatttgttgctggcacatcgccactatctttccgtatgtctccaaaaagggttctattctgggtagcaattatatggtcagacacggcttccgccaccccattcaattctttgaatgagtaaatgattggcacagttgttgtcataataggccaattgtgaatcgattactgattttgtgggtctctggtatttatattatacttgtaggagataaagaatggacacaggtaggctttttgttggttgaagcactactctcttccttggtatttttgtagattcagataagactataaggctcggtgtgtaccaatgggaaaaacgattaattgaatcgttagagggttatttgaaagctttagatgtaaattctagcttgttgccggctgatttgggttgcgactacctgattagcaaccaacccccaagcatcacacacactccttctggatttttctaggcgggagaagagggcgatcacgctcgaaagggtctcatcccctttaacctgaaagtttccccgtctaagaactccgtatcaattgcttttcccgataaaattatctttgaaataattatggacaagctggaggaatacgtagcaaaatggcacagctcgaagccattggagagtcgggaaattgatgttggcggaacaaaaggtattgttacaaaacttgataacaacagtatactcctagtactgttgggtgatatcatagagactaggataatcaatgccagtctgatcacaagcgagccaattccgaagtcaacggaagatccaaagccagctgaacaaacccagactggagagagtagttttagccgcttaagagaaacaaatccaatatcgccaccactaggagaagctcccccacaatttacagacgaatatcagttactggatgatcctgtagcttcgaatttccgcccaccatcagggcctccaccaattggagagggtgataggttgcctcctggaggggctcacccttcactatcgccttttgctagcgatctacaaacagaaggacatggaatgtatccctcattgaaccaccctatttttaaccctaatgaaaggcagccaaatttgaggcatcccccaggaagtagatatgacgaccctacacccttcgggctaccaggaggaacacctcaaggaaaaggtcccccagggggaggaagttcgggttttggcggcttcctgtaatcagaattttttcatagattttcttaatctatattgtatgagaagaaatcaccaaacgtagaaattcagatggctcgcgcgatattccttttgcctctttccttcttcacctaaagcaaaatcatcatgtcacttcaactgtccattatcttcggcatcctgatgggtgaaatgttcattatcacccttctggttcttcctcttgggtctaacgttcgaagatcggttgttaggttgttcaattggacagcaaggaagcctacttgtaatgtgactacgtacatcgttttgggtttggtaggtcttttctttatcgactcgtttagatcagttaactctgctagacatacaccggtatccaactacgatgctgccgttaaccagcaggcttatatgaaaaagttttacaaccaaagaaatatgtatattacgggtgctaccttgttctatgctgcttctataaagtgtattatcaacttgatcaatcagattctgaggaacgaggagaagttgtcaaaggttgctaaggtagaacacactacgttggatctgcagaaattgaaagaggagatcaaatcaaaggatgtccaaattgagggattgaaaaggcaacttgaaaatttgaccaaatcctacaacgagctaactccggaggagaagagcaacaagaaggacgagtagggttgctttgtctttttttttttcatagtattatcatttgacgtggactaagggtaaacttgggggttagactacactagcaaagatcatcaagtctgcaaatttcaatccaccttacagtgacggaaagcacatattaacactggatatagttacctcattcatctaaccagatttcattcccaggcacttactgcccccaaattttgcctatgtgttcggttccctcttaatatacatagtttaagtagcctcgaacttacctaacggtataaatatcagctcgaaaatcttaacattctaactcacagccatcggtccaccatctcgtacaaacagtcaaatgcacggagcttattttcagaagaactccaaatatgagctgcctcagccttatcatctgaaaccagtgaaaaaacatcagattgataaactaccaaagaatgtttttaacacgaataggaaaaagctaatggcgtacacgctaatacttatgattcttgctttatttgttttctactcaaggagtcccaaagatgtggctctggtgctggatgatgacaatcaggatgacattcttgacgaattgctcgcacagaaggagaaagctttggagttggagcaaaatgccgacccgctgaagcctccaaataacgaaggcaactagtcaccactacaacacatttacaaacaataaccccgcaattcatgtaattattaatagataaactcatactgttaatccatggtctttgacatctctccgttcttgccaaacggtctttcctgtacaactgcaaacctgtttgtcattctcccaaacaccagctgatctagcaatgactcctaccagggagctatcagagacatcgtcgtaccctttaccatcaccaacaactacagacctaccgattaagtctgtaatcttcaatgggaccgaaatgaaatattggcctttgaaaccttctgcggctttctctgtgatattgatttgctgcaattggaaaaatatcgatcctgttgatttggcaccctctgtaagattacctgatgttcttatactgggccaatacgtaccagctttggacacgccgtccacggtgaagtcaatgagcatttcgctgggggagacagctaccattctcaacaatcccttcacagggttggcacgatgctccggtttgaatgattccaaaatgcatacagcagctgagttgggagacccagttccacggatgaccgcatctttaccgatcttttgtaactgggagaccacttgagatggggcaactctaccaccgacaacgactttattatctcgcaaattgatgtccagcttttccagttctggaatcatcttcaaagaattcttcaccgactcgacacatgaggagcattccatgggaacttgatacacagtttctaacatgtttctattactgtgaaaagagtgattgtattagtaagagcttcatcatatcagtttgagaatcgcgccatatctggagacatcgcacatctatccttcaccttaccacatatactcaacttgatgctcaaacactccttaaaaacagggttggtctttctcacttggataccggtgatttatacggtaaaggaacacctgatatacgttggaaaggtggaaggatcctcaatgtcacccactttgaatcccgttaaaggttattctgactatgtgattttatggaagttaaacttcaaagagtcactcaaagtgggagacgtggtttttataaggtctcctgtagatccagagaagttatatgctaaacgtataaaggctgttcaaggggataccgtggtgactaggcatccataccccaaagacaaagtgtccattccaagaaaccatctttgggtagaaggagacaatatacacagcgtggatagtaacaactttggtccgatatcgttgggccttgtattaggaagagcaactcacgtaatttttcccctgaacaggataggtaatatctctggtgaagggggtagagaagttagggaggattatttaagagcggaggacagtccgatgtaaaataggaatttaatagaaatgcacgtacttatgactatgagtttattatgataacgatgagggaggcattccttgtttggatagtggaaacttgaattcaaaatcaaattcaggatgtgcgttttcgtgaggagtaaaaccactgagtgaagtaacggttcgtttgagtcgcttcttggtaatcatgttagtggatttacacctctgtaaagttcctttatcctcggaacgtatgcgatgtaattctttctcacaagtaagtaaaaagttagtatctttcatagtgatatagcttttcgggaagcagcggtctgcgtggttttgaaagaaacttttgtaaccaccatctaggacaacgatgtccgggtagttgagaaagggataattgtcctgatttataagtcgatcgcattgtcttaaatggttggccatgattggtcctctataagagctgaactcgcaatggaatatcattaagactttctttgtggatggagaggtgaagaagtagtcctctaattgtttctttgatattatattgatagcacgattcacatgtcctccattgtactcatattcaaaccgacaatcaactattacaatgtcttcgaacgtatcccggtaatgaccatccagtattctgacaaattcgtcgatcttgattctaggcagaacgtcctgcgagccagtctcagtacgaagaccacatttagccatcaaagagttgtcatatgatttgcatgatttgtggtataaatcacttggggagttgatcattgattgagttctcagtaccttgtttcgtaccagactcaatctgttcttcctttttggggaacctgtgggagaacctgtgggagaaccagctggagagactctagatagtcgagacattctagatggggctcttgtaggagaattttcatcctcttcgttatcctcttcatcgtcttcaccttcttgcagacacgaagcacccgaaactttgggaagacttctcataggagaaccttctgaatctgaatcaaacggacatctatttaggcctccagttgtagttcccaaaaggaagtccttcttagcagacttgaagctgagagatgatcgactgctgaacattgggggcttctcagcttggaaaggagcgtggctaacgctcaacgaagaggttcttgacacttcacacagctcgttgtcgtaatcactaaagacactcagagaaccgatggaactcatcgaagaggagtggtttcggagtcgcaagaaaggaggcaggaagtcgtcttcagcacctgtctcactggcataaggcgccaatggaaggaccttcttgtctttcttgcccataagctatgatcaggagattaaagatcgaagggttttggaggatgccgtgtggtgtaggatattcgattggctttatgttagttcgaaaaattagggaatgtagtgttggatacacaaacgagccagatcaggaaattaccagatttgcgtttcaggtgagtgagaaataatattagcaatcaatgcgccaaagccaagtattaaaaagcgtgataaagacgactgtggaaaacgaccaaaggagtcagtcagataggagaacgtatttgacggcaggctacgcttcgaaggtctgggagaaggaaccacctgtcagcatggatggaacttcttcgttgtggtttgttttgggctcgaataatttggttccatcggataatccacgcaggatggtgaccgtagaaaccagtttggtgtggataaagcatatgtgacgcgagctaaaaacaataggggcctagagataagtacacaaaagaaaaggccgtatacggcctctgtaaatattgatgcgagtgaactgaaaggcccccttcgtatgattatgcccttctatccctcttagatccgaccttgttttgtcacgcattctcctgaccttctagaactactggcgaagactctttcttttgcgtaccgtacctgtgtacctacctagcaacaagagaacaaataaacatattcctttttggtaacctatgcaaccccaagtataattaaccctttgtgcatgcattggtgcacagctttccggatgcggaagcgatgacgcttcgcttgcatatatatgttatgaattgattacctaaacatcaacagaggtttaactcaaactagaatcccagatatttgtgaaccgattggtcttcaaaagagaggaattagtaccaccgttaggtggatttgtcgaagagagtgttccgcatttgaaaatctcgaatggtttggagcttactctcctatgttgacccgagtacactgagcaacatatgaacataatgttgtgaacatgaagaggctgccaaggggcaaagcacctttgcagtatgaaactccctgaaaggaaattattgacaattctcttgttgtccaagttttacccatgacgggatgttctaatagtggcactctcattggacagtcattgaatttgcagctgaaggtggtcaggttcagctattcgaacttcatgtttcccaattggagtgatcttggacgcctgaaagaacccaataagaatgagaatagatattataattccttggatatcgtatcgttcaagggtgctcaaacgcatctctatttaacaaaacgatcatcatttctaaaagtacgttgacacgtcaactcttttaaaaggaaacagttccagccacattccatcgaatgaggaggcaacctctgtccagctctacctagtctgggcctaatagttgttcactctacctattcccccgcatttagggcaagtctccctctccaaaaagaaattatatcgatatccatctccattgcatttatagcaaagaattccgccaattgctggatctcctggctgcaccatccgtggcggcagaatatagggttgtggttgattcggaaaatattgcaatggaactcccgaaacggggataacaggtggaatcggactcggagcgggcggagggtaaaatacattggtttgtgggggtggagacattggggcaggtttggggggaacaggtgaaggtctcttctttggttcaaatttcgaccaacatgtgctgcatggtttactattcttcaacttgtaccctgaattattgcatttcttacaataatatccccttggatatctccaaggcaatgaaaggttatttgtatagaggctctctggacttctactatcagcttgtgattcctcataactgggaggaagagggggagtatcctttggcatggtgccttcaattgattctgtataagatgtagttaggctagaagcatcatgtgctatttaacgataatcgagcatgtcattggaagggaggcagtgcactttaccttctggataactctccgcctactgactggctccatctcaacaccatacacgactagctccaaccagccaacacgtatctctggcctctggtcttgcttttttcaacaaaacatcaaatgatctggttaacagagctacaaagtgagtcattgagccgttccaatttattctagttcatcaaacttactaacaatagaatttggtgtcggtttcacagcttgtggtaagtccaatattctgagacgtgctcatgcactctactaacatgtcaaggactattctttttcattctaggagtaattacattttttgatgcagcattattggcgttgggaaatgttttgtttgtgattggcctagtcctcattattggaccgttaaaaacagttgtattttttaccagaccacagaaagttagagggaccatacttcttgcattgggcattgttttgattctaacgggcagatcatttttaggctttattattgaaagtttgggtatagtgatattgtttggtgatttcttctctgtcattattcaatttctaagaagtattcccttcattggcccaatttttagacatccagccgttgctccaatacttgacaggatagctggtatctctgttcttccagtataaacacagtcatttcaaattgtatagtactcacccagatacagaaacttgggactgggcctgcttggatatcaacggcaccccaataacagaatctacatcacatatttatgcttatgtaatcaagcgaaacttttcaactatctagatttttttttttctctttggaatcttagtctcaaccaaaacttgcctgctgcccttatcaaacatgcccaaatacccccctcgtcagtccaactcatcaagtggagttgatgtttctgggcttattggcgctggttcagccaagctaaagaagaaaatacgtgatattgaaagactattgaggaaacaagagctaccatcagatgttcgtctggagaatgaaagggcacttaacgctttgaaaatggacttggaggacaagaaggttgatttaagagcacaaaaatatgctaaaaagtatcacatgatccggttttttgaaaagaagaaggctttaagaaactacaagagagtcaagaatgaactggaagctgcgaccgataaaaaggaaataaaaaagttaaagaaaaagctgcatcattgtgaaattgatttggcttatgtagtaaactttccaaaggctgaaaagtatattagtttatttccaaaccctgtcgacccgaatgaaaagctgtctgaagaaaccaagaaagggctgctgcacacagagcaggaaaggcttgcgtacaaaaagttgatctctgaaatggcagaagccggcactctacctaatacgttggaggatattttagccggaaggcctgccgtcaacgtgacgacgttaagcaaaactcaaaatgatgaatcaaatccagttacagatgacgtttctcatcataaaacgacaacacaagcgatcaacaatcaaggacaacaggaagaagaattctttgaatagatgctcccatcgttggcttaatttttatcttatagtgacctttttctaattaataaaaaattacattacttctattcggctattccttactcaaagtgattgtagtgccgtaggtgatgtccataaaatcactaacaaacataacagtgagcattctacctttaagttgttcaggaatatctatattgcacacgacggagcccttcttgttaaccatttgagggctagcacgtttcaaaatgaccaattcgtcgaactcgggttcacaaaggattgcaaaccatgtctctctttgggattttccaaaccttggggcataaaccttgaaatcctggttccatggagcgttctcatgattgagagtaacaacaagagtgtcgacattaggttgcttaacgttgaactcaccagttgggatttttgaagcaacgtccaagaacctttttcttttctgagccggaacacccagttgattagccaaaacttgaagctgaccatagctcatggaaccaagtttctttaactcgttagaactttcatcggaattctgagcttcctctaaaacaagtttatccaagtcccctccatcatcttgctcctcgtcgacaaactcgggtgataaaccaggcaaaacagtcaaaggcccgttatcgaaccaacaggcctgctttatacattgcatcacccttatcaaagtcaaagtagtagacagatacccaagctctgaagtggtatcaatgtaggcctgtagaatacgcaaactttgtgctaatacagcaacagtatcttgactgtagtcagcaataggaagatcgacacgcgacatgaaagcttggagtagtaagtatgctttgatatgaggattccaaaagaagtctaattcataaccaaaagaatctgctggatatctcattttttcactcatttctatgttaattagggtttcgccatggcgagttgataattcgtcatactctgctgcttcacagagccattgaagacattctctgaacgacgaatttctatgcacatttgaaagcaaagatcctatagtcttgtgtgacaaatagtaataagacgaaattttcaaaaagggagtaggagtaagcaactttggagtaactaccaagcatttagcatactctaggctctgtataactttgtcgatgagttccgttaagtacttgctgattccttcatctgtcgtatcttcgatcccgtagtaagtaggattgttgtgagctcgtctgaacaaaaaagtccacgttaaaaagtccaatgccttttgacgagacttaatagtgccagctgaaatttccgcaccgatatggtcagctaaaaccttatgaagagatgactcaacagggaatccaacgttcaaaaagtgcttgtagaaagttttcttagattccttggtatagacaatagccacaccactggtgtcatatgccggtctacctgctcttcccatcatttgaagaatatcagtaagatccatatccctaaaagcttcaatctttgggtcaaaaaactgggtccctttgataactaccagataagcaggcaggttcacaccccaagccaaagtggaggtagcgactaagatttgaatcttactctgttcaaacagcttgtgagccaaatctctatcactttctactaaacctgcatgatgcaccccaataccaaattgcaaggacaatttaagtgcttcatcctttacctttgccagcacgtcttccaactcatcatctgacattttcataaatctacgaggattctcctctgcgccacacatgtgaatcaaatcaagggctgtaagtctagtctgccttcttgaagcaacaaagatcagtacaggcttgcttggtgaatgttgcttgattgccatgtatgctggcttattcattgtcttcatcaaagggcaaaatgccaaattgtctggaaaaccatcaatgtacatctgtagtggaacaggcctaacagatgaaggaaagttaaataatccagaaggtcctacattcaaccaactggccatatccatagcgttcgacactgcagtagacataccgagtaacctgatttgtttgtttgtaaacaaagagatgtagttcatacggctgacaatgatctccaggataggtccacgatcacttgctagtaaatgaatctcatccatgatgattagagaaacctgttgaacaaattttctggtctgccaattacgagaaataccatcaaatttctctggtgtagtaataacaatattggcttctctaatttctttggcttcaggaagagaatcaccggttaattcaacaactttatttcctgtaagccttgctctccaatcgtctactctttcccgtactagtgccttcattggagcaatgtaaacaactttggatccgggaaactccttaaaagcatgccaaattgcaagttcggctacgactgtttttcctgaaccagtgggagacccaatgaacacattctggttagtgttgtatagggaatgaaatgccattgtttgcataggattgaagtaattgaactttttggaataaatgctttcaatctttggattgttgagagctgtgattggtagtggttgtaattttaataatcgggtagaaagcgtctcattatgaggcctgattaggtgctgaaaagaaattgtttgtgtgttttcagctcctatccaagtatcagagattactctgacgacaacttgcggaggcaaagggtcggacaagggtatcatgaaatctaattcatgagttgcttttagttgtctcttgttgatgatcagcttttctacatgcaaaatagtagatttatctgattcttctaccaggacccaaaaaaattgggcatttccgtgatatttttcgttccaatagaaatcagcatctagcttcaagtgaatcctcatgacattgctggttattggaaatgcttctgcatcaataagaatataaggaaaagaatcaatcaaccggtgaatgcttttccccatttttttattatgtcctaaatcacccagctcttcaactgtcagatctctcaaagtatctatagttgggttcttggcttcaatttgtttcattatatctgttgggatgtcaaactgacgcaaaggatgtgaccatgcccaaattcgcctgtctattgatttgcatatggataacatgactttagaaaatattccccacctacggttcaatccaatgagaaacagagcacgacaaattctagcagaattctgagccacatagttcaagtctgaaactagagcagagttcttcacagaggattgggtaatataagcttgcaagagaatgttcgtcttaccttgagccgtatcaggagaagcggcgatttggcactctgtgctctcgtccaataatttagatagctcatttgtctcatcttcacgggccttcacgttatcaaattcactgctcatacagatcatggataaaacatcagcctcagtagctctcgggttaagtaattggttaaatacttcaactgactcattgagtaaataaaaatcagatgctactcttccaagatctttcggcaccaatgaattggatctatcatcataaatgatcatctgcaaagtatgtaactttctagccgcctcaattatcatattgcgtctcttttgtaccagctgtggatcctgtgatagttctttccagtcgattccatatgcaaaagggttctgtttcattctgacgttcatataagtgtaacccagccactgaactccctcatcaacgttcgtgacggtacctaaagaaatttcggcattcaaattgtccaccaatttagcagccagcttcgattcaattggatgctgctgagtaatcaatgatatgtaatgatccagcttttctagattggtacacagaataccagtaccaaactgctcatattggggacggcctgcacgaccgaaaatctggatgacatcagatattccaaggtctgtaaaaccaccctgctttgaatcgtaaacttgagttcctttaataataactgcagcagctggtaagttaacaccccaggctaaagttgaggtacaacacagaaccttgatggcaccagcagtgaacattttctcagtaatatttctatcagatcgtagcattcctgcatggtggataccaaatccatgttgaaataactctttgacatctttgtttctattcttacccatttcccgtctaaagcgttcgaaagattctgagtttgagcagtcaaaataactgaactcctcattctttccagctgcattgataaacgatctcgccgtcatggcagtatcttttctagaatgtacaaataccattacttgatgaccctcttccactagttcaactagtttttcataggcaacattttcgatggcatctctagttgcacgagggctgtcctgctttctcacaccaattaattgttgctttaaaggaacaggtctgaatgattggtcaaagtaaaacatgcctacatgcctgttcactcctaagaagtctgcgacatctatgaaattaggtagagttgctgaaagtcctacaaccctaatcatgctttgggaactctcgacttgtctaagtgttcttgctaccaaggtttcgataacactaccacggtcttcgtgcaaaagatgaacttcatctataatcaaaagcttcactttttcgaccaactcattatctccgttggactttcttgtaaccacatcccacttttcaggagttgtgactatcacctgagtagcgataatctcagatttagttaattgcatatcaccagtcagttctctaacttgaatacctagccaccctagcttttgcgtgaatttttccacaatttctgcggcaagtgccttcaatggcgccacatatactatcttgaatgattcgtaatctatatccaactgaagaccctcctctgttgcagtttccgtgacaaactggttgattacactcaaagtggttaatgttgcaacatcagttttaccagcacccgtgggtgcacatacaagcatgttttcattggtattatacgcaactggatatatcagtgattgcattctgtttaatgttttgtaattcttgaaagtacccttgcaaatggggtcaagctctgatatttgaattgctctttcattaataacgacaggtttcgccgttggataaggaattacaatttcttcgtactttccgtaagcctgtctcgtggtcccaacgggtaaagagtatttcttgcccgtgaaagaaatagtgttcccactttcataacttctaaaaacatgtggatatttttctttggaaggagcaaactccaaaggttggattttcgcctttcttctgttttctctcacctgaatggcaatctcctcatcagcagtagctttaagtgagtcattcttcatcgtccttggtttttcttgagccactagggcctcctggtttttaaggatgttgctaattaaatcaaaattttcaaatccaaaaatatcgaccagtagagattgaattaaatcttgtgagtcattctgttgtagaatatctctaacttgttgaagtaattgatccgtagtgaatccactctcactagtaacacaaaagttactcaattcttctataagttcatcaatgggtcgaatttcaccactatcagagtcactagtatctatttctgatctttcaatctcatcaaacagtgcttgaaggctcttcagaacattaagttggaaaccatcatcgtctttgaattgggggatctttatttcttcatcgggtactaccaagcttagttcttctaagctttctatcatgggttgcatcgcctgtaaataggactttgttgaagatacatcgtaagacgacatgttctgctactttggttcaaactattattcacttgatggataatgatatatacttacatgtgtgttgtggtgtttggatgtataaatgcttagtctagtttgctctctagaagggacaacctttggtccatttcgttaatcatctgatccatatcgttcttgttttgctcaaaaagtatctcagtattgtcgtactctttttctagtttgtctaaggtggtttcccattgtttcatttctgagttcatcaagtcgaggttagatttcagggatttggagaactcaactgctgactgagcttcaacttggatagtttggaaggttttcagcctgtcaatgatcgagggaagtgctttctcataccttggcaaactggttatcttctcgtatagtttgtggattttggcttctagtatagggtttatggctggggaacctgactcttctgatggctcaaacagcctcttttcccgctctgctttctttgaagagtttataactcgttctgcttcttcattcaatgcagtgagttgttttctcactgagtctagtccctctggatcttgcaaaagtgctaatttcttatttatgtttgacaatgtgagagtaattggaagattggagtcgtcatgaaatcctattgttttttcaagttcggccacttcgtggtctaagtttatgagtttggataatgtctcgttatcctttggaatttctgactttttgaactcgatatcatcaaggcgaagagaatcatcagttggatacctaaatggaccctgttccgctgtgtccttcaaatccaaactttgaaccatctgcaaaagttcttcagacctgtccgattgctttgcgccttcaatagtagtatcattctttttctgttgctggatttcgtataattcgttctgtatgcgcagtagtctttggtcggtggtctccttgaccctaccagtaagaagtgttctgtggtaagctgacgtgattcgatcactaaaatcggtcaaattatttgacacgatctcattgaggaatctttcttttgttgtttcatagacttgtggctcatttgatacgtctgggtcatctatcactttatatggggtcgatagggtattatcgacaaactcggtgtcggatgtttcgaacacctcttgggtttggaattctgaagtctaaagccgaagttagtatatgaaaagaaagacaaaaacagcttgtcttactaattggaagtcctgttcatcaaagtccatggttgttaggacgagaaagcgtgttggagggagctcttcaagaaagcttcgcggcattgcctccagttcacccaaattcactaaagccaccgcgttcttactttgctcccaactacagctacccaaatgaaattgttgaactttctgcttagcttcgtaactctgttcggactattatcaggttctgtgtttgcacaagaactgaaagatctgccagaaattacccaaaaggtctattttgatattaacgagggagacaagtttttaggaagaattgtcattggtctattcggagatgtcgttccaagaactgtggagaacttctaccaattggccatcagtgaagatcctgacttcggttataagggctccaaattccaccgtgtcatcaaggactttatgatccaaggtggtgattttacttcaggagacggcagaggaggaaaatctatctacggtagcagattcaaggacgagaacttcaaactcaagcacgatcgccctgggctgttatccatggccaatgccggaaaggataccaatggatctcagtttttcatcaccaccgtggtgacttcgtggttggacaacaaacatgttgtctttggctatgtcgttgatgggttcgatgttgtcaagaagattgagtccaccaagacttccggtagtgctccaaaggaagacattgtcatcgttgactgtggagaagtcaaagagtctgttgaggatgtcatcaaggacgatgctgaagattacgccgaggccatcgaggaggtcgtgaaagatgagttgtagatcatagttagttattgtgtgtactcgacgaaatttcatcattcacggccattcgaacgatatcgatccgtcttacataattcaaaacgtcacctggatcagacatccacctaattgggcaataatcccttatcttgcgatgtatatctttgcgcggcgtttctcactcacaaaaatcaaccttgaacaaatatagggctctactcttttgcagccatttgaatatttcactaggtaaagatcaactacgatccacacaagacacacgttttgtcatccaccgagctcaaactacgtttataaaggctttatctgccccttagtattgttgactcgtttttttttcttggctttttttttctgaatcactggatatgtcatcccataagaagagaaggggcatgtctatttcagagactatagctaatatgaaccagggcaattcaaacgatctctcaggtcgaaactatgtgtttggaagtttcaaacattctcaattatctaatctgatggcccaagatggaagtgaatccatgcactattccaactcacctgctgttcattccactatcagtgttaatgaagagactgctacactggcaggtgtaggtgtgcttgaaggtccggatgatgagaatgtcgtgtttgaggatgagcattcaagttatgaacccgtttctttccaagaggagcattatcagaacctgcatgaagattttttgaacgactcaagttctctattgcatgaccctcatagaagttattctactatcggtgagattgaagagatgcttccagatgaggcgaatgacactgatttagagaaccaggcacaaaaacatggacataatccttcgttatctcgtttctccaagctgatccgtgatgcttccatgttggacacacacactgtgataaatcactgtgtcaccaaaccaattagttatttgccagcggttttccttggaactctattgaacattttggacgctttgtcctacggaatgatcatgtttcctattggagaacaaatatttagcggcatgggcgcagccggtatttctatgttttatttgtcatgtgttgtgagtcaactagtatactcattggggggctcgggtttcagttctggtattggctctgaaatgatcgaagctactccgttcttccattccatggctatgagtgtcttaaaacagctaaagggaagagaagactctgtcataccaacgactattgtggcctttgctgtgagttcagttgttacgggtctggtgtttttcttactaggaaaatgcagattgggctctttagttggttttttccccagacacattttagtgggttgcataggtggtgtcggttacttcctgacggtcaccggaatagaggtttcttctagaatagagggtggaattgagtattcgttgccggttttccattatctaacgcagccactggtctttctacagtggagcattccttgggctttggcaatcattttggtgatagtacagcatttcaatcataacgcccttattgttcctctttattttatactggtcttcgttggattccacgccatagtttctctggtgccatcttggtcacttgaacaggctagacaatatggatgggtatttgaatctcctccttctaatgaaccatggtacggattttacaagtactacgatttttcattagtggattggatgattgtgatgaaggagttccctataatgcttgcacttaccttctttggtattttgcatgttcctatcaacgtgccagcgcttgctgtgtcagtgggaatggaccaatttgacgtagacagggagttagtggcgcatggtgtatccaacgttgtaagtgggttaatcggttccatccaaaactatttggtgtatacaaactctgtcctcttcttcagagcaggggctgattcaaggttatcaggtgtcatgttggctgcggcaactgcaggtgttatgtttgccggacctgttgtcattggatatatcccggtatgtgttgttggagctcttatttacctattggggtatgagttactaaaggaggctctttatgacactcgtggacgcttggccagatttgaatacttgaccatcgttgttatcgttgtcaccatgggagcttgggactttgtttacggtatccttgtgggtatcttattggcatgtctatcatttgtagtacaagccgctagaagaccaattatttcaggagtttttacaggagagtatgctagatcaattgttttacgtcatcctaaacagcaggcattcttacaagatgttggaaaccaaatttatgtccttaaacttggtggctctctgttttttggctctatagggggattggagaagaagatcagatatagatttcaagaacccattttctccagggaaccaattcgttatcttatcttagatctcaacaatgtattctcattggatttttctgccgtggaaggcttgagaagaattaggaatctaatgatggagaaaaactgtttcttgttaatttcttcagtgagctctactggcccaactgttaacgctcttcgtgatgccggattatgggaacttccagaacatgaagagaaaatccaactgtttaatactttaaattcggcgcttgaatggtgtgagaacatgtttttgaagacttactcagatattaagagcagaacgatcaactcaaggggcaagtcaatcacaaagccaacacctgctcaaaagcttactagtgcttatgatagaggggttgtatcttcgcctagagagtctcatattttcaacgctgcgacaagacaagttcatgaggaggtcatatcatcaggcggaattcttacaaggggtaacatcccattgaacctatttatggcaacgtttcaaggtctttctaagctagatgaaagtgaatttgccaagattattcctttctttgaacgagaagtcttacctttgaaaaaagctttccacaactctgccaaagaccctccgtgtttctatattgtagagagcggacaagtcacaattgattatacattcccacataccggttttaaactatctactagtgcattgccgttgaccgcatttggtaatgtcgctgttcacatttggtcgcatcgaaacacggtatactcttcatccagcacgaccgagactattgtgtggaagctggttcatgcgaacgccgttcaaatgcaaaagaaacagcccaaactctacaacgagttactgaatatttccatcaggttattaagtgaacgttttgacagcattaccagtaatctattggtagcttcataaggataacgacccgtgtctcaattcctttgtgcttttaaaggatgataacaaataacatcatgcataatattataatcacatgcacatcacaacggcgtcatcaataggtagatagtctcgttattgttactatattgattctctataaaggaatgtcacacgagcgacaacggattgaggagagatatttgcataataatattagccgaaacactacttttctcattttctaggcatcgtaaagattctcctatctctaccacagggcgggtcaaaaaaaaaaaaatctacatcgtatcaactgtattcgtatctagaatctcataagtctgccagacagaaactgcaatcatggacgataatcctgaccattacgttaagtcgcttggactttcggatgagacctggaattttgacttcaaccaatctgaatatgaaaagctgggtcaaaacaaccacccagaggagatgtacccagattattcagataagcatgacgagctgcctttggaatctccgtatctgaaggatatggctgaagttcctatgggtcctgacatgcaccatgacgactttttcacgccgttgctatcaccaatggtacaacagacacaaccgccaacgaaccccaaactcaacgttaatgataactttagccctttaacttcaccagctctagcttcccaaaactctcgtcgaaagttgtccacggagagtagttccagtgtcaaagtgagaataaggaggcaatctaattcaagttacacaggaaaatcaaagactcccggttcaactcccaagctttcttccactagcgcagtgtccaattcttccaataaagtgataaagcaatcgccagcaataaaagcccggcgtaaccctggcttatctaacaaccttcatcggacattaagcagtaacaacacatttgcattgcctgaaagtgctcagactacttctacaactgcaacggcagaattgtccaacactttaaacgtagaagccaataacagtgatgagtttaccaatacgaactcggtgactccaagcacgttgatgtcatttggccacattccccaccattctactagcaatgtcatttttgatggtttaaaacatagttcagtagtcctcccatcgtccaaaaacgccaatggaagaaacaccactaaatctccaaatagcatagctaaagatggaacagataaaggaagaaaggctgatagtgcgtcacctcctacgataccaacaggaacactaaccaaacggccttccaagtcggatgaccccaaaaaagttaatcataaacttgccgaacaaggacgaaggaacagaatgaattttgcaattcaaaggcttgaagatcttataccaggtgactataaagaggacacaacagtgccatccaaggcaactactgtggagatggcagtcaagtatatcaaggagctgcaaaatcaactggaaaaacttgaagaacaacgttcaaagtagctgaataatgattgcaccaattgtatagtagatagagtaatgacagaagactatttcccctctaatttgggctcagtcgatcgatcccttcaaagagttttagcgttaaaacgcagggtagcaataggtcatcctagcttggggtaagcgcgactacttcctgcccacagaaaataaatttctggcctgttaaaattcctgtccccggataattatgtcagacctgcaaagaagactactatcaccaagtggaaaaaccaagggaggaggtagcagaggaagctccagatcgcattctcgagtaagtacacctggcttgagtgacgatgaggacagttatttgaataacgacctggactttaatcaactggatgagttgctggcaaagaaactgggtgagctatcggtagaacctagtagaacatcccgttcagagaatcctcagtcgacgagtcccaattcctcaaaaaaactgaaggagccctcagacctggaccaagtgaagcggaataaggaaattaccaaccaggatctttactccactgataacctcatcagttcattaactagcactagccgaacgcaagtatcgcaagaaagtagggaacttttattggcccaactgttcaacctctacactacatcatcccgctaccagcatacttatgacgaatttcagctggagcagcttataagggtctttataaatgcaaagaccgagaatgagaagctgtttgccttgaaatgcggggcctatatgggtgccattgacacagaggaaagttcacagattatagtggatgagtttttaccgttgctaaagagagacataattgttgatgacgatagtgtttctgttactttgaaggcaaattatattatggctttctcatctctattattggttgtaatggacggctccgggtgctatggaattgaagaaaatagtgagatgtttttggaagtaattgaagggcagctgaatagcaagaatccttccacatcaattgtcgtcaattctttacaaagtgttggaattatattaactttgatttattcaggaagaggaggacctagcagctctctaaacgattatttgatcgaaatagctcctcgtgtggtggcagttattgaccatcctgatttccaaatacaattggccgcaaccaaattgattggcttgatttacgaattatttgattacgatgagggcaacgaagatgaggaagaatacgatgagagcgaagcatttcagccaagtccatatcatgacgaagaaattctttactctctgagagagctttataataaaggtaataaaaagacctctaagagggacaagagtgacaccaaatctgtcttcaaggatgtaattcaatccattgagtactatttgaaccaaaataaagagccggacaggcttcaagacatttatgtattaccaacgttgactcgtttgaagatttcaagaactaaatcttatgagatttccagttggtttaccatcttaagagtatccagtctcaggtatctttttggagcagcgttccatacccaactacttcgcaatgctaacatcaagaagcatgttttcaagccatctttcaatggtttgaattctggaagctatgaagaaaactttgatgatattgatgatgatgagtatggttattcttcatcccactctcccttgagtgataaaaagaaaacgcagatgttgcaaaagaagagatcagagaaggcaagagaaagggttcattctgattttgtcggttaattctaagtagtggaccataatattatttatcttgagattaaacaaagtaggcaagatttgccaagttcaattacacttagtgtgttcatgacgactgtaaaattgtaaaattatttggtgaacatggttcctgagtatcatttgatctgttgcgatagggaagggatgaaaatataagtttcctagtgaaatcgaaagtaatttttctgatttacgaattcctcccggtggccaagctggctaaggcgcgagactgtaaacgtaatttcagctaatcttgagatcgggtgttcgactcacccccgggagattcttttttttttccagctatattcaaaggtagaagatggtagagtaacttgcttcaacgggcaaaatagagatttcattggcgtacaatgacttatggtcagccatcaactcatcaattatttatcaaaggatcaaaaagttgttcttagtggctctctgtttcgccatgttaccaggcaatcttatttcgcctagatcgcggtttattctctgtttacgttcttctgcacccagatgtcattactgaaccagccaattgtcctggataatggatctggtataataaaattgggctttgctggacaagagcagcccctggtatatgctccaaatatcttggggcggcacaagtacagcaaggtcatgactgtaagcgagatagatggcatttctgatccaatcttagtagggaagaccgcacagaagcacagagggatactaaagctctcgtatcccatgaagaatgggcatatctctgattggaatgatattgaactgatatggaaccagcttcttacaaaggacctcaaggttaatgatgtcagtgatcaccctatattggtgactgagatacctttcaataatgttaaaaatagagaaaaattgaccagtatgatcttcgaatctttcaattttccggctctcaatctatcaataccggcggtactttctttatattcgtcaggaagaactactggggtagtgcttgatagtggagatgaggctacatacgtggtgcccatttacgaagggttctccttaaactcttctatgaaaagaatagacataggaggaagggatataacaaaacatgtgcagttcctattaagaaaaaatggtgttcagctactgtcgagtagtgaatttgaaattgtcagacagatcaaagaaagatattgcagggtttcgcttgatcctgcaaaagatgagagagaatggtcggtgtatatatctactcacctcttgtacggaagtgacacccttggtgatgcagatagtggaaaattaaccagattcaagttgccagatgggaaaatggtagagattggagctgagatgttcagaggtcccgagatcatgtttaatcctgtacttataggatcggaggccaatggggttgatagtctactcacaaattccatcaactccatcgatattgagcttcgaccccaactttatcaatcaattttactagctggaggctccacgatgtttcaggggtttggaaaccgtcttcttagtgaactcaaatccagttgccctaaagggactaaattaaagattttttctccgccagagaggaaatacagtgcatgggtagggggttcaattttggctgggctgagtacattccaaaaattatgcgttactagagagcagtacatggaaaatccagagtcagttgttgaaaaattcttcttaggttgaatgctaaatacaataatacctatcaccaaagtcacccaaaccagggacgacaaacttgttctcatccagaccttggtcaattactccagttatgatcttgacgtttggatacttcttataaaaggcctcaatgccctcaggggcagccagcaagttcaaaaacaagattctttcttgcttgacaccttttttcaaaagaacatccacagccatcatggcagaacctccagtagccagcattgggtctagtaagaaaacataacgttcactaatatcgtcaggaagtttggaataaaacagcttaggttgagctgtctcttcatctctttgaatcaatatcttaccaattctcaccgatctacagcaatcccttaacccttgttccattgattcaccagctcttataatcgaaacaccacaaattttgccctcaaaggagaaaccctcgacctcatgaccctgtgaagtcttaactgttgttggtttcactggcaattggttcaaaccttcttccaccagtaacctcatgattctgtcactataaaagacgaaatctccacgctttgtatttttatcacgaataatggtgtacaatccccgcagctgattggtctgccgtagcataaatacatttggatagtttgttgctgacattggaatggctaggtttgttttatgaggccaaaagaaaatggtatctctttttatatggaggggtccaatgttttagataccagcctcccaacaccacccgacgatctccggcctagggattagggattacgatactggaaagtggaaaaatacaataataagatatcattaaaagagacttagacacggttttcttcggcctcttcgttttgagtgaacggattagccacttcctcgcttccatctgccagagcaaggctcaccaatttcggtcccctgacaatcacacggccaagagttctcttctcggttgactttaaaatctcttcagcatcatccagcactaagttcataagttgatcataacctttcaagcatccaatcactaaagttgttagtaagtcagttcaatttttcagtagtcttatacttaccttcacgggaatcgtggactccggaaaaagttaacctaatttgcttatctttgtagttggcaaggttaataatggacgctcttttgggagcgtctcttctagggccttttctttgatttcccctttgaccttgtcctcctctttgattttggttatatctttgaccttgtccacctctgtgaccgtccctttgaccttctctttggccatctctccggttactatcctggaagtttttctccctactattctgattctatttggttagtaagttaaatttttaactgtaccgcaaggagtggttgatgggaataactgagtggatactcaaataaaaacttgttttaaagtcttagaaaaaatcactggaacaaacaatcaagcgataaataaataagagctcggtctatccaaacgtttcctctgagtgtgagcatccaggctctgctaacgactagacttactctttccattatgaacagttgatgagagagatgagatatctcgaagacgattcatgtgctattatttcgagaattgttccctccagaaggaacgctgggaggaagtcatttgcgcggagctaaatccgtctctttgtttacgtgaactcttaccctagtacgttatacccaaaaaacttcaatggccgacgtcagcgtttatatcacgtcgggattgacctcctcagagagaagaatatctcctcaatgggacattgcacatttgaaacaacgattagagtttgttacggggatacccccagcagatcaaaagatctgggtttacaaaacgcctacatccaatgcaaggtacgagctgaaaggtggcgaagaaacgacacttaatgaattccaaattgcaccctatactagaatccatgtcgagaacatcaaccagcattcggatatctcagaattggaatctgcaacggcccaggatgatgacgagccagtcttcaatttgagtgaagatcagtacaattccatggataatacagtgcgcaggtggaaagaggaaaacaaactggggcgattcgatcccgattatcagtccaagaagtctagaattttggaagaacatagaaaattatcagaatcgtttgagatcggagcgagatgtcgcacaatgaatatgatggaaagacggggttacatcagatatgttggaattataccagagattgacaatgagagctactgggtgggcgtagagtttgatgagcctgtgggaaaaaacgatgggtccatcaagggaaaggcatatttcagatgcaaggccaaccatggcagtttcgtgaaaccaacgttggtgcaagttggagactatggtattaaggaagatgaacacagtgatgatgaggtataaatagaagtaatgatatctgtcgtgagcctgtgccagaccttggcttacctacgaactcaaaaccacggagctgtgacaaaaccgcgcacgggacggaccagcatcgaaggaaataccaaacagcctttgccatctagctctcgataatgtttgacctacaagccatatacgatgactttatcacagactttgacatctataacctcataagaatagtcatcatagttggaggatatatttttttgagaggaatcgtgtcaacagagctgaagaaacggcaattaaaaaaacaacttgagagcgatcggaagaagaaactattggcacagggtctcgtagacaatgatgcatacgatgtaattcatcccgaagagggagcttctggagtccaggttgaagaagagatcatagatgacggctcttgggggtggggtaagaagaccagaaaagagtacaacagaaaggccaaaatttttgaggagacaatcaagagggaacttgaggctaagcaagcgttaagatctgagtttaatgaagattctgatcaggacattgctgatcttttagaggatgactagtgtatttataggtggagatggtcgatggtgattttgaaagacacttcctggccacctgggcggaggatcgagacctttttctcctacctttcaaacaaaagtgaaggaaaaaaaaaatctacatactcttaataaaataatttgacttaccaactacaacaaagacctatgagttataggaaagacaacaaacaaaagttgccttttggattagattacaatgatctaaatgttgtagttgaccaaaagcgatttaagttacctcttcctatcaatggtcccttgaataagctggaaaaggaaattgccaaagagtacatgaactttatgaacaacgtcaaagaaagttccttctacagcgacctcaaggatgacgatattcaaggtattaatgatggaatacaacgatacagtgacaaatataggaaaaagaagaagccaaatagactactggctgatcatccgttcattgtagagttcttcccagaagaattgtatgatgtaatgggagttgacaataagaagaagaaattgcttaagcttaacaagacccaagataacaagcttgctgaaaatttggaagataaactgagaaacatagaagaaaatgataatgccgtgctagacgaaaataatgtcgagaaggagaacgtagaagaagagttcgacgacgaatttgaggaggatgacgatgatgactataatgctgaaaaatacttcgatgatggagacgatgattatggtgctgatgatgacgatgatgaagctgccttctaaattgtctttaatattattattagtacgttctattcaagatctgtccccatgaatgtccttcaaaaacttttccctgtcaacatagtagtattcttgcgtattcattcctatgggaacttttggaggcaccaatggcttgggttggttttcttcgaggccgtactctctcagttgttgtttccgtatctctgaatatgtcatagcgggtttattccatttaccatctcccacgtatccacccctgtctatctggtctttctctgatgcatatgtactaaatttgaaatcttttaaatcaagattcttcccgtcttggaattttaaagcttttgaaaggtttatatccggagttggagcaaagtgttttggatctagaatttcatcttgtttcgaaacttcgtaagctggtaccgatactttacttgtccctaagtagatatccgagaaggacgtctgagctggcgggggtggcttcctgcctttgggtgacctggaagaggtaaatggtgattgggaatggtccatactcttgggacgcggtgctatattttcctgttcatttactggcactttttttgggggctgatttttgctgacccaagaagatgcaatgtactttttctttcctatgtccgagggatctctgctgatttctgactgaatttgctgctctagaacgtcaaaggtatcacttgaaggtttgctggatgagcctattagctctctggagggtgaaacagatttggataatctcttcgaaatcttgctcagcacagatccgcgttcacgttcttgttcacggtgacgttctttgctcccaggctcactaaatacacttacacttgggctcgcactgtatggtggtggtgtgagttcctgatcttctaacggaggcagaggtaagggtttgtgtacagagtttgatctgacggaactagcaagctcggtgttgagtggggacaggtcaaatgagtgtttagaccctggaatcgctggaagtggtctgtctgatgttcttttagaagttctgggcgtgtttacaatcttgggaggaacgattggggcatctggatagaaagtcatttgtaaataaatctctcccctatttttcttataagattcagaatgaacatggtaccaatcatctagatcacctctaataaagactttagtaaggtcaatttccgtgcttgcaatcaaagaggacgactctttggtgccgtcgaatatcataagacccagcttcggctcaacatctggtgttatattgaaccgaagttcgtggtcccattcaggagtctgaccgcctctatatatagtttttgatctttgaactggtaatccattaattcttagaagacaatatggcgactgtttgtcgagcttgcgtatattgggtagatccctagccttgtcaaccactattaccaaagttccgctaaccttgtagtggggattaagggacatttgttttgaaaatcacgagaaatagatagatgcgatgaccttaggcgtaatttggtggtgggagaaaaagtaccgtaccagaaggagggggagggaggatgttaggagggatgaaagttcaaaagcgagagatgaggagactccagaatcgtccggatggacgactgctttgggagaagctcaaatggaaaatagtaataataaacaaaacggctgggcataacaaaaccagtgtccgtctgaatcaaaacaacatgataaagaaaacaccgtactattggctgcttttatagtttcattaacccacgcactcactggtctgaagaaattccagccgcgcaattaaatgaattggggccccttaacggcgatgatcttccacatgagcaataaatcacgtaatagagccggtttcttatggtgtcatctaaatatttaaccaatgattattgccgactcacttgcctcattgcctcagcttattctgtcaattcgtgttgggaagagaataatagaaatgcatgtggctctatttggtttttttttctcacccaaatgttctcatgcataagaaagcaatcgtgatgtaaccattaaattccctatttaaggaaactcaattcctttcagtgttccccatcaccctattttcaattgtcaatgtcttcagaatctagaacctattcattcaaaatcttttcgattttgacctatgctctgtcaatttacggggaagttcgttacttcctcttcagaacccaccacagcaggtcttatttgactccgttcactggaaactccacactcgactacatctatgttattgccacacttttgcttcaattgttgttcgtcgtccagtactttagccaagatggtactgtttcagccagagaacaaaagaatgtgttggaacaggtcggataccacttctccatctacaatgttctgaactttatctgggtctatcttttcaagcacaagagatttttgtttgctgagattgttttgtttgtcaatctattcaatctgctgtctctgtacttcatccacaagacttatgccattaaggatttgggccgttggttcactatccatctttcaacggtggctttaccactttcgtggattcagtatgctattttctggaatggtgctgctttattccactcccactatgtctccttattaccacgtctgctggccaatcttttgatctgggagtttttgttggttccagccttcttcattgttgtgtttgctgattacggagtgggtttctccagttcatacctcaccctcagtatcgctgttggtcaacttttgactaaggttattggtctacaatggatctttgggttcgttatcgctggtaccatcttccttctgtcattactggtctccactggtgtgctggctggaaaagtagccaacaataacaacgtgcttggttccgacagagaacaagctccactgttgacctaggccgattgctttaaaccaatcggtggatgggcaggaccctatatgttgtgtacttagtttcggtcaattttactttttatgccatcctcatcaactctacaccctgccattttttcaatcatctcgaactttgtaatagcctggggcttgttcaatcctatacttagatactccaacattgggttgtgctgcactaaagtggcgtaggtgtcctttgctatgttgtccaaccattcctttctggtcgtgtcagcgttgcccaaccccagatgcttggattttagttggtcaaaaacctgttgctcttttagtttatcagcctattcatgttagtgttctgccaaagtaaacatagttcttgaaagaagtagatgactcaccattatttgatatgggaacaaacaagactgaaacaggtttgaaaagacaaaataggttgatactaaatttctcgaaggaaatctggaagggaccggaaggagactgccaaaggaattcctaccagcgaaagagaagacgttgtgattccaacatgataacatttcataatccacgaaccgattctttcaactcgttcactctataccaatgactgagcaagttgtttccaaagaacaaccatcagcgactgaaagccctatggacgttgatgtgcagggggacacaccagttcttgggaccaatgactctaataccaaagatatcccagagttttggcttttcttttcagacaacgtcgttagtagctgggatagtgaaggacaacaagagatctctaggcaattggacgagaaagaacaaaactttgaaaccatagtttacgaaactttgatgatcgtaaaagactttccgaagagactttcaattgagaaactacaatcttttctgaatgagctgctgaaggataattttaagagatcggaaacttttgtccttctattcaactgtttaacggtcaatgacaatatgattcaactactgaaatctctagatattgaaacctctataaaacttgatcatctagagagaacaacgttggagaaattgcagttgacatcgaggagttataagcagaagacatttgcttatctgagggataatgtatactcatttgaaaactttactctcttgggagaatctaatgaaggttacagtcgtttagtgctactgctaaccgaatactttaaaggggagaatacgaaatatgttattccaataatggtcgatgatgtgctgaaaatcatgaatcactttcagctggattcagttaaatgcttggatttgatattcactatttctgcgacgtattccttaaatcgactggaattgattctggactttttgaaacaaactcccttttggcccgaaaaaatagttcaacatcaaaacaaacttgacatagaggccgttttcaaaaacatttctaacaagaatgactccggaggtagtttgatatcatctcaactggttgcgagcaagattacgaggtacaataccgatgagttgacagttactaatgaattttttcttttcgtgtcagttcttatccacattggattcctgaaattctctgttatattcgacagtttatcagatcagcccgatgatgccgcggaaaagctttatgaaatctacaaaagaatgactgaggtgaatatatttgaggcttctgcctcagcgttagctttggctggacctctaccagacgatgatgaccttgataactcaaacggagacgatgtgacaatgaaggatgcttcggaaccgaatccagtgaagcaactatcaccaatggaagaatttcaaatactgtctaagcagagaaacagtgcaaagatcgaactgttgaaaagttttctcagcattgggctctacatggagtcccttttaatactatcgaagtatccatatttaccattggttgatgatcaaatcgccgacttgatcaacaggtttgtttctgcatgcataaatgactattatgagagcagtacacatcatactcttcaccttaaagacatcttagaacctacagctaactcccattccgctcgtatcatgacattcgatccatttgaaaaagaagtttctggaaagaaaactattttcttttttgattggaaggccctacttccagagatcacgaccagggaggagtttgttaaactgtgtcacgaacttctgcatttcaactctttcaggttgactagagatccaatattactgtccaagatctgtagaatcatttatcatgacatttcaaaacatggaaaatctcaagaggttttggattattggcttccattttataggtccttcattctaccctgctttccattattggaagaaaattgccctttgatccaggagctttttagaattattgctgaatacccattagaagtgagatacaacctctatggagatttacattacaacatttcaaagaatgtccccgaaatcaagttgccttataatagggctgaaaaacagaccaaaaatgcattaaagagactctccaatactaatattcaaacaatgacgagaaagttggcaaaaattgctttgtcaaaccctataccttgtttgttggttattgtccaacaactggagagctatgataatttgaatgagcttatcgttgatgtttcaaagtattttaacgatttcacctgggacgttcttccatttatcatcctgataaggttgacagtaaacaggccacattatcaacctgatgggattaatatatcccaatggcttcaaagtttgtccgtatttctcggagaaatttcaacaagttcttccctaatgaacattaaacctttgttagtattcattatcaaactattatacagggataactctttggttttacccattttgaaccagttattgctgtcaatggggggaattcagaaaacatcaaatttgacatccacacagattattcaattaaattctgagcacagtctgaaaagaattatatacagtgtgatacaagataaacgactactgaagactcgaccggctagtcgtctcgttgccagtttgttaagaacgggagggctttctgaaattttcgttctactttgtcaattaatgaccaaacttcagttagacgtcgataagaatcatcaatttttgaaagttcttggacagagaatagatgatttgagttcacttatccaattgttcacagaatttatcttttcctttgttacacctgacaaattcaagcaaaattttccttccttacttgagttatgttctgattttaacattgatgttgcttgggcgtttgaactctggagaaacttctcaaaagaatacaatgtagagattattcaacgtatcaaacctgactataactggaaatatctcactccgcagctgtatgctttcttttggaatttgtcactatatgacgttgattattctcctgagttgtatgatgatgctattaagaaagttgaacttcaaatagccaagatagaaacacaaataaagaccgcaagcagaacagttactggtgccaacattcaggttttgaagaaagagctttctgaactagctcactctcagtcgaatatacctctggataaagagcgccataaaaaacacagcgagaacttcaaaagggaagtgcaagaagcgagacaggaatggttcaaagattttggaattgataatgctgctgatcagaccgctgcttttctatcttactgtattctcccaagggccactcactcatcttttgacgcggttactgcagggaaggccatatttttcctttacgaacactgcccaaagaattttcatcttatttcactattgcagcagttattttcaggcaggtttttgcatcaggcgctcttcactagtacttcctcggaagctgaaaacctaggaattttttattcctacgttctggaagagctcaataaatggagggttcccgatgagtaccccctgagtgattgtgaacacgataaatttttggaaacacttttcaattggcatgcagatcttcttgccgatatttctaaggccttaaaggcagagaatttcatgtcccttcataatgcaatagtgtttctgaaaactccggcttcattatttccaactgtggagtcacattgcgagtctttactttttactttggatcaaatcatatcaaacgataccagaggtgacatcttactgcccgcaaggtctttaagtggcctgatcaaggcacgtagatcttcatggattttaggatgggacttttacgcaatggatctaaagcaaaagcaatttttattgctcaaaaagagagccattaacagaatcagaatcgaaaagcgtaggaaggccgaagaggaggcaagaaaaattgaaatggaaaagaataaagctcccaacgcatatggtttggcttcacttcctgttcgcaaggtggtcaaaattaaaacaacaattgaaagccccacaactttaaattcggtcgacttttctgataataagaagcaggccgaaaaacagtacgagaatggtaaaagcaaagagggaaccaaaaaggcaaagttacctgagggaccaaagaaagagcacaaaagaacaaaagaggaaaagagagaaagacaaaaggaaaaggaaagggtaaggatgaaagacaaagagaagcagcaggagaaagaaggtgatattgagaaggacaccgacaaggtgacagagaaagagaacaagaaggagagtccgaaagagaaagaaaacgagaaggcaccagagaagcgagtagaagaggtaagctctgaagggaaaggaaaagaaattaaagatagagaacaagaaagacccaggtcatctgaaaacgatctaaaggaagactcgtccaagcgcagagtagatactaaatccgatacacctcctcactccaatcaagacaactcagaagtaaaagcaccaggtaaatctacaagagaattgcttgaggcaagattgaaacaggagaaagagtttgctaggcaaaagaaccagaccggtggtaagaacaactcaagacctccttccagatctgaaaaggaagcggagagtacagatgttcgaacagagtctcgaaatgattttagaggtgatgtgaagaaagagattccaagatttccaagacgaaatgagtatccttctagccgcaactatcagagacccgtttcaactgttagtcgtggcctccctcaaggacctgctcgggatagacaagattctgacaagccacttccacctccttcccaaccgccacccggcccgtattcaacttcaagaggaccctcatattctggccgaggtggaccgagacaaccacaaagtcaaacatttcaatcaagggataggggaaaccagtctggattcagagatagaaagagacaccgggatgacactgattactactctcgtggaaagaggacttacgattcgaaaggttccaattatcatgaccgagaaaagagatacgattgaacattaaaaaaggtggaattacaatagaattaggttatactatttaatatcaaagacaggtttcaatttacgtaaaagaagccaatcttctctagtcacagtgtcacggaatgctggatctttcagagtgtcgatggattttctggagatgagggaatacaaagtgtctgactcatcgacatgacgtccccataccggttgagcagctgaagggttatccaaacgcatggcaacaccggcgctagtttgtcccttctttacggaatcaacagctttgtggtttatttccagcgaagttactttacccaaaaccataatgtttctttgcttggtttcaggatccaaacgaacagcacagattggtgttccaatacggactgtaccctctataacatccacaccaataatcattggttgacgtttgttgataatctgcagagtcttcaagacacaagggaaaattgcgtactcaaggaaatccttacgacgttgctccaataacttggcctgataggcactgaatgcatcaaacagatggtaaatgacatcagcattgaaaattttgattccttgttcgtcggcgtattgttcagcttctttatcaattttaacatcgaagcataacatgacagcgtactccttgtccttttccaacatggttgttgccttcatcacgtctctcttgtaaactggtcctagacctatagacataactgggatcttcatatcctttaggaaatcaagaagagcttctaaagaacccagcgtagatgcttgcacggtaacaccgtgaccagatgagtcgacagagtccagaagacctgtaagatcatccataacagtatcctttaattcctcttcatcatcatcaggtccgacaaccagcagtctggaaccagccacagccttttccaaatcattggcagcaatcttaacacccagagctgctttaacctctttatggtggatatattctgacttgatacgtagctcacgagatgggggcggcgttagaagcgctctaatatttgtagcaataggaccgttcaaaccacagagcacgatacgatcaccttctctcaggataccgttggaaagaataacatcaatggtagtaccgaaaccttcaactaccttgacttccagaatagtagcagaaatttcagatagatacatcagctgtttgctcattctcttctgagttaattccaaaagtaaccacaacaaatctggtacaccttcaccagtaacagctgatgtaggtacaatggaaacatacttggccatgtttctgttttggaagtataattcggagttcagaccttgctcagcaagagcaaccttgatcttggtaagcctatcttcaaattcctgttgaacacttcttgtctgcttagagaaagagtcacggaacgagttgttggggatggtttgccagtcgtaaagacgatcaattttgttcaatgccacaataaatggagccttacggtcacgcagtagacgcagagactcaatagtttgttgttccaaaccatgcataatatctataaccaaaatggctatgttacacaacgaagaacctctggatctcaagttagtgaaagactcgtgacctggagtatcaatgatcaacagaccaggaacttcaaatatacgtttttcatatacctgcatgacttcagtctttttctttattgcttccactgggaagtatgtagcaccaatttgttgggtaataccaccggcttctccaccttgaacattagtttgacgaatcttgtctaacagttttgtcttaccggtgtcgacatgtcccaagatacaacaaattggtgaacgtagattggaagtgtcactttccttttctgctgccttagaagcagacttggaaacttttccggacttatcaagttcttcaatcttggaagctgctttgataggctttgtttccttctgttctactggagcagacttcttttcgggggctaatttctgaggagccttctgctcttcaacttttttaggagtctccttaggagcttcctccttggaaggttgctttgaaggcgcttctgctgcttcggatttctcatccttgataacatcttctagagcttcccaactatcaacaattggctcatcattttcttcaagagctaacttttcccagtcatcagcaatagcattttcttcctcactatctttttcttgagtggactcctctttgacggcgaccttaaccggagtttcctgttcggcaggggtttctaccgttttagagaacctgtttggctttctcttggcataggcagggggttgtttgggagtagagtcactttgaagaccggctaccctgaatttaccggtggccagcatttgctctcgacgcttctctgccagctctcgttgttgctgctgtctcttggataacaatttgccctcagccttcagcctttcccgttctaatctaagttcttcttccttggctttgagttcagcctgtctggcagcctcctcagcggccaggcgggcctcttcttcagcagccaaacgagcctgttcagcttccaatgcggcagcctcctcttcagcttgcttctttaattccagctggcgtttaagcgcagcaataccagcagggaccttctttcccttcttcttaggagcagaagttgtaggagcaggttcggaactttcagtaagttcaggagcagattcgggagcaggagaagtcgaagcagaggcgacagcagcagaagcagcagcagcagcatctttttcagccttctgtttctctgcaaactctttattctgctgtttaaccaaatccttttgtgcctgttgttgttccttcttcttctttgccaactctttcttcaatgccttttctttctccttcttttccttttccttctgcttcttggttttcagtgttggcttggcagcctcatcctctgcttttttctctaacttatccttggatgcttttagggccgaaagaaaatcagcttcctcagcttctttcggttcttcactggtagatacagatccttcgggctctggagtggctccaaactcttgggccgagtcaatttcgttttctaactcttcatcccagatgtcccctccggctttattattcttttttccctttttcgccatcttgaatcaatctccaagttcgccttccttaatgtctttcgttttccaaaggagacaaaagaattggagatggtcgtgcatacaccatgaaaattttggtgggctattatactgaggaactacagtcgtgcacgttactgaaaaaaaaaaaaagccaggggagacagatgttgtgctaaggaagatactattgaaaatatataaatcctttggattgatagtattctgttgacttaagcagttagccccttacagaaatgacaacagtagagaaaattaaggccatcgaagatgagatggccaaaactcaaaagaacaaggccacctccttccatttaggccagttgaaagctaagctggccaagttgcgtagagaacttctgacagactcgaagaagtctggaggaggtggtggaatcggatttgacgtggcgagatcaggcgtagcaagtattgggtttgtgggatttccctccattggtaaatccaccctactaaacaaattgacaggtgtggcaagtgaagtggcagcatatgagttcactacgttgacctctgtgccaggtataataaagtacaaaggtgccaaaattcaaatgatcgatcttcctggtattatagaaggtgctaaggatggtaaaggtagaggtaagcaagttatcgcagtggcaagaacttgtaacatgatattcattgtgttggatgtgaacaagccactacatcataagcaagtaatagagcatgaactggaaggttttggcataagaattaacaaacagccccctgacattcttttgaagaagaaagaacgtggaggaattaatatcactacgacggtccctcttactcacttggataatgacgagatcagagctgttatgggggagtacagattaaactcggctgacatttccttccgatgcgacgcaacagttgatgatttaattgataaactagaggaacaaaacaggaagtatattcctgccatttatgtcctgaacaaaatagattctatttccacgcaagaattggaccttctctacagaatcccagatgctgttcctatcagttcaggaaacgaatggaacttagatgaacttttggagatgatgtgggacaagctgaagcttgtgagagtatataccttacccaagggaaaactgccagattttgaagacccagttgtgttgagatctgatagatgtactgtggaggatttttgtaaccaaattcacaagtctttggtagcagagttcaagaacgcgattgtttatggatccagtgccaaacatcaacctcagtacgttgggctgagtcatgtgttgcaagatgaagacgttgtaaccattttgaagaaataaacctttttagtttttctattttttttttaaggttttttcttcgtttctaccctaaactctttcatgtgtaacataataaatggttgattcgtagtctatacgtaaattttaggcattgtatgctgcaatcaagaagctgacaaggaagctcaggttgaaacttggcttctcaaataccaattcctttaggttgatagtctcggatcctaactgcaccacccgattgtaagggatggtaatgatgtttcgggatgcaagaaattgaagcagcaaataccctgagagagttacgaatacgaggacggaacttaacttgccgaccacgaacccaactcctagcccaacaaaactaccaatagctagctgttggtaattgagagctccaccaaaagcgccatctaaacggggagaagattccttagtaggctcaataacttgtccaactctagatccaactggagttgttccagtcttgaaagtctcattctttatgattttatccattagacacactgaagaagcagctcctaaaacaaccccaagtggtttagaatagctagttgtaggagtaaacagtctcctctgaaaagaagaagcccattgaagtttaggttttgctagtccagctcttaaatgtttaaacatgtacgatcagtaagtgtatttgttggcatccacgtcgtcttgtgcagcaaccattgagcgtgatggataatggtgttcggatgtacaaacgttggttgggatttcagaaggtgcttgcttgtgttgggtcagtagtggagaatgctgcagtaagatagggtgtatgataacaggaaattatacacaatattgaaaactgatgaaataattataacgcagacgtgatggtttgaaacatttatttgaggaaggcaggtggatggatgtaaaacatcattggtaattgattctttcccctagggaatggatgaattgctgtcagttcatccattagagtacccttcgttgaactttacaacagtcctgtttatgctaagaatatcaaagcataatgggctgatcaatgcatttttttcgtaaaagttgaaatgtataatacttaccagctgcgacatcactgatgttgtggtcgatgcttcaaaccttaacgtgaaagggtgttaaataccgaattcggaaattatatctcttattgcttttgcttttttcactccagttcattcgagtccaaggatgttaggaaataatctctccagttggtatcacgatgttgaagaacttgaaacagttgaggctccgcttgtagtatgtgtctgcgaaacttccaaggcattaaaactgtatcaaagagtgcaacatactgcatgctttataatcatagatcccttcttggatctaaacaagttgaatagcgatgaagttgaggttctgttgcgatttcaagaagaaaatgatatactctggaacaaaatagacggctgcttttcatcgacttcagtggtgaacagaagtttgaacgaggtactttttccactagtgagacttatggagatgaacaactggcacttaaacattgtcggacaagatcaaacggggttgctggctgctttcatctgtactatggtctactttaaaatgaatgtttcacaaaacatgaaactcactggagtggataaaaatgatattgacattccgatggcaacttcattttggatgcaatggaactcatacaagaattactctcctaaatcaatgaagagaagaatcgactgtgtatgagatcagatcacggggttgatgactggtaattgtcatgtaaataaacaacatgcctacggtcttcgaaaaccgaccaccaaaaacagcacaacaataaggcaaatgacatatgaatactccagtcaaccaagtcaagtattaaatagtagaattaaacaaccctttaatccctggagttcagaaatcttgtggagatttgaaaataatttagctggagtgttcttaaacgcaaaaacaatcgcctcttgatccgtatggcctccaactagaccgctataaggactctaactagtccaatttcttctcagttctctgaagaagctccaaatacattgtatggtcattgatgatttgcttggataatcgaataaagccaaattgccagtaaaatttcagattttctggatctcgaactgtagcatcattttctcataattgaatacgttcaataccaagcgctgtcatgaccatcgatcaaacgtgccaatcgcttgaagatctaggtcatttgaatagcattttgtcaagatgctcaaacgtcaacgagctgcagcatttcatccacgtcttggattctgaaaaggagaaaaccgataccgctatcaggacacttcataactctagttacaaagaagaatcagcgagtatacgagaattagagcttaaaagagttgaactatcgggcactctaggaaacatgaagtctttagtttccgttaccactgaagcccatcaacttggggatcagattaccacaaaagtcaagtacttggatcaagaaaagaccaaagtattgcagacttacgagttcgtgaacaacgtccaagttttgaagacagagttggccaacgctcatttaagtattcaaaacgaggactggctcaaagcctgtgaatcaatcaatgtaattagacaattgcctgattgggtactcactagtcgatttgtcaatgccacagttcccacatctgccctgccagacgaaccaaaggaagtgctagaggtttggattaaagatttgagccaaattcttactaaagaatttgacagagcagccagtgagagaaacccggatagaatcacctattatttcaaacttttccctttagttggccaacaatcaattggaatcaaaagttactcttcttttatttgcaatataatacacgaacaatctaggctgaatatgaaaacgagtcaaggaacaaataccagtcatgcttttttgatattgaagttatttgaaacaatttccaatattctcatccaacattctaatgtcataaagaagcattatgagccacggtacatattggacgtgatgcagaaaatccagaatgaatgtgatcttcagtgtggtttaatttttgacacattctgggatactcaacgtttggacagagttgttaatctggtaagagagtatgactatccagttttggtcgaagctcttacaacgagctccgaagacagatccaacgttgataggcaaccaattgatgaaagaatttcgttatcaaacattggcgatcttttgaacgagttagctctcatattgaaccgttggtcaatgtattgcaagttcttcagcagtaagtggaacgagtttaaaaatgaaggagagccaggaaaaaccgaaataacgagcttaccagaagcccttttcaatagcgcatttatgagtaaaataaaagagagaataaatcccgtattcgatacgttgagtacgttttatctccgacggtctttagaaaaagcttacgaaatcgaagagtttccaaacatcaccaagaacctaaaccagtcagttcaactagttttgacccattctgttgagagcttcgttccaccttcaagtaagccagcctcatcattaatagacgatttggtttttgtcttgaacaatatctacaagcgcgcagtatccactgggcaatcaagtattatcaataacttgatcaatagtactcgccgtatcttagagactaattttttatcaattgttgctaaagagttgaaagaaactcaccctagatacaatactcaattgataaacttcaaaaccattctcacaaacacagcaactgctagccgtcaaggaacaccagtacccgcaaatgatgacacttcattcataaaaagtgcaacaactgcattgcagtcgttaaacttgaacaatgatgaatcgaacactgccaggatatcgaagtacttgattcttttgaactcaatatctctattcgatgaatatctgtctcagctggtttcaaatctactgaatgaagtggaaactgactatctagtgtttttggaggaaggagaaaacaggatcaaccgtttgaacttaaaggtgatattagagaatcttaccggaaaaattcatggtatttgtgatgcatctttaacacagcatgtaaggatactttacacgcaagtattcaaaccgagactaaccaaactaactgttaatttgtttgccgaaaatgaatttcttttaaccttggaggaattcgactcaatcgatagcagcaactctgatggagtgtcgacatttttgcaagaattcacccagttgactttcccctattacgctattatgacacaggacagttataataagttgattgccatgtttatcgatcaattgtcgaaagatctggaggaaaagatttggtctttggaaaataaatgtaatgagttagggttgataaaattggaaagaagcaccagtgctttgatcactagtctcacgaagctaaattacaagttaagggaccgatttgtgagggtcacccaaattattatggtcagtaatttaggagatgatgaggaaatagataacctgggggagatgcactgggtgttaactccaactgaaaggttgaaggctagaaacctacgggttgataggtgatataaatggggataattataattaatatgtatttacagactcgattaaaatttaaaattgttactgcgcttgttctgtgggaggagcattatggacttcaggttctggctgttgctgctgttgttgtatttgctgctgttgttgtatttgctgctgttgctgtatttgttgctgttgttggagcagttgctgttgagccagatgttcctgtcttagtttttgcttagcttcttcctcctccttatcttttattatctgttcatctgatctaatcaacatacgatgctggatcaaatttggatcatattttggatgtgcaagttcgcaattcttccctaaaggacaaaaaccggtcatataattttgacaggctacttttctgatgtgtcttctcgagcatttaggaccatcgggacagaatccctgttcatagtttggacagtttgaaacttttgtctggggatcaatatggaggtacaaacattcaggtgtttgcgtacagaatccattcttactaaagaagacacattcgggtagtttacgaaagttatactcatgcaagaactcgcagtcatctcccttcttacaaagaccacgtaaccaatgcttacaaacgattttgttggaaaacatcttggagacatgcttgttttcacagttggtgccattggggcattccccagacgtgatccagaaattacaaactggtctgtccgggttcaaacctaatccgtattcctttctcagaaacggctcaaatttaaaatgtgagtcttttcctgtggaaggtaatggagcattgggcaaggaaaacccgagcaatggtagttggggttgaaacatgggggcgttgtatagaaattgctagtaaaaatgaggttaactaaaagatatctgataaatcgaaatattaatcagtacactacaacgacggacacggctgaattgtaaggtgtgctcactaaatgttggtaaacgtacaatatatacattaattaagatcaagagggagcagaggtcttcatacgtgccttacgcgttgttccgacaggcccccgaatactacttcgtcttctggcaccttccctggcccaaaactcgtttcgatacaactcccaactttctctaacagcaggagagaatgaacgagaattgagtaccagtttgatttctgtagcccctatcctttcttgcgacctcagatacagctcttggcaccactgagattcggatgtgcctttgtaaacgaacttgatagtgttgtatagtaagcgaagaacaaatctggaaatatcagataagacgtcaccccaaggtgctttcaccctcacggctctgagattcaattgtcttaaacctttgttggttgtgatgagaaacttttttggcaatacaatcgttctatggtactctccactcaagtagaaaagaaccaaggtgatagtggtaatgattgatagaaactggtacgtgatcagccaaaaacccgtaggtagttggtctgtattgctaaagtacagttggtaaatacaaaatgcaatgagtccacataaaagtgaacaaaacagcgtgtatttgcgacgaagaaacttctgttgctgtaactgttggcgaatagtttcttccatgatcagaaggtctttgaaaactttagccatagttgtcaattcatctctatgcctagagtttcttctaggccgcaatttgctggaacctcgccttgtggcacttgtacttcgactccgagctctagaaacaggctgattcaaacttctggaagatagactagctggcttatcaatatccaagtcagaagctacggcctcttcgtcttgatctctggagtttgtgaggtacaaagatgtggggggtgatagagtcatggatcccggacttgaataggtgaattcttcatctgacgaattcagcatgctaatggtcttgcacaatagtgcttttccaggaaggaatgggaaaatgggtactaataggattctggtggtgaccttgaggtgaccttgcaagaatcagaatggataacttagagcgagggagcgaaaaaccagagttggaaggaacaggagacagggagagaaggcttttggtaggaaatatagagcttgatttctgggtagctttaacgaattgatggcttatatgttgtactgaatgtttgattttcaatgctggtcctctaggtcctcaaaaggctttcgtttctgaaataatgtgctgtgatgtcccaaaatgaatcatacaaaagctgctgtgcctacggtaaaacaatcacttcaactgaaatccgatcgtctcgaacagattgagcattgctacgatcttttcctcaatgaacgtcttcagattgattcataggtggttaagcatttcccaagcgcattgcccgcttttaggctggaaatctccaacattttctggatggctgttcgcagagacaaagctcaaacgcaacgctaaatatagacatcatggaaacccatcacaaggtactaagggaaacttaaccagcctttcaagtgcaatgaacatgcaacccaatagtccttggatatacatcgcgaatcttctggcgaatctagtttcctgtctactccagttccctgggataacctccaactcatgctagaatatatggaatatttggaacaatgctttgcaaagaatagtcaatgggattacaataacttatatgaacacgttttagactcttctgctagcatattgcaattcaagatcccccatgggttcaagtttagcgtttcttccagcagttcgccttacaactacaactcgatcagcttcgaaaacagagggaaaggcaggttgaacggatccttggcctacttttacacgacacaggaactttcaaattacaaaacatcaaagaacattccgctgcaggatgtcatagattcttatcgattagtcaatattccgaagaacgatcgatcctatacagacaatgaagaatccaagagaccatggctcttatacggcagaatgtaccttccaagccaatcaatggaggcaatggcaatcaaaagactgacagctaatacacaactcatgttgaagggtgtcaatattctaaaccccaccccaacaccttttaacaataagttaacctctctaagcttctatttgcagtcaaactattataaatggtccagggaagctatatttctttccagcgatgctctgtttggtttgagattcctctataattttggaaactccaccaatcctcagtgtacaccttccatcgactctaataatatctcaactttatcgttgggaacagagctatggtacggagccatgaacatgacgcccgggctttcgacgacattaagatatacatcattctctgtgacagggaatccattaactttcacactagcatgtaaccctattttggggtctgtctctactacctattctatcaagacgaacgtatttacaactctatgttccaaatttgattttaatttttactcttacgagagtgatctcacgatcggatgtgatttatggcgatttggtaataatgaagatgtgccagattcgaatccgacacctttgccttctaaggaacgggaacttttcattccattgcatgatcatcaattagtgtttccagagcaagagaaagccaaaaccatctccaatgagcccaaagattacgaaagcgatctcttattgaaattcctggagattcaaggcataaaaaccgctcgtcaaagtgtagccacaatcaataactttacccaaaaaatcaaaaatgcaccatttacaagtgccctgaaattaaataccagtcttaagaatcatacagtaaatttgatgtgggaaggtaaatataacgatttcctcttgagtacgggctgctcacttaatttagatctcaaaagaccaaatgtggatggattcggtcttcaaatccaatattcttcttaggtcaacacaatcaagagtattaacaagataagtaatccaaaaattgacattagtcttccattttcactgctcatctgactaaatttggtaattcttcctcgtgctcgataaagtgtattttcgttgtgatcgatttgggcctccaagtcatctaacatgaccacttgttcatcgacctctcctccaattgttagtcctatttctcgttgttttcctactgaacgcgacaatttgtctagtacgtggtcctgtctcaatagttcttgctgattatcaataaagatactttgattgttcaaggaattgatagccgagtcccttgtttccggtgcatcgtcatgataaggcgccactgtagtttcttgcacccctggctcaatcaagttgtccttgaatctaaccgacttactcttcttcaattgtctttgggagttatcgttgacttgtccgttctgtgaatcctctgaccatatgttgtcaactttgaatgagcttgtgtctatcgataaatcctcagcaagtgtgtttaatagctgtgtgtagcttttgtagagagcttgaactcgagacttatttttgccggatacgtcaacagagataccattgaacatattatatgtttttcgcagcactggctccactttcatggagaaggaagtggaatcgtagtcatcattcagacccttgatgatagtttcctcatttagtaatgtttctagttcttctattagcagttgaagtctcttgggtgaaatcattaacgcaatacagaaaggaagaaagaaagagaggaggaaagtgtcaaagaagggaaagggtttaattgcatatgttccgctcgatataatgttattttataattacttaattatattatttttatctattattatatttgggactgttccacatatcttgaagcaactccttttcccagagtatttccactttgatgataccatctccccgaaaatatacagtgagtactcatattgcggtggtaagtcagatttgttagcagtttgggtgtaattagaaaatattgagtggggttagttccatcttctttatcgtaacaggatgtctcaatgatcagcttatgcacataagcctctgccgtttcatccagtccttggtttatttcatcaactattctaaatggcgattgcgtaaaactttgtaaagtagataggaacattgcagtggtgaatgatttctcacctcccgagtgtcgagtactactaaagacactagacacctggctgtgtgtaaatttaacaactagatggatcttccattcactgaaagtcttgcctttaattaaatgaatttctccttctctgccattgaaatgaaaaaccttcgtaaacttggtagatagttggttaactatggtttccagttttggtacccaaacatcttcaatactagtcaacttagcttttagcgattccaaagtgctattccaattgggcaataattcctccaattgagcaattttatcttcattaagtcgcagtttttgagttgatgcctcgctgaaagacccaacattgggcaaccgagcatctaacatcgaaatctgatggtttaaacgtgtcatggtcaattgccctttctttttcaaattctctgttaacttaccaagcttttctttcaaagaaggttctagttctacgacaagtttttggagttccttttgcttagccttcactactgacctacgtttggagtactcatccaaagccttttctgttgcatttttcctgctttgtacctgcgccaatatctcatcattgagtttctctagggccaacttcctgtttttctcctctattcgcttcaactctttgacaaccaggcgagtttttaaatcatgtagtgcttcaatgcagtgtttgatttgtcgtaagtgttcaactttcttccacgttgtatcagatatcttttgattcaactcattgaaccttttaaatctatcatgagagaggtgcgattgaagtttctttacttggtcagtctgccattgaacgctctgtgaaatctgctcatgcctcgtcttgagtttcttgaattgagctattgatttcaagactgctgcttttgaagctgtcagttgctccaattcttctttcaatctaggtctatttcgttccagttcgtcatattcttcctgaagttgcttcagtcgaccttgttctctttccagcttctgttgttggcgagatattctgtccatatctacaggagcggtaaaccacctgggtttatcgttgatgaaactcaccttggagaatacttgttttgatccgtaagaagaaacacgcagttcgtgaaattgtctaccttccataatgtttcggaaccgaatattaccctgggcatcctttaaggaaagtttctccagaattttgggttccaaatttgttaatgagactggcaccacgtccagaaacgcattactaattaacatatcaacaacagcctgttcccctgtgatgaaatcactcaagtacccactaaaaccaaattctttcaattgttcatgagttagacgattacgaattcttggatccgaaggtaccactctcaaaggcacgttgaccttgactctgtttcttaagatatcttgacaatatttcaaagtcttggtgtccacacacgtaaatgcaagaagagtatttctgggcacacatttctcaagatgagttgcaaaacgatcatcaacattgactgaaaggatagcaggctcaaaaattttcccatccagacttaaattggtcttgttttccctaaaaaaaagaactgctcgtttgagatcaacttcattcgattggtctaataagaatattttatctgaacgaattttagatagagtttgttcatcagatttaacttgatcttcttggtccttcagttctctttgttttgtcctttcaatatcttgtagctttactacgacctgactttcacgagccgatattctctttctttcgtcatgtaattctcttagctttgtgtctaaatcagcaggattggatactactgtgctgatttccttcattaaggattgcatctcatccatggattccttcaaagccacctttatatcttgcaattgttgtctgtttccctcaattttacgtagcatggaaggcttctctccctcccatttgtcaatttggtcatcataactctcgagcttcttttcaaggctgaacactttttgctgctgttcatcaatcaggccttttaactctctaacttctctttcgcattcaatatacaagtcgtctttgttctgaaactgttcagttatttcctttatatgatcagtgaactcttgaaatgccttcttcttttcgtgatactctgttcgatactctttagcttcaagggctaaatcctccaactcaacgaagggtttcaaattacgatgtaacatgatactatccttgattttttggtattcttggtacctactgacttgatccttgagtcgtaagttttgagttttcaattcctcgatggttgtaattgcttctttgatttgttgagagacatttatttgctccttctcaagctcaataagctgcttatgatcttctaaaagctcaccgtttccatatgatcgaagcacgttgtataatacctgctcaggcttcaattctgaaaatctgctaactctctcttgtggcaagaactggcaaagattatctaactggatgttcagctctttgcacctttccttgaccattttctccgtcgtctctttaccatttaaagtccaggttgatctgttagtaaggttaaacgatcgcctaaccgttagggtttcatttgtttctgcacctttaaactctatttcaataaacgaattatcgcagccgttacgtatgaaatctttcaactgaagctgttctttggcaatccattcaagtttaccacccaatcccagacaaacggcattcacaaatgaacttttcccactaccgtttggacccacgataaagtttaaccgtgggtttagttggaactcactgagtcctgtgttctggaagtttttcactctcaacctaatgatagctccaacttgataagcatccaattcaaatccattaatcctgcgtcgcttagagggttgcgtgacatgagattcaaaatctatgtcacttaatgaacccatggagctactagttggtttacgcgtacaggcttcttagaatgtaaacactttagaaggggatcattccctttcgcgagatgagatgccttctagagatgatcttgaagaacaccattaaattgtagcccttgcctgatagaagagtcaggctgattttggtactaattacattcttatccctctatttgagtattcacgctactcagagctgtaaggcacccaaccatctgacaattgactctgaaagtattcattttagtaagacgtcccctactcaagttttcagtatcgaacttgcccaaaacgcggaatctgtcagtcctatcctatgccaatggctgaagaagaaaccaaacccagggttactgctaagagtatcacagcagatggaaaggaagtgctcaatagcacggtgataatacagcctgctacaactgttgaccagaaaaagttgaaaggggccaatgctatatatgaaggtaaaaagaaacctttcaaagtggttcaatccttaccaatgtccatagatgatactgatgtcgattacttaagaactccgttgtcaatcaaagactctgcggtgttatacaattctttggtttactctagatttaactggacgcacaacatattcaaaatcttttggagacggaaagatcacatcgtcggtggaacagatcgcaagagagataaaatgagcaagttatgcgattgtcaatttaccgcagggcctcatcaatttcaaatcagaatgtttgtactaaaggacgaggaaattgagcgtaggtttgaacaagaacagaaagaaaaaagggaatccaaacagaaagccaaagaagagaaagagaggctgaaagaagaaaggaggaaattgagagaactgcaagagaaggagcgagttttaggcgtgactccgacctcagctggagtagcaggaccagcagtgggaacctcagccactacggtgccatcgaattctgctgccccgaaagtggccccggttccttcagcaccaacagtagttacacctagtgttgttcaagcaaaaccagaaaccgttctcaatagcaagccagatgagtctacagcatctgcaacacacagcacacagcacacaccaccccaggtctcagtatcgacgcctgttgaaccaactgaacccgcaacaacagctccagcagcttccactgcgccaactacagcagttagaactacatccagtaaacaagccccagaatcatcagcctctggtgtttcgacgcctgctaagtcagccactactcccattcccgcggtctcatcctcggtgacatcagatccacagacaaccaacgaaaccaagaaaccaattgtgccaaaacctaagcaaacccaagcagattatatggcaagcccagagaaccagctaatgattactaatttgaacgcaattgcaaaagtcgacacttctttgaactctttaatgaaaatagttgcatcagggaatgcgtcaactgctcaaatcgccgagtttcataagtatatacaacgagccagggagatgggggatactaatggaacactgcaaagactgcaacaagaacaacagagaaaacagaaagaagaactgatgcaaaggcagcaacgaaaattagaggagcaaagacagcgcttactggaaaaggaagagaaaaaacgacaacgtcagttgttgaaggaatcaaagcccgaaagaaaagagtccgaaaccctgactgcttttcaaatgcgatattcaaaagacgcaaacttggtgtttgagttcacagagaatacctcatcaaggttttttttcccaaagaatgccataatagaggttattgatgattttgaagaaactcctatgcagcaggcaactgtaaaatcagagattttggaagaaaaccaacaaactgacaagcttcccccaatgaaggcagaatttaaagatgtcacaccgttaggcgatgataacggaacaccgacctctgcctacactccaaatcagactcccaaaacaccaacagttgatccaattccagcgaaggcaacaactaaaaagcctatcaaacgtaaatcacactatgacctgttattgtccttcattgttgtccataaccaagtacagattgatgagtgggaggcaaatgaaaaagccaaagaagaagcaagaattaagttggagaaggaagagagtcagagagaattggaagaagaagaaaacgaaaagaaaagagcatctcaagactcaggccacaggctacgaaagagacccaaaagaaaaaaatcgaactggtcaggaaccagaaaaactagaaacgcctcattgaatatagagcccgaagttgaagaaaagaaggatgaaactgttaagccggtccctattttttcatgtgttaccattggaataaataaagtgtctgccaagtttgttccaatacttaaaaactctgtcaattctagagagaagactctagaatacatggaaggaattaagaaggctggaacccaactggataagtatcatttatggtacgaattagatgccttcaaagatgagttgttgtcagaacagcttagattcaacctcaaccgtcttgatttcattcaagggggaagtaaattgaaaggtaaggcaatgttgaggagaatagttgaaactggtggtgccactgaactggaaatcaaaagcattcgtcaaaactcggaagatgatgatagtggagataattagacaagtttcaaacattcttcttcactcgtgattggtgattctatggtatgagtaattatcgaactgatccctagattttctgctaactggcccactatatcagctgctagatgatctattgagggtactacttcactcatattcaactttttaagttgctcactgattgacgtctgtcgagttcctggtaaaccacacataactaattgttcatcattgacatatgaaagatcagtggtgttatttatagataatccgtgggaagttatagaccgtctaatattcacacctatggatgatatcttttgaccattacaccaaacacctgtgttctctgtagtttcacccttaagatgataatttcctaatcccgaaattactgatttttctagcatggaaacataacatttggaggttagtttttggaagtctaaaagatttataattggataaacgactaactgaccggggccatggtacgtgatctggcctcctcttgaagtttggcaaaactgtatgccctcagtttgactgagatccctgtacttggagggcctatgtgcaaatttttctctttttccaccggtatacgtgggctcaaactgaaaggacaatgcaactggatctatattgtttagctgtgataaatcgatcgtgtccgtctgactggtctttaatgaattattcttctttttctgttctagttgacgactcacaaagaattcctgtatcaaattcccctccaaatatggtcttgttcccctgaatacataatgatgcagtttcaaggggagtttgggaggaaatttggaacaactcatgagaactactctggtgattaaatgagggagcctgggaaagacaaaactagatatcttgataatcttacgtaatatttatctacattagagatttaggccattatcctaaaactgtgtaaaagacaaatcaacttcaattcttgtaggaaactaatcctaggtactagaactagtcaccaggtttatttagaaagttcagacggtatagtagagctctcactctctctcgttgcaccacccactgtatcttgaaaagtttcctggaaagacgcgcttgaatcttattgacgtgtatgtatcacatcgctagatgaagatcctatgcgttgcagagaaaccttccatagcaaagagtgtagcttatactctcggtggaggtaaagtcactgtgcggaatagcagtgtcaaatatgttaagaattacgactttacatttgaatttcctggagtgggaagatgttcggttacgatgacttcagtgctgggtcatttgacggaaatgacaatagataacaacagatatggatggggtaaatgtttaccaataaatctatttgacagcacaatcatagttaaagaaaatggcaacgattcaaagaaattggtgcaaaatatagccaacgaagcacgattaagtaatcaattgatgatatggacagattgtgatagagaaggtgaacacattggatgggaaatcctcaacgccgcttcgaaaacaaattcttctttgacattggaaaatgtctggagagcccagttttcccaccttgagagaagccatatcatctctgcagccaaaaaccccaagcaattggatcgatatgctatcgacgctgtgtgcactagaatggaattggatctacgggctggtttcagttttaccagatttctcacagatctttttaagactaattttcaagagatcaaggaggagcgtcgtcttatctcttacggtggctgtcagtttcccactcttggatttgtcgttgatcgatatatgagagtgaaggaatttgttccggaggagttttggtatatttcaattgaagtgaaaaagggtaacagaaagcttcctatgtcatggtcacgtccccacttgtttgacagattagctgccatgctcttgtatgaaaactctttggacatagccaaagatgaagctgaaattgtgcatattatcagcaagcctacatctaatttcaaacctctgcctttaactacagttcagttacaaaaagactgttccaagtttttcaaattgtctgctaaagagactcttgatgccgctgaaaagctatacaaccaaggattcataagttatccaaggactgagaccgatagatttgatcctaaaactgatttaaaaaacttgttaagcaaacaagcggaatctcctcaatggggtggctatgttcaagaattgttagacgggaagatgcgttcccccagagctggcaaacatgatgataaagcacatcccccaattcatcctatttgttatactgatttcactaagctcaagtccagaaatgaacagctcgtataccaatatgtgacaaaaagattcatagcatgctgttctgatgatgccaagggtgttaaaagtatagtcaccgccaaatggggactggaaacgtttacggcttccgggctaatggttctggagaaaaattatttggatatctacgattactttaaatggaccagtaccaaagagttaccagaattcactcttggtgaaaaagtcaaactactaaaagcagatttggttacaggaaaaacatcaccaccttcgtatatgtcagaatctgaacttattgcattaatggacataaacgggatagggacagacgcaacaattgcagaacacattgaaaaaattttggccagggaatacgcttctaagcaaagtttgggcgagtcaagatctaagaaggcttatattcttcctacagaattaggctgcgctttagttgaaggattcaaccaaataggatttgacaatctctctttatctaaaccatttctcaggaagcagctggaagagtctttggcgaagatcacagcaaaacaagaaactaagaacaatgtcttggacagatttattgaactttatcgtcaggcgttcatgctaagtaaccagaagcaggcaattttggttaaaagttacagacacattcagaggagaaatgcttgaaaagttgtcttacttaattacatagttacctgtgggccagattaatggcatcgtttatcctgctattgaaattttccgatccaagaagttctgctagtacgggaagcttcacaccagaaactcccccgctaatggcaaatctaaccgcttcaaaaacttgtttcttagggtattttgaagccgtgagatttatggcatctgtgacgtcgtgacatttcagtgcctctctgaaagcaattagtatactcaaagtgttttcatggggaaattcagctagcactggtttcgaaaagagatatacctgttcctcagaaagttcgttcaaagttgtcaatgagcccacagtctggagaactttttccacatatgatctcgtagtagaaattccctttgtttccagaagcctgatgacttcgtctaccgattcgttgaaaaacttcttgtctttcaaaaattcattcaagtaatgtttgttcaagaagtctaacttcttgaaatcaactttggcatttcctttcgtcaaatcatccaaggaaaatacttcttctaacttggaaaggctcataacttctgactgcttttgaccagcaactgacctctttggagcccaaccaaaaagcacagcaaaattaatcaaagcctcaggaaggtaccctttagccttcaaggacattatatcaatatctccggatctcttgctcagctttttgtcctcaatggaagttaataatggaatatgtacaaatttaggcggcttccaattaaagctgttataaagagcgatgtgtttaggtgttgaaggtaaccactcttcacctctgatgacatgagtgatgttcatgtagtgatcgtctattacattggcgaaatgataagtgggaagaccatcagattttaccaaaattggatcgtcgtatctcacatcctcttgatttatttgaggctgtaaattgatagatccatgtagaaggtcttcaaatggcggatatttatctggggatctgaatctaattgtgtatggtttagtcatggataatttatcgctttcagcctttgagtatttcaaacaatgcctatcataagtgacgttggtaggcggtttcagtagtttggcagattctctaagcccttctagtctttctctgttacaaaagcatctataagcagaacctgtctcgatcatttgatgtacgtgattagaataatccctttcactctgtttatatggggaaaaggggcctccttcaacgggaccttcatcaacagttacattcagccattttagtgtttcgtatatgttctcttcagctcctttaactagtctattttgatcagtgtcttcaagtctcaggatgaaatcacctttagtggccctcgccagcaggaagttatacagtgcagttcttaatgaacccaaatgaaggaatcctgttggggatggagcaaatcttgttctcacaggggatgtaggttgtctactcacttccttaagacccagtttaatgggtttctttaggtttatggagtgccaccgtttgatgatcatgatgacaataaagctgatctcagcgaaaattatcagcttgtcggggatagatcgtcgaagagatgatggatgccacgagtgataagagaggacaacctgagaggcagaagatgacactacagaatacgattagtacaactaggcaatgatacccagagaaataagataggaaaggagatggggtaatttgagtcggaaaaagtatcatacgttcgaaatttgccaaggttcaaaaggcacctcagaatacaactggcaccaactatttgataaagacttatggacagtaatgaaaaacaagttataaaagttgaatattaccatttttcaaacactgccaatcagagtagccccacttgcaagtatttgagaagtcatctaagcgaaatttttcattcctctcctgctatactcaaacctcaaaatgtaccgccaatccgcaagtgccaaactcagagctggcagggcttttgatttagaagatgatttggagttttgtcctttgtttattccaagcgttcgcaaacaacaagaccctatggcgatgttaagaatgatgacgtcgggcaatgttaataggagtagtcccaccttcaagttgtcctaccgcaaaccatgatagactgaaaacaaaattatcagcttgtaagagttagtgtgccagtgggtggccctttggtatcttctctactctgctacaaatgactctaacggccttcttaaaagtggccaagataccctgtctgcattcctgtaaaatattaaagcaaagcatattcttaatcataatttattcgttaattttcattgtccaaaaacttggggttattctccaatttagatttgaatttattccaccagtcattgaaccgggaaatcggaaccttctgttgggcatctataaacccactgaggtagttgtaggcgttggttattatcttgtttgataactccatgactttaacaggctccaacgcatctgaacttgtggacggcgctggtagctgtttcctgttctgtaatagcagatccgcttgagcgttaggctcaagggatattcctatgttaatattctgtacttcacaactgggcgcagccacatcatctagcatgacgtcttcattgatggcgcccatgttgtttgcaggattgtagttattattgttaatcttgtagatagcactttgcttttcagcattcaagcttccgaaaagattgaattcaccttcattgacctgaaagtagaccagtgccttatagtttgggtcaaatggaatattcggaagaaggaacaaagtaatgtatgagacgttgataggcacgctggggtagttgattacgtatttgaattgatcaacctgttgagcaacgactaccgggcttcctgaatagcatgaaccaaacatcagttgaatatgagcttgtgtgatggaatcggccagaaatagtggatgcttcctttgagttactttaaagtatgatgtgatgcgtctaagatgttgctgttagcgattgtgagattcttgaacgttctagaaaacttcgaatcctcttaagaaaggagttagcgaggagaaaaaactttcttctgcaactcttatttcatctctgtgaagtaagaatctttggttattaaagaagacaaacatatcacatatcatggcatgattgttgatacattgaccacagattaatacgggcaacacattttccttttttcgtgtttgagatgaattgggaaaagtatgtcacgatacatcacttacaactatccaacttgtagcgcaaccgccctggataaacttgacaggacggcttccgttgtaaatctcgtttaatgagtacgtaacttgttcgtctgttggtctgtctttattttctattggtttctgaccacaattgccatgttcaccccaaccccaagcagagacagaatgattggcgtagagtatcaatccatgctcactaccgagagatatttgttcgatattctcaaccgaaagtccgtcataaaagatttgaccatgtgagttgtttcccatagaatgcaacttgtttttttcaatgaaatgcagtgagctccacatggtagagaggaaactaatttcctttggatctagtttacactgaatatctgtttttcctttaacacttagggaaccttcctttaccacaacagagaaggatcttgccaaagagacttgtttgacctgttcatcaatcaattgaggctcccatattattctatctgaatctagatttaagagcccttttctattattcccccatccatacaactggccaccttttaacttgatcataaccgaatgaatggacgtctctatctggtcaatatcccaaataccagggattttggtgagcttcgtctggtacattttctttcctagccccaactccccactaaaaccttccccacagacccataattctctgttttcattcaaaagtaagctaaactgccatccggccgctacatcagtccagtctgaacccccaacctttggaactgctgttaaattggggacgactgggacgtcatcaatcccgcattgtcccttggagttgtctccacaaccatatatatatccatcggttgacaagaccaaggtgtggttgccgccacaagcaatcttggagggttcccaatttagtttctcctccaccaagtggtctttatcctcgtcatcaccaagtcctaactggtatttgccgttagaaccacacctcaataggtagtagttcatcgaaagagatgcgaagagagatcaggataacgaaacgcgacttttatttcgtagcatttttttctctaagatttttgggttctcttttctctatctaggcttacttccgctccaaatacacctctttggtttgttttatatgaagccatctgtgatacaagtcgaagcgacgccggaaaaacccaagccatcatttatccaagttcctgaatcatctccaatgactaaggaagaatctacaacaggaagattagactcgttaagaaagtttcagtttcaaccaggagatgaatctcctattccgaaacaccaggcaaaagtctcctatgagacaaagaagaacattcatctgcttcgcaagaagtatccacatttcacagcaaaagagatcttcagagcttatatctcatgtaattcatcgttgaagctcactaatgataaactcgcaaccatgccagtcagaagtccatcatcgcaatcaccctccaccggagcgttgattcctacagatatacccaagcgagaccctcctcgtatcaacttacaatccagtaaggtgaacgttggtaagaaggaatctatttcttcgcgttatctgactcgccgtcaggaaccactaaacgcaccacaggcaagttcggttgatccaacgatcaagaaaagaaaattagttagagtgtctagcttggaaggtacaacccctcaatttcaactgcaacaacccgtgttgtcacttgaagaagaagaggaagaggaggaggaagacgcgatacaaatagacgactctgacgaagaagttgatggagctcagtttgaatcagcctctaccgattttgaggaaaagacactaaactttttgaatacagctgataagcgggacatagtggatgttgccaatatacatccaagtgtagccgacttgcttattgctaaaaggccattcgagtctttgagtttgattgaagaagatgacttttcagataagcccgtaaaaggtagaaagaaaccaactggcgaaaaaattgtcgaaaaggcctctgaaaagctccgtggctatgaagctgtagaaaatctcattaagcaatgttcctattatggtaacaggatttctaatgaggtcaaaaagtggggtgtcggtgttcatggcgagaggggagaattggaggtagttgaggtggatgttgataccgagcccgaagatagtgagaacgaagatggtctgggccaaaaatttagtacattgccagaccgatctaaaaccgctcctcttcctcaaaatacaaaaagagtcagaagaaaacacaaagcagtggattacgaagaagattttgaggatgattttgaagaggaagaagaggaagacgacgacgaagactacttatctaagaattctccaaagaagagtattactcatattaataacaagataggatatttcaaaagaaagcccaagttattgagtgataaaatcagcctgaaaaattatcagcaggttggagtgaactggctgaatctactttaccaaaataacttgtcgtgtatcttagctgacgagatggggctcggtaagacttgtcaagtgattgcatttttggcccatttaaagcagaagaaatatcctggccctcatatggttgtcgttccatcttctactttggaaaactggcttcgagagtttcgtaaattttgtcctgaattaattgttcagccatactatgggtcgcaggaagaaagaggggagttaagatatcaactagctgatagtgattcatacgatgttttggttacaacttacaacttggctactggaaacaagtttgatcagcaattcttgagaagtagagagttcaacgttatcgtgtatgatgaaggtcacatgttaaagaacagtcaatcggagaggtatgccaaacttatgagactgggtgctcatttcaggcttttattgacaggcactccattacagaacaatttaaaagaattaatttctttgttagcatttattctgccaaaactattcaaggaaaagaaagatgacttgaaagtattgtttgatcagaaggccaagactaccagtatagaagatcctgatttcaatccattgttgtcacagcaagcaatatcaaaagctagaacgatgatggcaccttttgttcttcgaagaaaaaagttccaggtgctttcacatttgcccgagaagcatcatttcattgagacttgtgaatttcttgatgagcagaaggtcctatacgaagaggagcttgagaaggtaaaaagattgagagaagaaagagaaaaaaggaagctaattaaggatgaggaaactttgaagaaacttcctccgttgccgtctcaatccaatcttataatgcagctgaggaaagcagctttacacccattactgtttagaggaaatttcactgacaaagttattaaggagatgtccgttaaaatcatgaaagaacctgtctacgctgatgccaacctggaatacatttacgaagatatggccataatgaacgactatgagctaaatgaactgtgcttaaagtatcctcgtacattatcaaagtacaagttagaagaaaaatcttttatgcagagcggaaaagttcaaaagcttaaggaattactagacaagattatttttgagagagaggaaaaggtattaatcttttccttattcactcaggtattggacattattgaggtggttctctccgttcttaaaatcaagtttttgagacttgacggccaaacttctgttgatatcagacaagatatcatcgacaaattctatgaagatgaaacaattcccgtttttcttttatctaccaaagctggtggattcggaattaacttggtatgtgccaataatgtaattatcttcgatcaatcgtttaacccacacgatgacaagcaagctgaagatagagcacacagggtgggtcagaccaaagaagttaacgtttatcgaatggttaccaagaatacaatagatgagagcattctgcagttggccttgaacaaactacaattggatagtaccgtcagtgatgacaacgataaaagcaccagggcatttgaggaacagacagccaaggtcattgaacaaatgctttttgaaagggaaagtagcacagacgttccagaagagaagaatgcgtaaagctgaagagtgcttctggtgtacaaatctcctagactgaatttccttgaataattttatagttttagacacttagattggcattaccacgatagagggtacgggcgccattacataatcaatactagatcatctctcgaaataccttagaaaccttcaagcatgaaagtgacattatctgtgttagctattgcctcccaattggttagaatcgtttgttcggaaggagaaaatatctgcataggtgaccagtgctatccgaagaattttgaacctgacaaggagtggaaacctgttcaggaaggccagattatccctccaggatcacacgtaagaatggactttaatacacaccagagagaggcaaaactggtggaagagaatgaggatatagacccctcatcattgggagtggctgtagtggattccaccggttcgtttgctgatgatcaatctttggaaaagattgagggactttccatggaacaactagatgagaagttagaagaactgattgagctttcccatgactacgagtacggatcagacataatcttgagtgatcagtatatttttggagtagccgggctagttcctactaagacaaagtttacttctgagttgaaggaaaaggccttgagaattgtcggatcatgcttgagaaacaatgccgatgcggtagagaaactactgggaactgttccaaatactataaccatacaattcatgtcaaacctagtgggtaaagtaaattccactggagagaatgttgactctgttgaacagaaacgaatcctttcaattattggagctgttattcctttcaaaattggaaaggtattgtttgaagcttgttcgggaacgcagaagctattactatccttggataaactggaaagttcagttcaactgagaggataccaaatgttggacgacttcattcatcaccctgaagaggaacttctctcttcattgacagcaaaggaacgattagtaaagcatattgagttgattcaatcattttttgcatcaggaaagcattctcttgatatagcaataaatcgtgagttattcactaggctgattgccttacgaaccaatttagaatctgccaatccaaatctatgtaaaccatcaactgactttttgaactggctgatcgacgaaattgaagctacgaaagataccgatccacacttttcaaaagagcttaaacatttacgttttgaactttttgggaacccattggcatctaggaaaggtttctccgatgagttatagataattggggatccctatctcattacaacattctccatgttgtaggatttttttcaaggatgcatgcgaaagttaacgtaaattaccaaccggacccagatattcgacatcgctttcgtctatgaaaaattttcgggagactagttcttgcttcctatatatcccctaatctttaatatagaatgaagtacgttttatccgagcaagttcttactgtcccagaagatgtctccgtgtctatcaaggccagagtcatcaaagttactggaccaaggggtgagctgaccaaagacttgaagcacatcaacgttgcctttgagaaatctggcgacaacgagatcaagatcattgtgcatcacggtaacagaaagcacgttgctgctctgagaactgtcaagtcattaatctctaacatgatcactggtgtcaccaagggttacaagtacaagatgagattggtttatgcgcatttcccaattaatgtcaacttcctcgagagagatggtcaccagtacgttgagatcagaaacttcttgggtgagaagagagtcagagaggtcaaggtttacgatggtgtcactgcatccaactcttctgctttgaaggatgagctgatctttgagggtaactccattgagaacgtctctcaaacttgtgctgatgtccaacagatttgccgtgttagaaacaaggatatccgtaaatttttagacggtatctacgtttctgagaagggaactatcgttcaagaagaataaattctggtatatctcaaaagatttatgtacattagttaggctttccacactgtgtgtttcctacccccattcccaaccccgtgaatcgttacggcccttaaagagaaggccccttacgattacacacccgtaaaataaccccttattatatctggaattttgttgtgatagttactgattctttggaggattaacctccagtggcctgggtttagttgtccgaatgaattattaacttcatataaaatagtgatcttggattcttctttcttttcgtcctatgtggtatggtgtatatgcttggttcattagtatttgtttataaatatttgtgctggttaaaaggagctccaattccaatcggcagggacgctgccaacgacagtctcagatccactggcgtaccttgatggtcttctctccaaatcattcatatgccaagtattaggtgtatccatggtgtcattgttctgacgtcgcaaggaactgatgttctcacgtaagaacacctcatatttcatgaagcagtcatagcaaacttttgaaaggaacttttcttgttccacggttgattgatcgtctgctagtttatcgtctgtgtcagttcctataagtacaaactcagcgtcacaatcaagatagatgaagttagacaaacagtcactgcagaaaatttcgccacaataacgacaatggtgtttccgtctactgttagtcaaaaagtggaaaaacctgccacacctgaagcaattaaatctggagttgtcaggcttccagtgtctcttggtgggagcattatgatcagaggcttcgacagatgtagccagcgaagcacaactagtagaaggagtcctgctcattagcttggtagggagagaagtccaggacttcttagatggttgctccgttgcggagttatggaactgtgggtgtaaaccgattctattggtctgtcttaatttgtgtttcaaattgatatccctgtagcgggaaagctctggggaattctggtacggcaggttatcgtgaagagatgcaaactcagtggttgttctgagaactgctggggtatacattggttttctttgggtattaatttgtttcaggggccgtatggagggagtttggctcggaggggatggatttacaaaagattcagtctccgacgaatcgggctgttcctcttctctcgttgacaaagaaccggcagagacttcgtactgaaattgtctcacagagtttcctcgggggtctgctacttcaagagctggcgtttccaatgttgtgtccatcatccggtccagtgactggacggagtcctgtttcttctgtatccttttctcccgtatgtatttgacgctgttgctgacgggcaagctatcgcttgttgtaagactgtgatgaggggaagaagagttcttgtaactgctgtggaagtattgaagcccttcatctgctgccctttggaacttactgtccatgggccgcagtcccaaatcctctgacccgttcgtttcgacgctgttgctgttgttggtgtataaactcattgaacccaatttcttgagtgcttccgtggtcaagttcctcgagttctgtgcctcttcttcgtcaacctgcgaaacggagctcgtaggttgcgtcataattgaagtcgttgaactaccaattaattgtgtggtggttatgttaataattggattagtgcccttgtttttttttatttaaagctttaatgggactttagacttttttttttccctcctcagttttattcctatgggaaagggggcgggtggggggtgactctccgcgcgattcaatgccattcttacccccagaagggtgagcgcaggctgaggaaattctggttggtttttcgccatttcatgttcagcgagaatggttgggttgtgggaaagaccgaaattgtgacatctgtaaacggaaccagcgctaaggggaaccctcgaagggacgatcactttctgcaagttggagtctcatttccttcaaactccgtcaattctatttagaatcagctgtttcggatgtttgctcagcggttcagaggggctagacctctattgaactcactaaggcaccagagtcaagttcggggccaagatcatcccaaaccacctccacttccctcgcaacctactcctgctccctctaagaaggaatcagaacctgaagagaaatacaatcctcatgttagtacctttttcactattcgattacccgctgcttactaacaacaattagaccgtcttttacagaaaatacagtgtggcctatttcaaggtcttgggtatcacaatggctacttactactccttacaatatctctgggagttcctagagtcacaggaaacggaaacgtcacacaaaactactcaagcgtaacctttttacgaaacttccttcaagaaaccagttctcatggtactctttatgattatagagatgtagtaattatataggatggtccattctaaatgttcagcttagactgaagtttcgaagcaacggcatccagaaattcagtggtggtaacgtaagcagatctatcagtcttaccggcagctaaggccaaatccttggtcatgattccgtcttgctgcacagtgtcaatgacaactttctcaagtaggttggcaaagtcaactacttcaggcgtgttgtcaagacgacccctctgagcgagacctctactccaagcaaaaatagaagcaattgagttagtagaagtttctttaccctgttggtgttgtctgtaatgtctagtaacagtaccgtgggcagcttcactttcaaaggcttttccgtcaggagtcatcagaacagaggtcatcaaacccagcgatccgaaaccttgtgcaacaatgtcagattggacatcaccgtcgtaattcttcaatgccaacacaaatccacctttggatttaatcatttgggcaaccatatcgtcaatcaaacggtgttcataccaaatgccagcaccctcaaattgttccttgtaggtggactcaaatatctcctggaaaatgtccttgaaacgaccatcatacttcttaagaatggtgttcttggtactcaaatacaatggcaacttcttagtcaaggccatcttgaaagatgaatgagcaaatcctctgattgactcttcagtgttatacatggccaaaccgacaccagggctcttatagtcataaaccttcaaagtttggacttcaccaccattggcaggagtgaaagttaactcaagcttacctggctcgctgacaactaagtcagttgccttatattgatcaccatgagcatgtcttccaatgataataggttcactccatccaggaataattcgtgggaccctgtctccaatgacaattggctctctaaacacagtaccattcaaaatgttcctgatagtaccatttggggagacccacatcttcttcagtccgaactcctttactctagcctcatcaggggtgatggttgcacatttcacaccaacaccgtgttccttgatggcattagcggcatcaatagtgatttgatcgttagtagcgtctcttgattggatactcaagtcatagtacttgagatctacatccaagtacgggttgatcagtttgtctttgataattttccagataattctggtcatttcatcaccatccagctcaacaatagggttgcgaaccttgatcttatcaagattagccattccctgagagaaactgcgcactcctgagagtggcttaaagccaactaagctcttagctgagagtagggtcaacatgaagggtatgtggagaaaaatgaatcatttctcgtcttggtcaattcttcgaaaaaggagaggagagtcccattcgcgaagtccgccggtaaaggcccgttaacggagcgcggttcgtttggagaaattatttattgcctatttggtgggatgtgtagttgaaaaacaacatccaacatctatataaatactatttataattacatatgttcaacctgaaagacccaagtaccagtagtggcatcgtagctgatgaacttggtaccggggatgttgttaagtttttttatatgccttttcgttaattgatgcattgggtcagttattggcttcctggtatctctagccagaggaaaacaattttccaaggtaatgacagctggtaagttgaatccttctccaactttgggtttgatactttcctcagggtataccacacatgtcttgttaccaaaaacgatgagagtataaattttttccaaacttgagattgaagtcaaatcaacaggtttcaagaattcgatagatccgtatcccaatctgccaacagtgaaatgttccaactttcttaactttccagctggataggtattcaactccttcaatgaaggtttagtccaatactcttccgaaatgctatcctcagtttccacgtaatcttctttagttccgttagtttttttagagtcgaaggtaacatctttttcagaagccgtctctgctacagattgcttgatatcgtcattggcttgtaacggcactttctcgtcattatcctcctttggtaacaaagctaaactttggttctctgaggtggtaaagtctacgtgtcttggggcatttgctgtattggacgagtctctagaatcagttgccctttgaattaccagacgtttgatatcgttaggtggagcaaaaattgaacttgacaagatctcttgatccgtttctcgaactaatgcggttcccttatcagaaccattaacagatccagatgcgctttcagtagatcttgaactcactctagattgactggatgcattgaataatgcctttggtgtaagtttatatgcatttaccagactcaacttcttcttctctcgcttaactggttgagccaagggcaatggaggtggttgattttgctggtttccactggtcaatgaaggagtggcaacctgggtaaataaactactcgatccgtaagaagtctgtgctgtgccgagattagcatttgcattagtgttgccagcgttgaactgctgttcaggtttatttccaaataatccaccaccagattgctgattatttgaagaaaacaaagacccccctgtgccagtattgctactggtagtattattcccaaataatccaccacctgtagattgttgattggtattaccgccaaacaatccaccagtagtaccagtagcaggtttgttgccaaaaagaccgcctccagttggctgattgttggcggtgttggtaccaccaaataacccaccacctgtactagcagcaggcttggctccaaatagccccccagttgctccctgggtattagaagaattggtgttcccaaacagcccaccaccggtggaagatcccaaattagtggcaggtttggcaccaaataatccacctcctgtattggaagtattgcttgctccaaaaagacctcctccagtgctaggttgattgtttgtgttgctacccccaaagaggctgcctccagtattggtgttagcattggtattaccacctccaaacaaaccacctccagtattggtatttgtggcattattggcacctccaaacaatcctccggtggtagaagttccagcgggtttgttgccgaacccaaaccctgtattcgattgattctggttctgaccaaaaagaccaccagttgcagtgttggtggtttgattgttttgcccaaacagccctccagtattgccggtattgcttccaaaagcacttggggtgttgctactgggggcaccaaaagcatttgtgttactggcagtgttattcatgccaagacccattgtattccctgtgttgccgaaggtacccccagcgggtttgttttgtccaaaaatgcctcctgtagatccagtagatccaaaagctcctgtattgtttgacgcaccaaaagctgaattaccagtattggaaacgtttgatgccccaaaaatgccaccgccacttccactggtaaagttgttttgagtactctgtccgaacattcctccagaaccagtgttatttgtagcgccaaacgcacctgtgttttgagatgctccaaatccagtattggtgtttgtaggttgggcgccaaaaattccaccggatggtttattttggccaaatattccgccagtattggaagtagtattgctgtttgctccaaataaaccacctgtgttgctagtattcgttgtattagaaccaaaaagtccaccaccagtggtaccagctggtttattttgaccgaatattcctccacctccggtgttggtaccgaatgcattactggtattggtggctccaaacccagtgtttgttgaagccggggctccaaaaatcccccctccggcaggtttgttctgaccaaaaagcccaccagtattgctggcattattagtagcgccaaatgctcctgtggaagacgagttggtgttgttggccccaaaccctccaaatcctgaagaagcaccaaatgcatttgtgtttgtgttagtattggtagatgcaaaaggtgtgttactactagctccaaatataccgccaccagtatttgtattgttggcggccgacccaaatggagaagtattagtggcaccaaatgcgccagtggggttgttattggcagcgccaaaggaggaattggcgttcatattactgccgaacattcccccaccagtgtttgatgtgtttgtggccccgaaaggagatgtatttgttccaaatccagtcttattttggccgaatggcgatgtattagcactctgtgtgttggcatttgcaccaaatgaaaatcctgaggacatgttctgcgtggcgaatcgtctgttcaattgataatcgtttaatcttatttcttcaaatgaccaattacggtactcaggcatgcaagagatgctctgatactctaaagtgcctgtattaggagccttctctatgaaaggtttgaaaggaacggtgggaggttgttgctgtgaaagggtgcctgatgtggatgaaatatttgaaccaaaaccagcagaagatgacctattaaacatcgtcactcaatcgaatagtgaggtaagatgaactaattcacaaggtgaacgatccaagagtgttgttgacggatttgctagactaagtaggtagtgtgtagtatcgaagatttttctatgagaggtatgatttgtgagggacactactagggatgaaccagttttctcccgtaggttggttaaaactcccgtcgtggttaggggggggggggggggaagtggtcgttccatcgcttacaaaaaaacttttctaattaaaatctttaattaatcactctaattacccgaatcgtaaagttcattatcatattcatcatctgaggatgagcattcatcctttgactcgttatagatgaaaaactggacgaaaatggtaaagtctaaaaataatgttcccaatgatcctgccaaccatgaagagttgactagtaaatagttgtatgaggtgtcaatggataaaatggaaactacatatgtcaggtttcccaaacatgcaaaaagaaagaataaaaatgaaataccatcacatgattttctctcgtagttcagtaggatttggggcactctggatcccaggtataagaaagcacacaaccatccaaaaatctgtgcaactgtgtcaaagaccaactctgggtcatcaccggtatcatcgtttctggaatcagatatccaccagccaaggacaccagcaagtacaaccaagaataccattaatgtattgtaataaatggaactcattttgctaacgtttccgctgataccatcagtatctaagaagctttctaaatcagcgtctgagcctagtcccgtggtgtcagtgtccatatcatcgttggagccaaaataatcacggtcactgcttaagacactttccaagaggttatcatgctcatttagaggagtagctggagaaagatgaatggggtcaactccctgtgatgctttcaaggctgataacccttttgaatacacgaggcattgcgcaagcaacacaatatccgcaagagtataataaatagccagtataatcatggttggtagtacaccttgcattactgcacctataacattgaagatgtcaccaagcaaccaaagaacgacaaaggtcatggacaagccctgggcgctttttcttatgaagttctcatatatttggggagcaaacactatgatccaacaggcaatagatatggagccggtgatcccacttatggcacgagcatctatcaccaccgaggggggaggaggggccatcatagaggggatatttgggttgtttggggaaatgtcaagctggagggagaaagaaaagaaatgaatgaatttctgcgaaaaaaaaaaaaaaatcagtgctacgggaggtcattctttgatgggagatactgtgggggagcaacatggtaggaggctgcatttttctgggaggggtgactacagggagaggttgctacatcgggtgagaatgtttagagtggcaaagaaaggtaactgcttaaaatgattgaaatttgtagttgaactgcttcatcttagctgctaacttcttagtcaactgtcaattgctcgtccctagagaaatagttttgtagacgggaaggccttctcgaatattttcaacattactctgagtattttccaatctccagaggtggaaagaagcatgagtcagctagaagcgaataaattgtcggagatatctccagtgtccccaactgaggggctatctctgaatgaatctttttcttctgctacctccaaagttgtgtccaggagagaagcagacaaaaacattcctgaggggatgtctaagtctcaatggaaaaaattacagaagaggaaacggtttgatgatatgaaacaacaatttcaagaggttaagagggccaagagacaacagagtagagcaaatagacgcattcgcaacgaggaacttcgagctaagggaatagatccgtctactgtaactggaggccctccaaaagctagagttattgatccagaagatcaaatacctacagattcgtcagttataattgactgtgcatttgacgatttaatgctggagaaagagatagtttctttatcaaaccaaattaccagaatctattctgatgctagaagaagtaaatacgccgttggtctggttgtcacatctttcggtgacaggttagagagccggtttgatgacgctctttcacaatataaatcatggaaaacgggtatcaacttttccaaggacagtttaaaagattacctggagagtcagccatatgttaaagacgatcttagcaatgttgtatatctctctgcggatactgatgacaaattagagaagttatcgaaggatgaggtgtatattattgggggaattgttgacaaaggccgtcataaaaatctttgtcagaataaagctcaggaaatgcgtattcagacaaaaagattaccaattgatgagtacatcaaattaagtggaagaaaggttcttgccacaagtcatgtctttgaactgttgttgaaatggtgggagttcaaagactggaaaaaagcatttgaagcggtgattcctcagcgcaaattgatagaagaaaagtccagggaagattgataatagattactttttccatcaactttttttcccataatagaactctgtacgcatcctcgtttggttcctgaacaattgattcagattgcttttctttcaaggagttctctagtagatcaacataatcctgtatattttccaagaattctatcccatatttcttttgcttgtagaccaaatagtttctaaccatgctgaattcaagatcttgcttcaataacaagttttcctcctcggtcagaacggttaaagacgttaaacaaaccgcagatttattgcaatttagacctactgtcaacatgagttcacagatatgaaatacttggaacaaacattggaacgagatttgattcaattgcaaaggttcttctctattcaattgtaagtagaaaaaccgaatagcaccaggattcagaaagtggtaaaactttgaattcaatttctttcgacattgctgagaccataatgtgtgtatcgattgaaaaaaatgctgatacaattccggatgtgaataaatagtgtcctcagttaccattttcccttgtgcttggatcccttgaaacgacatcacaagcttatcatccaagagaaaattgaatattaggtatagcacattgatatcgaaaagtttctggatgcaatcagaaaggaggatgttgtccctaaagtcattgattgaccaattctggttccaatcttcttggtgccttccctgatacaaatgatctctcaactgtttgcccaggataacagaaatccatttcagggtggcccttataaactggtggcttttatttatgagcatcacaggtaggaattgatgtttgtgtagataagtgttcgctttcgtgagtagtcaaaagagagtgtcagttagaccctcaagcttctatgaacacggtactagaattctctgcagcatggttttgaggagaattagagtctggctccggtttgggacttggtctctgtttaatcgttattttaggcttggatttggttttagctgatgcagaactaggattttccaggtcgctgggcttggaagtttcgttggagttttcattaggttcagatgaggactcaggatctttagctttggactttggttttttggttcgttttttgggtttcgacttgaccggggtatcttccgaaggagctgaagaagttgttttaacttcttctggcgacttatcttggttcactgcctgcttcttctttttcttttctttctttgctttcgactttgatttatccttcccctgaactttctctttagagtcaggtttgtctacctcttgttgttcttgggctttggccttgtccactttgggttttgatttggccttatcctttttcttggactttttccctttccctgtctttttgtcagacatagttggaactaacaaatgtggagcttcgccctcacagccggtgttataccactctaagaacctctggaaatattcattagactctaatggttctgtttcttcctttactggttcctcttcaaacggtccaatatgaaggtaaattgccctctctacccgaaaatgctcaggatcatgattgaccttttccctgaaggttttcatgaaattctcggattgctccaagctatcgaaacgaatgtaagcccttgcaaatgtcgtttcgtcgtacatatccttggctacatggcctttaacgtatctataatacccattccattctccttcgacacagggagtgaatagctctttaaactcctcctcagggagctctgggggaattcttcgcactattatcttctctgtggggcatgttatggaaggttcgtcgagtttgttgcgacccatgctaaaaggttaactttaccaggcagaattgaaaagttgattatgcgtctcgcgcttatgtaactaaacgtgaatgaagatgcgaggaagggtgtggcagaatgaaggaagaattggtggcaatactgacctggctaaaacctattcaaactgggctaaatacaggattcatgagtttcctgatctcaatatttttcagtcctccttgcccttgcaacgttttcttattcaatgcccaaactctcccatcgacgtcgcctcgaaactttctgaaaatcatgaccgtctgtttaatctcccgagactcttcttctctatgaacattcactcgttagcttccctaaatgagtcaattagaaatcttttttaaaaagattcattctacgattcggcttcccgaaaaagaggcaagtgaattgctcaagaaacaattgactatgaacccaaaatctcctcatctcccaaaacttcaagtggatctacagaatcaatctgaacaaaccataagcaaattcgtgcaagatcaacagttctttggtggcgactgggctcggttcgaaagccttattgtcagctatttaaaatttgttagaaactttgacccctggtcgatattgaaatccattgatctaatgattaacgttgttgacgagttggcaagttctctcaacaaacaacagcattacaagtacctgtttgggactcttgttgattatgtcattcttttgcatcctcttgtcaaattggttgataaaaaattgctaattatcaaaaagaggaacagctattatccaaggcttacgcagatgtctaccattttgcagaaagctttcaacaatattagaaatcaaagagatccaaccggccagatatcaagggaccaacaactggtcttattcttgcttggtataaagacttgctacatctactttaacatcaatcatctcttgagatgcaatgatatcttctccaacatgaacgtgttgaacttggacgccaaaattatccctaagtcccagctaattcagtatagatttttgttgggaaagtttaacttcatacagaataacttcatgactgcatttgttcaattgaactggtgtttgaacaacgcctacatcaataataccaatcatcggacgaaaaatatggaattaatactaaaatatcttatcccctccagtcttatagttggtaagataccaaatttgaacatcctgaaccagctgctgtcatctcaagaggcacaccctctgattgagctttatcgaccactgatttcaaccctcaaaaagggtaatgttttcgaattccacaaatacctgtttgataatgagtcatactttttaaagatgaacgttctcctgccgctacttcaacggttgcgtattttgctgttcagaaatctggtccgaaagctggcccttatagagccaccagtcaacaactctctgagattttcatccatcaaaacagcccttttcgtttccatttcacccaatcaaaacgcatactttcagaacaattattcatacctgattgttaccaacgagtcccagatagacgactcctttgtggagaacctcatgatcagtctaatcgatcaaaacctaattaagggtaaactcgtcaacgataaccaccgaataattgtctccaaggccgatacattcccggagatccctacgatttattcgactaagtttgccgtagactcgtcattcgattggctggaccaatagacgtccgttttttttttttttatcgtgtctgccgtttaatgtcacgcctcatgtttcaagttacgataacttatcatgcagatactaaatagtcacatgacgaatgacgattttttgcgggttgctcagaggaatatgcctctgataagcgaggtaaatgtcgagcataagccacttactgtataaatacccctttatcgccactttatcttttctccttgtccgttatctacaacaccccagtaaaacattacaaacactctagtgttgttttactgtcccttttaactctcttcaaacaaatctccatattatttaaactatgcaattgcgtcattccgttggattggctatcttatctgccatagcagtccaaggattgctaattcctaacattgagtcattacccagccagtttggtgctaatggtgacagtgaacaaggtgtattagcccaccatggtaaacatcctaaagttgatatggctcaccatggaaagcatcctaaaatcgctaaggattccaagggacaccctaagctttgccctgaagctttgaagaagatgaaagaaggccacccttcggctccagtcattactacccattccgcttctaaaaacttaatcccttactcttatattatagtcttcaagaagggtgtcacttcagaggatatcgacttccaccgtgaccttatctccactcttcatgaagagtctgtgagcaaattaagagagtcagatccaaatcactcatttttcgtttctaatgagaatggcgaaacaggttacaccggtgacttctccgttggtgacttgctcaagggttacaccggatacttcacggatgacactttagagcttatcagtaagcatccagcagttgctttcattgaaagggattcgagagtatttgccaccgattttgaaactcaaaacggtgctccttggggtttggccagagtctctcacagaaagcctctttccctaggcagcttcaacaagtacttatatgatggagctggtggtgaaggtgttacttcctatgttatcgatacaggtatccacgtcactcacaaagaattccagggtagagcatcttggggtaagaccattccagctggagacgttgatgacgatggaaacggtcacggaactcactgtgctggtaccattgcttctgaaagctacggtgttgccaagaaggctaatgttgttgccatcaaggtcttgagatctaatggttctggttcgatgtcagatgttctgaagggtgttgagtatgccacccaatcccacttggatgctgttaaaaagggcaacaagaaatttaagggctctaccgctaacatgtcactgggtggtggtaaatctcctgctttggaccttgcagtcaatgctgctgttaagaatggtattcactttgccgttgcagcaggtaacgaaaaccaagatgcttgtaacacctcgccagcagctgctgagaatgccatcaccgtcggtgcatcaaccttatcagacgctagagcttacttttctaactacggtaaatgtgttgacattttcgctccaggtttaaacattctttctacctacactggttcggatgacgcaactgctaccttgtctggtacttcaatggcctctcctcacattgctggtctgttgacttacttcctatcattgcagcctgctgctggatctctgtactctaacggaggatctgagggtgtcacacctgctcaattgaaaaagaacctcctcaagtatgcatctgtcggagtattagaggatgttccagaagacactccaaacctcttggtttacaatggtggtggacaaaacctttcttctttctggggaaaggagacagaagacaatgttgcttcctccgacgatactggtgagtttcactcttttgtgaacaagcttgaatcagctgttgaaaacttggcccaagagtttgcacattcagtgaaggagctggcttctgaacttatttagattggagaaaaggaatacacaaggagttaaaaaaagtgtggtagaaagtgcatttgtcataattttccatatgttgctgtcactgtaatcttttatattttgttttgttttatgtagtatttcaaaaggttcttatcatcttactggcataaacttgatgtacgcagagatagcaaccgttgcttaggtaagcatagtaaaaatggctggttttctgtcttattttaaggccactgttgggacaaaacacaataactagattttatcggattgaacagtgtaaaggcttcactggcttatatcttgtatgagtacgatacattatccagttccatcaaggcctgtggaaatattacagccaggacatgaacctgaaagggagtttagtgggatcactgtagataataggaacagacttaatgaagaaaagtattatcagacgaaaatagacgaagcgttgaaaaggggcacagaaagacgttacgttgatgatcatagcagaggtcatgagtctccaagttcagatttggaggacactccggatcaattcttggaatttcacattcatgataacggagataggaagatttcaaggccagacactgcttcgtcattgattagtgaaaacgacatggactacgatgatttgtttgttgacagaaagcaaccaaaacatgctacttctcatgtaaagcagtttattaggaagaatgtgttccaaaagaagactcatctaccaaacattggggctagagaactggaattacagaaacggcttgctttattagagggcccaatagatgacgatgagattattagtgctatgcccatggtagcgtgtccctctgactataacgatcaacctgctgattcaaattcaagtaaagcgttacagagttcaaccgcctctaatccctccagttcattgcctaaaaaagaagaggaggcaattaaagctgtacgggaagatgagcaggatactgcaccagacggagatgcctatggcattggaagcttggtggcagacgctgcttttaagtttctcaactacattttgccttcggattctagctccaaccccagttcgacagctatctccacagtagataaggcattgccgccagctccaacatttatgtcgtcaggtccctgtttagatggtgctagacccagttcaacttctccctgtacgagaaccacgccgctttattcgtacatggctccaaaagattcaagcagaaatcaaacggtaattttgaaagctttcaaacgcccattttcaaagaaatcaagttcaagcgtctctcctaagcgggaaaatcacactgaattaattcctagtactggccccttgtggagtggtgacagaaaacatgggcttgaattcattagtaaagctccacgaagtaaagccgaggacttttataactttgtgcgtaacactagcaagaagaagtcaaagaagaagactacgttcttatcaaatgactcttctcacgaggccttgtcgttcaactacaattacaacatgaacagccaaggtgtgacatttgatgcatcgtttgaaagagcctcagagactgaatttgaatcctatagctattcatctactagaaaggcagaacaacagaatcatacagagccgagaccaagaattaggatgccgtcgtttatgaggtctcgttcaactatcacaggtgatcagagcacgagagagaaagacaactcttctttaaaagagaatacgcctagtgccagttattttgaggcacccatatcagtttcgtctgatccaaagatactttctaatattcacacgataataggaagtattccctacttccgaattgtcttcaggcccctaactctacttggcgaggcaatgcctcaacttcagaacgttgtaataattgcagagctggtaatctgttttattcttctttatgagattcatgtatttctgggaaatttgaagctactcctaagtgccatttttggccccatcctagctatttccaagcttttctcatagacaatacataaaccacatgcttaactaagcaaaccaaccttttcttactgcgcgaagactaactcgtaaattgttccaataaacaggactcgactcaaacccaaacctttctgcagtatgagggaaccagtcaaagcattcacaacagggcatgaagagctgatacacgatattgagtacgatttttatggaaagcaattagctacgtgctcatcagaccaacatatcaaagtttttgactttgatccttctacatcaacctggattctgaatgactcgtggaaagctcatgattcatcggtagttaaattagcttacgcatcaccagagtttggtcacattctggcgtctatttcttacgacagaacaataaagatttgggaacaagatttggacgaagaagctggatctgggaaacgttggaagcggttggccactatagctgattctcatggacctctttatgatcttgcgtttgctccaagccacttgggtttgagacttggagcgattgggagtgatggggtcttgagaatttacgatgctgtagaaccagcagatcttagcaattggacattgactaatgaaatcagtgtattagctacaccaccggcatcaaggttacagtctgattttgccctaacttggtcaccatctcgtttttctaatgagtacttagtggtatgtgcattggaccaaggattcatatatcagaagggtgatcatgacaagtatgttttggctagcgttttgcctgaacaccatggacttatcagatctgtttcgtgggccccctccatggggagaagttttcaactgatagctacaggatgcaaagatggaaatgtacgtattttcaaattgagaacagaaccagctgtttccaatggagcagatatgataaccgatggggtagatgagtttgttgagaacaaagacactcatattgagctactttcgagtcatgatgaccataaaagcgaagtgtggaaagtcagttggaataccaccggcacaattttgagcagctctggaggtgactgtaaaattcggctatggaaggccacatattcagatgaatttcaatgcatgtcgattatcagtgccgaaaagccttagatttgctgcatttgcctttcagattaaaacatccgaaatcacgtcttccaaaagctttactttctctacaaaattggggtcttgaagtttcagtagaataattttcctcagatcgggtggactttgagaggcttgaaactgaggttcccaaaaagttgacctcgtggaatacgacattgtttcttgaggatctcctatattagaattggacaaggaattggagttacctccatcaatatcctgagtcagaaaggttagtggaagttgactagtaatcatttgcagcgagggatcaagcaattgagaatcctggatcagatctagacattggttaaaggagcttgtatctttgaaaaaaagctgaattcgcaaagtttgaaccatctgatcctgatcaatcatgaatttcaacgcaattacaggttttctgctcgtgatttcaattggcaaactttgtgttctctgctttggttcaatgcctttgaaataagtctcaatctttgttgagtctacagtttgcttcatcatggggttagtgaggtgtccaagaatttcttaacgaaggtatacaaaccaggtcagaccccttatgggtaattctcataaaatatccagctattccttgttggacgatgagactaagatcattacgatacggataatgctgccattggctgacatgtggtttcattccttcctttgttgtcacccagcagtatttacgtaatggaataacggttagcatctataatcaataaaaatagagtagtttggttgatatcgtgatggagtttgattcgtgaggcctcggagtcaatcgctgcgataagcttttttggcgatgagggttcgctaagtgcggagtcccttcatgccttgttgagattggtgtcactcataatctacatcgtcattgtcataagacgatcaccggccgtcgctcgcttttcttatggccttggaaggttaatgaggttgtgtggattgttcattgatttcgcagtaagggccctcatggacacggtcaatgtcacgtttaaccaagaactagagcactactccaacacatttgataatccgttaagaggtatggtaggatgtcgtggagacaattgctttgttataaagggctttcgttattgctctagcatacgctaagccagttttgctggatccacggtaatgctattacaacagagaaacctacaatgtctctagcgtgcctctcggtactaaaaaagctaatagacacgaacggatcactcgtggttgcaggattagcatctactgtccatcgttggtaacaatctcacacgacgcaacaaactgaatacaattttcttttgggaacttgagaatacgattggcgtcgtacattttgaatcatcgagcgagagcattcatgagtttatagacgggacactgagtctcggaccattatatcaatataattggccaagatacaaatgatatatttgcatctcaagactgtttctttggtgtctctcctgccatcttccgaaatagaagaaatttttctttgaacagcctttcaatccaatttaatcgctactagtaccgattgcgataggtgttggtcctttaaattcagtgctggatctgtagatctgactatgatgagaatggcaatataactcaattgtacagagaaaggctccaaatggaaagccagcaccaacaaatttgcttgtaagtggttcagtcccggcttgtcctctcacgattggcatagcacagataatgatatttgaactagcatttacagtttgatgagagctcatcattctcatctcatctcacatgataaggggaaacaaaaaaaaaagagcacaactcacgtgagaatttcttatcgaaaacaacaaaaccatgattgtatctctcttccctactttccttcccaacattgttaggtcacctatcaatggttgtagagcccacttcaagccctggtgataacaatacgacagaaattatgttacaagattatcaatcccggtcaggttcccgggaggacctttttaaccacagtgaacacagtaagcttgatcttagtcaacacgatattgaaatgatagaagaagaccttcttggggagttgccggaagggaagcaacggtttttgggcattttctcaactgttgtgttgtttgtttcaaggatagtgggatctggtatctttgctacaccttcgttaatatacaatgaggtcggagcttgtccaggcttatttttcttggtatggttcatagcatttttcatggcatttgcgggtctctatctgtttttggaactgggctcaattgtccctagaaatggtggaatcaaagtatttttggaatacatttattacaaacctcacatgttgatgagcgttattgttggggtctactcaatattttttggattcgccatttccaattctattatttttggagagtattttctttactctataaacgtagaaaaaccaagtgagtgggcttcaagaatggttggtgttgttctgattgtatttactacagttattcatggtatttcggtacagtttggtgttagagtgcaaaacttttttggtgttttgaagatattcctcttaatagccatagctctaagtggtttatacgccttaatcctccctgagaaggtatctcatttggaaaggcaattacactgggatcaattcttcaccactaagcagaaagtgtcattgagctcttttatttcggcagtattcaaagccatatactctcttgctggttggagttcagtgcactcttctgcaggagaagtgaaaaatccgaataggactttcaaaattgccgggccctcatcgttggctatcattagcatatgttatattatgatcaattttgcctatctgatggtcatcccaagtgatgagatacttaactcgggccagctgattggcggattactctttgagaagattctgggagagaaacttggaagaacgcttcttggcctgagcatagcaatcagtgccggtgggaacactttggttgtgctttataacatttcaagggtggatcaagaagtttttagagaaggattcctaccactttctaaatacctggccgccaattggccatttggtgctcccttgccagcattactagtgccagcaataatttcgtcatctttcctaatatttacacctccaggaaatgtttatgattatatcatcaatttggaaagttatgtgatgcaagtttttattggtttggttgcagtgggcgccattattttaagacgaagatttcctgattcggtgcctgccataaagtcgccgcttgtattcatcttagtcactattgtcttttccattttcattatcttgggcccactacttccaggtgataagagtgccaattcgattccaggactgcccagttacccatttggtgcattgtttttgattgtgatctgcgtgttctattggggacttgtatttaagtttttgccatggatcagaggctatagattggtcgtccttgaggagaagcaagatgatggtctgatcattaagacgtggcataaggattatcattacagcaatactcgagacgaaagcgaccttaatacctcactgctataaaacataattatagaatgaagcatatttatctacatgacttggctatccattatttcttattgcgcttagcaatgaaagcctctttagcaagcttaacgagcgtatcaagttccccactgttactacacatactgtagaacaatgagttctgatcactgatcaacttgtaagggtcgtcatactccacgacacgcccagcatccatgactaaaattttgtcatagtcaataatagagcgtagcctatgagctatagttaaaatggtgctatcgctgaactcttctctgattgtagtttgaatcttggaatctgtgttgtagtcaatagaggctgttgcctcgtcaagtagaatgattttaggagacttcagcaacgaacgagcaagacaagtcagttgcctttgaccctgcgacaggtttgagccaccttcggacacagtgttattcaagttcaagaacttgttcacattctcatttgaatcctcgatgttatcgctggaactgccagacgttggctcatctgtagagaccagattgactctcttcagagactcaaagatttcggcatctgagtattggttgaacggatccaaattggatctgatagtaccggtgaataatgttggatcctgaggaattatagtgacagcatttcgcaaatccttcaatccgatagaggtaatatcaataccgtcgatcttgattgacccagattcaggatcgacaaatctgaaaaatgctgtgataatggttgattttccagcaccagttctacccacaattccaatcttcgatcttggctcgaccttgaaagatacatttttaatgactttgggcagagaaggagcgtagcgtagtgaaacatcatcaacttctatttctccagtttcaggccacgaggatggtggtttattatctggaatctctctgtcaggttcttggtcaatgtttaaatactcttccaatctttccacagagttcatattcatctccaccacagagtagagcctaacaacccaaagagcactctgggtaaacgcaatggcgtaggatagggaaagaccggccataccagcatcgatatgaccaatactcagcatcacaaaagctgctgataatagactgaccaaagccccaacaaaatcaacacgaagtgccaaccatctattcgcaacccacaagtagaagaaagatctgttgttattatcaatcttttccaggttttgtctcataaatcttctttcgtcaccataagcacgaatggtggtaacgcccaccagtgtttcggagaaatgctgatgaatcggagatacagtgatcgaatcgtacctttttaactctcgagatgaagctaaatacaatgccccaatataatagtagatgatcacaataaatgcagcaaatacgataaatcccggagtaataatacaaatcaaaagaatagtcgcaccacactgaagaacggacacaataaatccttcagcataaggagccaattcttggtcaatggattcagtatctttggagaaacggttcataatacggccgataggtgtggaatcaaagaatcgtaatttggcattgaaaatttttgtcaacatatcttcaaaaatcttgttagaggcaacaattcctcccataaaaacaacgtagacacggaatgctgaaattagcgcatatgacaaaccaatcagagcatagattgtaatgtagtaaccagaagaatggctgctctcttcgccataaacccggaacatttcaccgcctagaggacgggaccactcaacagatgccacagatgctctgaatccttccttgagggcattcaatgacctatcaatagacatagtaaacgcaggagacaccagcttatcgttagcagccgcccaaatcttcaaccaaacagactgcatgatgtttgacccttgagaagcggcaaatgctgcaacaaatacgaaccagataaaaacgccaccaaaagctctaccataaaacttgtaaacttcccaactaactgctccgctagacttcgtttcatcttcgatcaacttccctcgaggtgagagtcgctcctcatcaagttgatcagccttgtcgctttcagctatttttttcaacttttgatgaatttcacttgtatcagatacattcaattgttttaagttgaccgaagattgactacgcgagctaataacggttgataccaaatcgtcatggcccaaactccccgatgaaagcaagtcttcacatgttccttgctcgagaactcttccattatccattgcaacgatccatgcagcatccctgactgtcaaagcaacgttatgagaaacgagaatacaagtacgatccttcatcagaggtccagtaatacagttttcgtaaatccaagcagcggtgtgagagtcaacagcacttaaacaatcatccaataacacatgcctagcatttgagtacagggctcttgctaaggagacacgttgtttctgaccaccagacaaagtgatacctttttcgccaatctcagtggcatcaccagcatctaagacttttaagtctctggttaaaccacaggcatcgataacagcgtcataacgctgttggttgaaaggagcagcaaagacgatgttgttcttcacggtgtcatttagcaaccaagcaatctgtgagcagtaggccacagcttcagtcatacctgtttctggatttggaatcaattcatcacgaggagtacttccaggaaggaatatcttaccattagtcagctgcatttctcctaaaagacccagcaataaagaagtttttccggaacctgttggaccaataatcacattaagcttaccaactttaaaggcaatatcaatatctttaagctgaaaatcgttctttgagcctttgttccaggatagtgttgcattctcaaaaccaacctcgggggagtttgcacctctggtgtgcgttagctgttcatacttatcactctcttgttcttctaagaatttttggacacggtccagagaaacttttgactgaaccataaatgatagcatatcggataactggtcaagtggagaccttaacaagttgaataaggagagtgcagtaaatgctacaggagtggtcaaaattttgccttggaatacaacgtaaaaatagaatgaaatcaaagtcaccaacgttggagtgatgaaccaaacaaatgcagagcaagtccagacaatgactctatacctcaaatacctgatttcttcatttcttaccttcataatctctttagcaaaattctcctcccaagcaaaaaacttgataatacgtatactctggaaagcttcattcaacttctgaattctgttatctgtaatgcctaacatttctttttggaactcaccaattttacttgctagtttgtagtttaatggtaacagaattaagatagaggacgagccagcgagagctgaccatcctagaagtctgtacagtaaggtgacggcaacaataatcataaaaaaggaattgacaaagaaatgcaaataactgcacaactctgaaaccttggatgcgtctactgccatcaaattgatgattccacctagctccgtagacttggactcttcctttgaggtttgatcggcgattggggccttgccatctttaggatcaacctcttctatcaactcctcagggctggtcatacgtcttctaagtgctttagcataaacttcaccaatgatcaaagctttcattctaatgcagactctccttcctagatatagggatctgccactaaccaaagaatctgatatttggataaaaaacatagtaagaacatacaaccatgccatattgcgtgatgtcatccctgggttgtcaacatactccaaaattcgtttcaacagcaaagatggcccaaatatcagcatggagtcaatacttgcccacaaagcctgggcagctaaatcgcctttcgaaaaataaaatatcttgtaggtgaaagttctagtgaatcccaggtctttaaatcttcttagtaggaaatatgcataatcatctattcttaatccccaaatgtcgttaaattgaagtggagtcttgtaagctttgaaaattaatgggtcaatccaagaataggtgacaatctcaaaaaagttggaattattttccggggaaggtttaactccatcatcagtgtcaaaaaggacagaaggatggtcaaacactcttgctgaaccaagaaggagaaacagtagcgtattgttaataaactgaaaagagtagtaatagtttaccaattgtgaattttgcggatgaataagtacacttctgaaagagagtgctgagggaacaatattaacgatgtagtacaacaatgaaatattggccaaaggaaatggacccgacttgttcaacgccctgatggatccaagtgcaaacaagaagatccacacgaatactcgtactattggagtaagcttgtaaccttcccactcttggttaagagaaggtacgaaaagagcgacgacagctataactaattggaatatcaatatcacaaactctagaattagcttaactttctcccagccatctctttgaacatatttcaccagtcctaacggtgtgccatcatctttcaggggttccagtctggaaatgtcaaaatgtttctgtgaggttgtcaactccgctgtggattgttcctcttcgtaatctatggtgccataagtattagaataatccgtaggtgagccattggcaggttctaataacggttgtgtttcatccttggcgtagagctttctgtgagtcttgatctgttgtgctcctatgagcagtaaatagagtaacgatcctactacaattgcagcaggcaaatacgaatccagcagtgactttctgatacagggagaaatatcatcattatcccagaaactgcaacccgtcggggctgactcattgtacgaattcatacgaaggaaagacgacttcttaacggaaagaaaatatcttctaatcttcgaactgttgaaaaaattgagtccacctggtaattgagtcttcacagggaaaaagcttcaaggaacgctgtggcaaggaatgacggtcctgttggcgggcaagaaaactggagggagttaaaagctctagcttggataacctcaactaaagggaagcttttcagcaaagatatgtcataagtaggtgtgaagactaaaacggcttaaaaaggcaagcaagctctacggggttagaagggagcgcaagcccgaagggagtaacacccgtcagggctgagaaaggttaggctgaaaactaggaggtgacagtgagctctacgaaaagctacaagagtattacccaaaatttaaccttgataactataaaagtacctagtcctgagtcttctgtgtaccacgcaacaaaccggttcttctggcggcaatcaaaccaaccttttgaccagcaacagcatttctggagatggtggaggccttaccaatatgttgatggttaccaccaccgtgagggtggtcaactgggttcatggcaacacctctggttcttggccaagagtttctcttaactctgtacttgtggaaagctctaccagccttcaacaatggcttgtcgattcttcctccaccggcaacaacaccaatgacacctctggagttggaagaaatgatcttcttagcaccggaaggcaacttaactctggtcttgttctcctcaacgttgtgtccaatgacgataacgtagtttccggaagttctaccgatggtacccttgtcacctggcttggcctcaacattggagataatagtaccttctggaagggctcccaaaggcaggatgttaccaacattcaaagaagcatccttaccagcatagatgaattgaccagtgtacaaaccctcattggcaatgaaagtctcctcacgcaaacccttcttggttgggtcacggaagataaccttggccaaaggagcacctctaccagggtcatggatgatctgcttaacatacccacggatttgtccctcacgttcagaagagtccaaagctctgagcttagcggctccctttcttaaacgggtgtgagcggtgaagatagaaccagcaccctttctctgagcacgaataactctacctataaacaatgacgttagtacttgacctctggatgtttagtggttggtggtttacatacccattttgtcctgttgaaatgtatagaatttcctttagtctaacgaatttttcacctaagatggaaggttccactctttgaggttggtgtagaggtgtattcgtgggtcgcgagcccagtataatatccatcacgtgtacagggctagggctcgcgacgggggtacagaagtcttgaacaaataaatatggaatgatgatacattattacgccaactagttgcaagcaaaacctatagattataatgacagagttcagcaactcgaaacggtttggaaaatcacactgtagtagtttgcacttctggagcaatggtggttgactccaatggtttgagcggctcggactttacttcctcctctaccttgccctcttctccctcatcctgcggctgagctccatcagtaacgatggaaacgtcagcaccatctttgacgctagattctttaggttcctccttcacgaaggaatcaatggcaatatcgatgctaattggtttgcccttaatttccttaccgttcaattccttgagagcgcgttgttgcgtttcgtggtcggcaaatctcacaaatgccataccacgcgacctgatcggaatgttctctttcctcagtttttgaacaacatgacggggtatattccttctggggatcgaaacccattgagggtcatactcagaaaggaactccgtcagttcggaagtgacaacctcctggtgcaaattacggatgaagatcgaagtctctgaaggcgtaccctgttcaaggggaactttatgtggattttgtttcttcttactgtaaggcttcttcttcttgccgccattgggagcgctgttctctttgtctttcgaatcagcaacagaatcggaagcggagtcggcattgctactgacatcagcttgggactcctcagtcccatccactgcagtattagtaacaccttcggtggttccatcattgttcttagcagcggaagtcttctttttgttggctttcttcttcttagtcttctcttcagttgacttgagtttggcagatttacagtagatgtctctccctttcaaatttttgccttcgaactcggtgattgcctttgcagtttcctcgctagaggcaaatgtcacaaaggcaaaaccgcgtccagtcaactttcccactcgcctagaaaacctcttgggaatctcaatgccttcgatgtcgaagcccgtaatcaactccctgagctcttcttcggtggtgtcataatcgatgtttccgacaaacattctcttttcaaggtcgatgaccttctcgtttgtttgttgttgttcttcttccgacatgatgtgtgaaaactgattgaaatttagtaaaatgacaacttggtatttttcctggtacttcaaatatctgctgtgaaaacgtgctgcaaattgctgttccttttgatactcaatcgatgaattcgggtgatatcttatcttaacaagagggtagtgttccgctgtatatatacaagtcgtgtggaaagggcgtgtccacgcgaatttgaacagactttctttctgccctccctcctcctaggaacgatctaatcttctgccttcgcgagggtaatgtgcggactctgaatgcgctggcgaacgcgctgcctagctaggtgaggaaggcaggtgttaggacgtagcaagtcaagtgaaccgaactaggggtagctgtggagaggtaccaaggccaattgaaaaaatagctgccggacagtacgcttaatatacgagcaaccagcaaagagcaagtgatttccaaagtggtgagccctaattgcccggtcttatcacagattaagcatccccaccccatcacactttgcaaatagcaaccaatcccgcatattagcaagatgcgctcaccgctcgtcgcgtccactatataattctctgccacccttaaatccataagatgcgcattacctaactaggatctcgcttttttggccaatcaaaagttggattttataatagtcgctctacaacagttttctttagctgaattctttaactactattgcaacagtttgtacatagactttcaagatggcatttttccgtgaattgattgacattttggctcccgcctacgctacagccgaagatcctgatgttgaggaccaggtggacgacactgctatagactctggctctgaacctcaagccaaaatagcagaagataacaaagctgacaacgcagctaagagagctaatgccggccttgatgaacagaatgcagagggaggagacgaagatgaggaaaaagaagaagaagaagaaggagatgacgaagaagaagacgaagacgaagatgacgaagacgaagaggaagaagaagaccaattagaagtcctgaaaaaacaatgtcaagagacaccaaagtgtaagccatatcttcaccatttgcacgaatgtatcgagagagtcaccaaagaacaggaggaagacggctacgatgagaaggattacaaagaagattgtgtggaggaattcttccatttggagcactgtatcaacgactgtgctgctcctcaattattctacaagctcaaataaacgtcctagaccaaaatttgtatcaccatccaccatattcagcccctcaaggaaaccagaaccagctcatatatatgaatatatgtcaagtccattatttattctccgaaatttttcactagtagtatctcatgaaattacttttatacaaaaactatgtagaaggttaaaagtatcatgattatttctcctccaagatcttggccttggcagcagccttagcctgggactcagcactcaagatacctccaccccacttctttctggattcctcgtacttctcggtgaagttcttgttgatggcagaaaccaattgggccaattcagcctcgtcttctggcttgacatcgaccagagcagcaacagtagcggtgcttctgtggatcaaggtacctaatctggccttacccttcacaatagcgtatggaacacccatctttctgcacagagcaggcaagaaaacgacgagttcaataggatcaacatcgtgagcaatcaaaaccaactttggcttcttgttctcaatcagagcaacaacgtggttcaaaccgaacttgacaacgtaaggcttggaagaaacatcctccttcttcttaccatcagcgatggcagcagcctctctggtgagtctctcctgcttctgttcgtaagtctcaggtctgtacttgttgaacaacttgaaagtttgagcagcagtgtttctgtccaaagtgttggtgaattgagcgatagctggagggaccttaagtctctggtacaagattttcttttgtctttgcaatctgacgttagctggccattgggcagccttctcggacacctcagtgacagctggggcaaccaggttggtgtctggaagctctaacaattggttggtaactgcagcgttagcggtagcggatgggagagactatattcttgttagtactgggtttgttttcaactcattttcttcggcaaaattaccaaaagtttgcaaaacaatgagatctatcagaggagcaactttcagtatttctctaccgttcatcttagtgcttgaatacataccattttgaagctagtaggtgaaaccgagtccaattttcaattttttttccactaaagagggaaacatcgcgagagaggtggaataatatttgtcatgtgattgtctatagggtttgtttatggtgtaagggtgcaaataatttaatttggaggtatatgctaaggtcaaggcaagtagactagattaagatgtatttaatgttcctagtgaataaagaaataccagatgtagaattttttttactgtcctgacacaggtaccaatagctattgcagattatgttttgttaaagtcaaaaataaagaagatataaaactttatctatgcaatctagatacagctatgaatccatattgttttgtattaaggaacgaaaaagatgtagttttgaaagcaaaaaatatggcattctagagagtatgcactaggagaatatgagtctatggaagaatatatgcatgacattgaaattagtaacaattcgccagaagaagcaacatcatcaagaaatccacctgatgatcatcaggttgaacagaaagtgagattatataaccaatcagacgaaaagagaatagacttggatacttatcatattttaaagctgaaggtgaacaggaagcatgtatgaaataactgagtcaagacatttgaatgacggtacttttctattcatagaaaacaacaaaaactatatcatgcgtataaataaaactatagactggagaatagaagataagtggtcaagagaacctttggatttcatttttagtacttatttctttagaaaagatgattaccaaaagttcagaatttagatgatgtgttttggttcaaatttttgtaatttgagataaaactcaaattttctttataccaatgtggggttgagttgagaaagtcatcaacttttatgcgaaggtctagccttctattctccacttttcatgatctaaaaagaataaaaaacagctcattgttttggttctaaatgatgatgaattgtccatggagaaattcttctaactttgatctggtgggatgtgtgcagaaatattcttttcccgctacgctatgtgtttctcccttctcttatgctagttcctctggcatcttcattattgggatgactaaggaagtccaaccaaggaagtgtctcgttctttggccctttccggttgcttcattgtactgttcccaggcatagcccgttcttttaaattcattgtaaacattggtcactagaatctctcgcaattctttgtaaataggcttggccatttcctttacatctggaagagcaccggaagactctgcgtaatgtttcaaagcatccaagattagatagttaatgttcaaccaaatatttcccctccagtagtcttctccactgtggaaaagagggtgcgatttggataaagatcgaatgccgaattgagaccaacatatatctggatctctcagatcttgtaatacatgaatcaaccgttcagaatcttctggaataagtttcaaagcaaacggtagaagagtcacgtatcccttatgacattcaaaaacatcattgtcgtcgtcatcaaccgttatgtcgcagtaactcttctcttcttcagaccaatggatctgatccaagttatatagcactccctgttcaatagtctcaaagtagtgaacatcgtcggctttattcaacaacttcgcaatgctcttcattgatcgagacattagccccatccatgaaagaagatcaatgttgagttcaccggagtctggttctgatgctcttggataatcatctagtccacttggtaggcacaaatctttggttcttcctatccatctgtaaagctggttgggatacttggactctctgctgagccccaaggtctctcccttttgagtcgtggcaaaccattcgaagtgttttttcaatctaggataaatgtcttctgcgtagtcaactagtatttctggattgtctaaatgaacatggcccatattttcggaaagatcctggatggagacaaaatcgtcttccgactttggagaatcatgagccatatttagtagcttagcaaagactaacattaatgtaggagggttggcgatattaggattttgaacttgaaactctgccggtaccctacttctggcttcagggcccaagatttgttccctagcaatccaaccgtcgtcatctatcaatgcaaaccaactttttagaatttcgagtgccagatcactgtcataatccaaaatggataaaagatgaaatccttcatcccaatagaatccacgaggaaaaaatggtctgcttggaacggaagtaaataactcagacggaccttccggtttcccaacaagtttgacattgtcaaaggagtcgtcgtcaacaaatgcattcctatcgactaactgttcaccataaaagtatccgattccccctgctagatttgataagaattccttaccaaagttcaaatattctttggtatgaaatggggcttgaaactgtaattgagaagagaatttttcatcaaagtgggttaatgctctatccacataagaatcgatgttggaagaggaaagtttttcaggagcatcttctaagttgaaaataatgttcaactcaaacttaccttgaaatgtcttttgaatgaagtgtaaattaccttcaaaattgttaatattcctcaaggttgtcaattgatcaactggtatttcactcacattcaaagagggatcttctctaatttttccaacagattcttgaagtaatgaaataaacacctcttttgcctgccacaaatgttcgtcggggacatgcaaagataaatgatgcgttagagaaggatctaaatcaggggcagccaaaacagtagcagacgggtacctgttggagggaccatcttcgactaataattcaaaagcgcctcccaaaactttggagacgccagtcaatcttgtcagatcattgttaacattcccaaattcatctttattgcctgcaaacattaacatgttatcctggtcttcctcagttccagcatagaatatcagagacgttttgacattttcctgtcctttctttggcactccagtaattttcagggcccaattaccatcactggtcttaacaaagtcagattttatcagcactttacagcctctgtccttgatgatgtgtcttcctccaacccttgcatcgtactttacccaaccgaaactttgaatctctgggtcctgttcacaagaatgcctcagctttacgattccttcaggatcgtcagcattgaaccacatgagacctgaaaggaaactatggggaatctttggtttgattccgacatacaagttagatctgtaaggaccccacaagagcgattgatcggagatcttctgaaaagcctccggtagggacaattcatcagaagggacattttcaaaagcaatggcaacgaccaaaaccgaaatgaggcttaggatccggcggttgaagaggttcatgagtgaaaaaagatgaaacggtggagctcggtagatcttaaaacagtcgagggtactgaacagagattcgggttgaggcccaaggagaaccaacccatggagcaaaaagagatgttcgagacaacagcagagagagtgtctgatggtgctaatgctaagatgaatagctcgttgtttacattgagaggatcacaataaaatggtttttccatactacttccttattatagactcgcacggaacaatcacagtagaatgggctgattagcagagccgtaatcttgctgggcctgctgagcgtattgttcatattgaatttgttgtggttgttgctgtgcttgggggtgttgttgttgtgattgttgtaaaggcggctgttgtgggagctgctgttggatttgtggaggttgttgtaactgttgtgactgtaaattcatctggtacattggcgtttgagcatttccgttagtattgcctagactggaaggagtatgacctgattggtttatatttggagtctttttaatattttttcttggcttcctcacagcagtctttttctgctgtagaacccttctatcttgtttgtcgttagaccctggtacagagccgactagagccccagaaccattggggtactggattttaacctcatgcttcgtgactttcacagaatcattggggctcaggcccattttgatcttgcaaaatcgtaccaccggtaaaactttttgcagttcttggtgatactcttcgatatcccgttttatgtctgaaacctgagttgagaccgtctggaaaaacccacttgggccggtactactgtcaactgaggctagcagtttaagacttgaaaccatctggtaccgtaaatgagacagtttttccttcaatagggagatatgtgataaaagtaggtctatatccaattgaccactttccaagtctttaatggtcacggtttccataaggtatttctgggagggctgacttgaatcatcattttccaacttaatttcgacttgaaagtctttcattgttgtctgaaaggctttgaaaagaaatacacagccccaagttggcgtactggatgcttattcgggggtagaagtggagagcggaggtggtgaggtgagaaggaggagatattaggagccagaaaaagcgaatgttgcttatttaatcaatacaaatggaaattattgtctgtgtctctctctaatcactatgctatcgttttggaccttccatgaagagtctttgatgagttcattaaggtctgtttggaagtagtcttgtaggtattgggtgggtaaaatgaaatatgatctgttgaaggtattaattgcatgcgctaccacctggtggtaccccatttttaaaaacaacagctgtatggaaagtttagggttatactggcattcgtggtaatatctgaaccatcggtcatacttttgaagtatcagcagcttgacaagctcgaagctgtggtttagttgttctctcccgtaggagttgataggcaattgatctctgtattcaaagtagactctaatagccttttggtattcttgattgaaatgggacaaatgtagcaccaaataagagctgaactcccctaattggtcactatccagcttcaatccctttagtacatttaatagcaagggcaggtacgtttggtagtggccaaacttgactgattcttggatggagaatacgtagatttcatttgcttcgttatcaacaattggcttgtcaagtattgcttcccttaatttcctcaaaccaagcaaaatttcatcccttggggggctcttctcaccacagagcttctttatatggctaaaaagcttctttcgttcttgctcgtctttcaaccgtagatcatccccacggctcaccaatccataagaagacggtttatttgattccttagaaaatctttccctcctcctcttaagttgttcttccgtagccatgtaagggacctctagtgtgtctattactgttcattatttagtcttctatgtttctctttccccgtccacagacgaggaatcgcgagagttcccgcccaatctccctccaacttttattagtcccctcattttctttcctctaatgttgatgtagactacgagctgtataatcacaaagctaatcactgctgtccaaccgaaagcttctcgataacagtctaccttatcgtcgcatacgttcattggctttttctgcaaaaattccacaagttcttccatcgtcttatcatcaattctccccttcaagtagtcaagattcagtggtttgatatgtttgtcgtaaactgatccaaataggtgattcaatagcatattgggcagcattgctgatagcatgaacactccccaattcatggaaaaattgttcaatccatatagatcgcaaacaattgcggggtacgtcgaataggtgaatccatacccgaatccaagtaacattgatatcgccaagagactctttaaggaagaggcgataagccccatgatctgcgtggcaaatatgatgatagtaggaacaaatagaaaccaagtcctttggattttaaacttcttgatggtcaaatctccaactactccactgctcaacctgcctaaagtagaagatatagaaataacactaacttgcagttgttgctgtgtttgtaaatacttttccacctttaaagggaatttgtcgattccttttgaaaagtctgcaattgaaagtatgtcctctgatcctccggttaatgctttaaccatgtaaccacaagaataaatgtacatctggcccaagcctgctaggaagccaagcaccgcaaataacatccagaattctggccgttttattaattgtctgatattcatctctggtgactcgaccgacttactggtaagtgtccatttaggtgtgtcggagggatggtccatctccacttcaaacggtgaaacaggtcttgaatgacgagggctaatcattacatcgctttggaaatgagtcagctctatgtcatggcttgcgaatgtcgggctcattagctgaacattagcttcgtcctcattgtcctgttcttcaaactttttgtttttactcttcatcagtgaaaaatcatagtaacaaacgatcggaacgcacagagaactaatcacaagacctgcccaggcaataaaccctaaaaatgctgacgtatctcccgggaagaacgtagccccaaccagagagaaaaatgtagcgctggctccatacattgccagaggcaacgacgatgccaaacctttcatgttggggaaaatggacatactacatttgagggtagcactattaacgaatgtggatccaattccaactgaacagaggtacatggaagatctccacacgcttgatgtctcatggtcgaactgaatcttgagtaggaaatatgctgaaaaactcataattgatcccagtatcatcgctggcgtgtagccatatttatcgatgatcagtcctactagaggtgccgaaaaaagaactccttgctgaccagctgtggcaatgttagaggcatttcgtgttgtatagcctaatctttgggccaattgagggctatacgccgagtaaagatacagggttccgcaattgatattaatcaccgtgacagccaccatgagaaacacccgtgttattgccttcatttttatttttgaggttagaaaacaactgggagactttctccccccggtttacgtgatgaagtgaaaaggggagaaacgcataataaggtaacggctttttgcatgagtgaatgctagatccggttttcagatgtcggggatgcaacactacgtttgtggttttcttcaattttcttctccagattccctcgtccctatacccaaagctcttttacgttccatggttggactcaaagtggcctattttggctcagactttttcagtatcagatgcttagatcatctgatgaacttgagcttcaaacagcatcatattggaacactggacttgattgctaagcattccaaacggggtggtagaggtaataaacagatcctggaaaccccaatagtcagctatgctaaattgaaacaattgaacattttgagagcggagaagaactcggaaattgaaagtctttccgctaatagctatgacctggcaattgctgtttcctatggcaaattaataccacagacatttctcaaaagcctcagatatggggggcttaatgtccatccgtctctactaccgaaatactcaggacctgcaccactacagcatactattttaaatggtgacagtgtcactggcgtcaccgttcaggctttgcatcctaccacttttgataaaggatctgtactaaaacaagaagtctgtcacgattaccgtcctgattcagaaacaaccgaatctttagggcttaaacttgctgatctaggcggcccgctactaagtgacgttgtgaagttcacttttgataatttaattcttcctgaacccgtagaaacctcaaatgaatacagttatgcaccaaagccatcgccctctctgtatcagataaattggaatgtgctctctacaacagagattatcagacggtttaacgctttgggcccactttataccttcaagcattgtcatgtagtcaagaaaccccctttcaccggcttgaaaagggtcatcctagataaaatctccccaatagcagatatatcatccaatctatcagcggaattgacaactccaggaatgtttacttcggtagaggacggtctcattattaaaagtcttgacggatatatcaaggtaaaatctctaaagtttcaaggatttggaagtcaggactcaaactctttcatggctagtttaccgaaaagaactggcgattcagtgcatgtatttctatttaacgactcataaaataacttgacatctcttgttaaagtcttgtacagcaattgataatttctgataaacttcccttctagttttctgttcaggaagaggtatgaacatttcggtagcttcggatttggaatccctttctgttaatttgatttgcaaccctgtgctgtcgactaagatggacttaatctgcttcatttcaatgcttcgagaaacagaaagatctgctatcgaaaccaggataatgtgtgtataggaaattacgacaacatattctcctccgggtagaactgcatgggttagatatttatcgttgaaaaattgacctccattagctgatttaagccaaaattgaccctgggcatcgcgttcggagtaaggactgataggagagttctgagcgacaaacctaggtaacctcaccttctctatgccttcaccatcgaaagccgttgttgtgcttctaataccctcaccaacgttggaagcaaggtcaaaaaatccaatggcagtcttcgttggtaaccctataagaccctttccaattcctttgaggaatccagaagcaccgtctgtcgcagcgccttgagatggtgcatctgtaaggccagtaataccactagatacactctcaaacaaagaagatgcacctgctgaaaaaccaaggaacccatgtttgcttttgttcctcctttgattaagacgacgtcgctcttgaaaagatgtgtcaagagtggcagctgtaagccctttagccatagaaccagtaaatttcgcaaagctatcgcttagtccaaatacagattttttgacaaaactcaaacttccttttgctaatcctattccaagctcctgtggtcggtcattcataacaaagcccatgtaaggttcgtaaaatatatccaagaatccagaacttaggttattgaacaaaccaactggattacccaggaaatcagcggatcctagaatcttgtacacctggtacaagaatgcttggccataatgggtctggataagctgcaacaacaatggaactggcacacgaacattttcaatcagaagggcattaagcctcactggagcatagttgatgtttcctatggccatggttaaaatattcaggaaaaacgacaaggcattgtctgagttgctaacctcgtcagcattgatatgctccgtacgaacgaaagacaagttcatttgcattggctggaaatgaagagcttcaaaataaatatcgctatcagaaacattcttatccaatgttggcaaatccaaatcattatcacatagtttatcttcaactttagctttaccaggcaccttaagggcatccaaaaccgcaaacaagaaatcttcgtcgatctcaagcgtaaactcttgcaataatatggtagcatatttgattaacgtaacaccgtgcgactcatccttgacttttgatatggaggctgaccaagcgggatgattattgatgtctttgttggagttaggcaacacactaggatataacacaattggatatatccctccataaagttggttatcgagttgaaaccatttcaacttgaaactcaaattttgatagatatcagattcgttatagcgtacttccaacgatcttaaggtcaagtagcataactcttgctgcctgttattgataaaagaaaagcctgcaccttccaagttgacaataagttgaaaaaagtagtcgttttctgagtcaattgtttcaaacttatcagcgaccgtagtgctagattctgatttggaatgcagcttgtacatactcttcgatgaatcataattggaaatcactaacgattgtgttggaccatcggcaactacattcaagtcaacaatggacttttcttcggtgctagtagcaggtaataccatgggtttcaagcttcctatctcttgtaattgcacatgtctctcagcattgtgtgagcggataatcaattccttcattgaacctgctggatagtcccaagtgtaaggcataacactctttggtggcagcctgtagtatattggtttgaatcggtagcttgggtcttccagaatcccctcttcattgatcatagggttactctggtagaatatgaactctgaatcactgaagttcctcatcgaaaatggccatttaccattagcatctatgattgttatgaacagagatccgttttccagtaaaatattgatcttggtgagaatgtaatcattgttgtgtttcagaattttaagataaatttcaccaatgtcgttgatattaaaaggtgaggacaattgagtacttccgtcgtcaagtcctagcgtgagctgtttcttacgtcctgttcttagattatagagaggaatcgaagatcctggtctcactttcaactgttttccagtaccatattcctgaaggatgactgtactctcaattttgtttgtgaaaatatatctcggtgcaactgtaactactttgctaagccaatactttcctgaaccttctccaatggtcacactgagattcttttcatatcctcgcgtattacatggaacatcaacgttaacagattggcccactgtgtcaaggccaacctttctactgacttcagaatctgaaagtcgtattgtagctctattgccattccagttgtctctatcaaaagagaacatttttggtaaagccttctttaccaatctatgcttatcagtttgagaatcgctaacaaaagacttcatagtattatagccctcactcaaaaacagatcttcactggttcgattcaacaccacgtaaggcgaaaatatagttatctttacccctgcataatcactgtgaatctttgaatagtgcaagtttaagtgaagcctttgtccgtctgtacctctggtcgttactctggtttccggtttgaagtcactgttttttggtgaattgatgatacagaaatcagacttgtctataccgcaatctaatggtttcaaactcaaaagcaaaaagtgatccaacttgacaacatgtacagcgctagagttgccttgtttcaaaaaatttctccaatctttctttgagctcttgtcgtaaattctataagataagtcatagggtagtaagttaataagctccaatggtggcgaaataacaatttccatttgaggataaacttttgctaaagcatagttttcgtttacaatagcataagcttggaaataaaagtttgctctttcttttccttcctcttcagtgcaagcaaaagatacagtctcattcctcaatgtcttccacgtcgtgctattgcttgaccaaccaaacgatgagtctaacccttctggtttaacaaaaatagaatcatttaggacattatcaatcgggatagcataagtttcatcaggattgattgtgaagctcttctgaggaacacttgacttcgggtcagagttaagaccgatacggatttttacttgagtagtattcgtgactttaactgtggaccgaattacaacatgcttcacgctatcttccccaagggtgatcgttacaactaaacgattgtgaaaattacctcttgctggctgtaatgtgaatatttcttctcctatagtttgtaacgaaacttgctgcagcttttcatacggggaatcttccagctcaattccaatgaaccctttcatgctatcaactgaaagagattcacgcaatgttctccagtcttcaaatacccaagaaacctcatctccattggcaatagaggtgagtctgttcgattcagacccttcaatccaaactttaatgttatagcctgtatggttgagtattctgtaagggctgttctcacctcgaggttgcagaggtatatcatcagtcaaaaaagtcgctacctggttcagcaatgcaagagatctagaagtcatcgtgatctcggctttatccgtggagctaatattcaccacaaacttgtcggaatctcctttggctaatttacgtgactttttaacgtgaaagcccaatggccaaggctcgatgagaggttcccatgctgaactcgaatagttgaatatgtttacaaatgactccaaatttgaaaaagcctctaggtctgtcgaccagttcttggcaactacgtcgaaaggtttgacattcatatcgagtacaggaagttcataaacatctcctatcaacacacatcgaagaccttcaaaatttgcaaccagtgattcatctctcacaacaacttgtgccttattcttgactttgtaggaacggactgacgtttgagaaatagtagagatgatagtcggagcgtattgagatagttttctcttgaattcttttgtgaaagaaatatactgaactccaggtgcggttgtggacttgtctggttctttatcctgctgtcccatcagatcaattgctttgttaactattgaaattgctagtcggatatcacgaacggaaagtctcaaaagaagggggtcaatatgcagtttgatgcttgttaaccgatttaattcactagaattacggtcatcaaccgtcaaactggttgaaaagttatccaagattctcaatctgttggtatcaaactgatccatcctgcacaaaaacataccaatatttttcaaagacaaagattgggtacgatgactatcgaacaacatttgctcaacattaaacacgatggcttctgttgtgtccagacttggatctgccaacagtataaccgatacatcaacaacattaatagtgaacttgaaggcttcctcattttcatcttgcttcacagcaagttgatcttgagattcaacagagacagattcagattcctcctcttcaggtgattcgttggacattgttgataactgaacattctgaagcgcaggattggcgctagaaataaacccagtatcaacaaaagatttcaaggcaactagataatcaagagcaagaatcgttttgggactgtcgatagccaatgtagcactcttgctacctgctttagagaatgctgaagccatgaactgataatcactatcttgggccgttgacaatatcttcgtaaacttgttgtccttaatttcacgagagtcttcaacgatgaacgaccttgttcgcagttcagagctaaaatcattgttctcttttaaagtgaacaacagatgagtgtcattgagagaaatctgggaaagagacgatttatccaaagatgttaccatatcagtatgatcatatatagtgagggcaatttgtgcgacatcaaatgtgaaatccaacttagtatgatcagatggtataacttctttctccgcagatttaggttgttcttcctctactctttccacattagtgcctctaatctccttattcatgttctcagcatcatttctcagtgcttcaaaattctcatcttcataatcagaatcgaactgaaacaccttaggtatcacagccatcaattccatgatatagcgacattgcaactcggtcaaattcatctcgcttccttctaatccgccgttcacaacacatattggtctctcttttatatattcatcgcaatagttcagatgaagtttaagctcaagcttatctatgatctcaaacaattgctctctctgatctttagtgtagaactttgaggtcactttagtagatcttattcctagatctataagttgaacaacatttgatcgctcctcgataaacttattggaagcgtataattctcctaagaaagcagtaattgtctcaaaacgatcattcgtaggatctatcgccttcggcaatacaactgtaggagccttaataagaacatcaaatagtatttttgtactattgtcgatactgcttgcctggttcaatgcggcatccctagcattatcgtagatgtacttcatcctctggaattgactaaggaactttattatgttgttgaaaggaccttctacgaaaacaattttcatcgagcccgtacggagtttcaatgtagcactgtattctttggagtttatagctggatcaaaggtttcatactccagttcggcaaggtcattaccctcaaaacttatcaagtttcttaagactgaagatctagaaacaccttcattaacttcgtcgaataaagaaagtcctccaatttttgcgctgaccttcaacctttcggggaagactacaataccaatatcagcttcacttaactttgttgtggcaagcttgatcccatcatcgtttagaacagcgattatgctatccatcttgattcggacgtttattgtttcaggtgctagcatttgttcagtgtcatcattgtgtcttaattgatcggctggagtttctggtggattgacatcggtgaacgtattcagagcgtagttcagtagtgttagaatggaccttcttgtaataacaaatttaacgtcagcgatgttcaaatcaatatcttggtcaaagcagataatttgctcgccattcagaggtacgattctctgagttttatcataacttaaagtaaacaggttgcccctcttgttgactacctcatgttcctcaaaattatcggaggatagtagatacttgaactcgttttctcctgattgctcgataaagtcttccacattgatgtctaatagcgaaagatcaacgtgaagctgcttagatgttttgaacagatccaattgtactttctttccgattatacgaatcagtgtctcggaaacaaacgttgaagcgtcgtcgcatctcaacaatgaaacttcaatcgtgtctagagtaaagttaaatacaaacaatttttgggtagacaccgtaggcttgtcgtctgaacccgcagacgaaacatcatcgggaacctcataactaaacttttcagtagattcattgttgtttgcaacgctaaacccattttctttagtggtctcagcgtcttcggagatattatcaaggtcaggaatcgcattttcaagcagttgcatgatcactttgtactgaaagttgttgagagcaactctgaatcttggaacatctcccccaatcttaaatctcggtaaagaaatgacagattgagcaattgaaactccaagcgaaaagttcatgtttaaattatccaaaattgtcgctgacacattactcgagtttccatgcagctgtgaaatggttgacttgatgttttgtccaactaaaacttgagcatcctgaattttcaaagtaaacttatcatacattaggtcctttaatgttttccagtcattgtcatcatactgcttggaaaccttatccgtgacttcttgatattttgacggatccactaaatcacttgtaacagaaatgtgtcccgcgtctaggactgccactggggatttccaactagaaggatccaaaggtataataatcaagggtgactgcatattcaatttcaaattgattgttttgtgctcttctaatgcgtactgtagtccaattctagtttgcattgtgaaatcttccaaagttgattctgcagcattgattatagcaccaaccgtctctaaatgaatttttggaggtgtaaaaaatcttgcaacatcctctatcagtttcggattgtggaaaattgtcatacttttcattctagcagttaatgatgaatcggcggatccatccaaggggttattttcaaacgctagttggaaaaagggttctcgtttgccttcaggggtgtgtgcaaccacctcagggtctcccaaaggtttaacgttgacaatatgcttgtagagtgtattttcagtaccatcttctacgcgcaattcatcaagctgaaatctggctaaaaaggagtctgggcgttgaaagaattcggaatagcaaccttcaaatactacttcacatagattctttgaggtttgggtcctcttaattgcgagaaatcctttttgtaaaactgaagatacctccaatttgacgcggtccttcggaatttccacagcttcggtaatggcttgtttctcgtcaaagtcaatcacatcatagagctcctttctttgttcttctgtcaattccagttgatctttagattcgtcgacttgggtgtcctttttggaaggaccccatatcattgataaccaccctccggaagtatttttctctgtttggtttgacaaagtgtttgaaggcgaagttgccttttcctttctgaattctcttcttgcaagagatctataaaaccttatatcaggataagacagctcatactcgagtttttcgaattgttcaagtttgtcatctataagttgcttcccttcaagcttttccttccataatttaatgtatagctttctttgatcccttctggactcaaaatatttccaggaccatttgcggttcttctcgtgaacctcttgtaaaatgcatttggctgtatattgcatccatttcaatggatcttccttgacagtacatttgggtcgcaacttgcggaatttcctagttttcaggtacaggtggtattgagatgcagtccacaaaaaatctctgtattgatcaccatctagattaaccccgaactcttcaaaaaacaacttcaaagcaacatgaggagccgtttctgttgttcccactttattcaaggttacatggcctaatccagagactggttctagtatgtattgatggtctgatctgttgtccaatgactctttaaaccttccgagcaaaacttcaggatcgggatctgaaatcgaagttgtttcggtattccaataaagagcaaacgagtccaaagtgagcaatttgtgcgtgtacaaagtaatagaagatatgaagttgggtacccaattggaatctgtagacacagcggacaattcaccaagagtaaaaccaaccgaataaggtctgttggtaaacacatcaaaatcttcgtatctaacatggatgttcttgatcgtgacctgaacgttatcagtgatcttcgtcagtaaactttcaacaaaagattcattcttctcaataccctgctggtccaattccctttcatcttcatcagacttcataggcttggagttggccaacatttccaattggtccaatttgtcttgtttgagcttctgcgcccttctctcttgctcttcaggatcaaacttcgaaggatcatttggcgtggccagtagataaacgctgtcaataacgatcttcacaggcttgctcttcaagtttgaccatggaatctgaagagtaagctctccaagatggccaaattggacgtcaatgggcaatcgaagctcatcaagggactcttttcgcaatcttagatctctcagcttgacatctccactccatattccaatgttaagcttgttattgtcaaagttctcaatgtaggcgccaataaacctgttaaggatgttagctgccaaagactccaacatttaaaggtgataagaagggtcaattgctatcggcctttaaataagggaaagccaggataaatgaggttaaaacaatagggggaagcactccagaaggtaggtcgcgaaggcggaagaaggcactcctagccaagctgttgcgccgataaagcaatcacatctccatacaatagccattcatatatacatacatagaaggtagagggacaagatatcaaggaataaaaatgtgtcgaactcattaagttaagataaaatttgccaaaaaacataaaactgacagctcaccaaacggctgaaactatgaataaatagggaaccccgtgcgttgaagtcataatcatttgaaagggttggctgctgtgttaccggtggttacggtgtcgatggtacgagcatcgtgggttatgtgagactccaattcagcagaagcggtagaagcgagatcgtggttgacaccagcagttcctgcggcaccagcaccagttctctcggccttggaaccgaagtatcctcctccaccaccaatgttgagaccttgcttcttctgcttgttaatgtaccagtagacaccaaatccgacaaagatcaggacgacaactggaatggcaacagcaggagcaatcaccttggcattgttagaagaacccttactttttgacagtccgttgtcagatggcactctagaaattgcaaagtcagcttcgctcttggatgtcaatattctaaccaatggtccagatttggtaccaacgtaggtggcttttgtctcagaggtggtttgaggagtgatgttcaggaatccccatccggcactgccggttctcatatttgaggccttggattcgaagatgtaataaccgtcggcatttgagatccagtcagttacaaacactggatcttcgtcatccttcaaaggatatgctctaatttgcaacttgactctggtgatatcgtcccctccccagtagctagggtcccaggtaatccagtaggtctcaccaattaagaattcggtaccgttttggacacagaatgggtaagccatggtgttgtcaggaggaactctatcgttcatacaacgcaacactgggggcactgcatctggagttgggaaactagaagcggatggagtaggagaagcagaaatggtagtaccatctttcacacttggggtaacaccgtaaggaataccagagctatccaatgaaacccatggggttgcagagttggtgactggggaggcggacagggttactccatcgataacggtgggagtgatcttctcgttgttagtcgtcgtccagattttatcggacaagacattctggttggaaatgtccatctgacgctttggatactgggccttagctgtaggctgaggaacggcagcagcgtagataaccgatggcagggcaactaatgtgattaatgtgttaaacttcatcgtatattacaactttaaaggaagaagaagtgaagacaaaggaaagggaaaaccaagtcaattgccagttatatattatgcatgatttacgaaaagttttccacaattggagttggttaatggactgcattctcctatacagatggatcagataaactctctgtccgataaatcctttaaattttagtcttcaagtctcttttgatactacatcttttttttatctagagcatcatgctactcaatatggcgaggaagagccaagaaaaaatgaaattgcgctgagccaaggggcccattagaagttgcagattggttgcaatctgccccttaaatgaccagatgacaggaggttaggcctttgacagggtgggaagatatgatggttcaagggttcagcagttgctcctcgggtcttgagggtttgcatgaagaccacatgatgcgcgaattagatatgaccttccaagagttgttcagttacgagggaaacgaaaagaattgccaggggttgtgggggaaggtgatctcgcatctcgccctgtaagtttaaagtgaattttaaactctgaaaaaaaaaaagagtagcgccggatggtttcgatccatcgactttagggttatgagccctacacgcttccactgcgtcacggcgctgaacagtgagaagtatttgatgtgcgaatgttatatcgtgggatgattttttcgtcctggagtggatgaaatgagaattctagacgttaaggcattactcgctttgcttcagttaacttgaggtgttttttatgacgttctgattcattgatttttatttccgaggtcggggctggttagatagccaataagctcagtagattttcactattaaaggtgacgggaaatttcgtctaggtcattgagtctcatattttggatgtaacaatttcagtatagtcggttaagagtagtttgaatattcttgctatccactttacgtagagcaattgttactaaccattgagaatgagaatctccggcattggcaataggtaattcaacgaggatggcttcaactatctaattacggcatgttgctaacgggctattcaagagcaagtcagcattattggtttaatgcgatcaaacgtttggcactttacttttaactggaactgactaaaagaggtttatcagttgttctacgaaaattttgaaaaacttcagatatctcatgtcatggttgaattgacattagtaataacaaataattatcacacctttttaatcttctattccctgcacttggatcaagcaaaattactccaaagagggattgtcaggttaccacccagtttatggtctgataacaggtttgagtaaatcaggccagattttgcccaatttctgtcccttcaagtaaaaaggtaatcatgaaattgatgatcaccaacttgacaaacactgttccgtttaagcgcctgcacgtaaccccagattctttactaccgattggatttatctgatctatgtaaatccgattttcaaaggttcatttcgagccgcacatacattgaaaaatataccgagggtggaatttctttgacccacttccgcacattgacatcattcaaaaccccacatcaataaaaggcccgaagaacccacaaactcgggtcttccaacaatatgtctgaatacgaacaagttttaagctagtgagtatccattcccctattttgaagttcattactaaccttcagttggtccccactgaagatcgacctgttcctgcaagttcgtggactcgaggcaccagttggactcaccaggaaagaactggtccaatttgcagcaactaagatcgaagttcctattatcaaaccaaaaatcactgctgctcttttggagagcttggtcactgaagagctcatagactacctggcaatcagagactacgttgttcttcccaaaggaagacctttagttatgattcctgaaaacagatctcgtggcactagagatgctattgtcaatcatgctctcaaggactaccatgagtgttatcttcatgagactgacatagagaaagaagaggttcaagtgaagcttggtgaaattcttaccaagacacgtaagatcagcaagatagcccctaaggatctgtctatgactcagtttacttatagaccaacagatattgatttgattttagaggcatttggggtgaacaaaaaaaagcacaccattgacgatccctttttattggcgcaagagtcactgaatgtgttttcaggaaacgtataaccagaatagttaattttgcagcgcacaattactcgcattatattagtctgtagttcaacgaatgcgggagtcactgattcaatcttccttgctggttttgatttagacccgatgaaggagagctagttgaacttgcatccttgaaggttcaaatgtaattcacaactacctttatgtgttgattgagagtaagcagcctgtaggaatgacatatctttgtttataattaactcagttgtgttcatagaatcgtcattgattcttttccccgaacagtaaacgaaaggcagatattatgataatatggttatgtttcgttatagttagcacaaatctttggaaatgctacaggataagcttgacagaatcctttactgaaagctgatgacagagcatgttaaattaccagataccagctcctaggattcttgcaatatatatgttactcttgaatggctttgctcttgttcgaaagttattgaggccaataaacctcgttgatttgtagtcacaaacgaaaatatgggtcattatatgcctataaaaggagtctgagacgttagctatgtgtatagcgtcgcaaggaattcgtcgtccgaattatatactatgcagtcttcacttccaagtcgccgcaccatagttttatgcgtctcctgcgcttgtcccccatagcaaaaaaacttatcatacgtccggtgcggaagttgaactttgaaattccgacgtcgattattacggggtcaagtagtcaaccttgagctattatttcttaaggctagtagtgattgttcaatcatagcattgaaattgcctcttactgcctcctgaaggggttagagccctaataatctatactttctcaagctttagatgatcgtcctgtttagatgccatgggcgtatggaaaacctgttatagatactagtaaaattgcagtattccataatttagtttcgagtagatggtactctttaacttattaattttgaaatgacaaagattacatagatgttcacttatgtgatgattctactctcttgaaaacttatcattaaagcaatgacataccaatgctgaaatgtcaagaactaagcttttacggttcttaaaagactactttcctatagagtcaaaagtcatggttaattgtcaagtccttgaacaaaataattcataccatatgacccactgcagatcttttctttcggttgcggccatatctagcagaaagcaccgtttcccgtccgatcaaccgtagttaagctgctaagagcctgaccgagtagtgtagtgggagaccatacgcgaaactcaggtgctgcaatctctttttattagtagacgaagctgttctctttttgcttcaataagttgcggagtagctagattttgcttctttggtgttcaaagcaaaagttgcctatgagtaatgaacttctcacttgaacgggactcaaggactggaatacccattttttaactacattccaactagttccgaacaccatctagaactgtgccttagaggatagcagttctgtctatcaacacagcagtaaaactacttcggaaatcactgcccttcataaaccaagttacctttcattcctttgccctcatcagatagttattccctgtagttctctctaccactcaaatcccaccattctcgattctccctcccagactcctcccccggaactcccctaccaactctcctaccacctaccgtccctcctgacaatcgcgactttcttctccaaaatctctctgattggccaacaggttcaaggggaaaaaccagaactcctacttcgacattctcaacacctatcaacaacccagacctttcaagatgtcttccgttgccaaacaagccgccactaaactcgactgggccaccatcatctctaaactgggattgactggttccaccgccgcttctcttacttccttcaagaagagacacgatgaggctcagagagccctatttgaactcaagcaacaacctaccaccgttgacgttgaattctacaagagtaccttgaaaaaccagaagattgtttcccaggttgagtctgatctcaaagctttcaagccaactcaattcccattggacaaacaattgaacttgatcaaatccttcgaagcaaaggctcttgaaaatgcaaagaacaccgaaaccgttgtcttggatgagttggagcaactttctgctactttggcaaacattgagggcgccagattatttgacgagttgactgttgatgacgtcagaaaggctagaccagatattcaagagaaggttaactccatggttaccaaccacagatgggaagttcctggctacaaggagaagtttggagacctcactattatgtaaggtgtatgactttttaggttacacaataacgattagagtagaactgaactgtagacggagtgaaagaacaggggatactgagtgcaattggtggttctctgggtagatcgacttcttggagggagatgccagattacgaaggaagtatcgtagaggggaattcccaagacacttgtgatatctaagtagcaccgtaattcatcatatctgtccttgctactgccaaaagttgatgtttgtcagctgtctagttttctcaatctcatcccgtcattttttctccagactcttttctagtcctgtttcgatattccaaggctacccaaatgtcggcgtccaggttatccaaatcttttcaggattcccttcagatcgaacagaaggaagactcggacacaacggctcaacttctctcatcattgagtcccaaacagcttcaatccaaagggctcgccatcctatcacttgagatcaccaatacgaggcctggatacggtggtaaaaccatcattgaattagccaagcattccagtaccgtgggatcgaaaaggaaatcaaagcaaaaagaccaaccagatgagtctttggaattcggagattttaaagtcggtgatatggtagtactggacagctaccaggcttctgactacaaccccaagaaattaaaaaactcgtctaagaagtctgatcaggaagcacacgaagatctggagcaagttgacctggaagccgttgtggtcaagatgagaaagaatgagatacatattgctttgagctcagattccaactcgcagtctgtttcaagtataaagattgacgaaaagctggctcatctgaacaataatagcatgaaatgctggctcgtgaaattgtcaaacactataacttacaaaagaatggctcaagggctgacgaggctgagtgaagtaaattcagactctgctcccgagttgattcgtcttcttttaggcgaagaacagttcaaagcacccacatcttcagatttggtttctaagatggaaaatctgacctttgaaaatgacggactcaacgattcccagcgtgaggccatcaactttgccctacaatctcccataaccatcattcacggacctccaggaaccggaaaaactagtacattggttgagttggtcagacaattggtaaaggctagaggtagctccagcaaacgaatcttgatctgcggcccttcaaacatatctgttgacacaatcttggaaagattggacgatttatacccaaacaaggcggattcaatgtctaaattgatccgtgttggtcacccagcacgattgttaagttccattctcaaccacagtttagagctactcatccaaggctcagagtcgaatgagattctcaaagatatcattaaggagattcaagatctgatgaaaaagtctaaaaagatgaagagttacagagaaagaaaagactgctatttggatgtcaagaaccttagaaaagacctcagagaaagggcaagaaaaatcacgtcagagctgatcagaagtagtcaagtggtggtttcaactttgcatggagcgtcctctagagagctttttgacgctgcactcaattctcaagagggattgtttgatactttgattattgatgaagtgtcgcaatctttggagcctcaatgttggattccacttatggcccacacaggtatcaataagttgattattgcaggagacaataaacaattatcacccactataaagactcttccagaggggaagcagaagagtaaggtggtggacatacttagcaccaccctttttgaccggttagtgtccattcacggacaatcctttgtcaaatttttaaacatacagtatcgaatgaatgaaaaaattatgagattcccaagcaatgaactctatggggctaaattgattgctcacaagtcagtagctaataaaacctgtcttgatctgccttacagagtcgaagaaactgatgataccatagaaccattgatatggtatgatactcaaggtgacgagtttcctgaacaggagaccgaggaagatcaaggatcgaagtataatgagaatgaggcactgctggtggccaaacatgtcagaattctattgaaagcaggagttttgcaaactgatattgggataatttctccgtacaatgcgcaggtttctttcctcaaagagttactgataaacggcgatgaccaactaacagagttggaaatatcaacggtagatggatttcaaggtcgtgagaaagaaattatcatcttgactttggttcgttcaaatagagaaaaagaagttggcttcttgaaggatttcagaaggctgaacgtgtctatgaccagagctaagaagcaactttgcgtgattggagacatggagacattaggtgagaatgaaactacaaagtttctatctaagtgggtcaaatggtgtgaagaggaggctgatttgaggtatatcgatgtgaatgatctatatgagaattaggagttcattattcatttatcaaaagaaggtgtccaaagggttagggaagtgtcagctgaggcaaaacaccaaaatcttgggttgaataaggtgattcggggtaatccatggtctgtactcagagaagaaatcggagaaatgggcgcatttacggattcatcggtaatcttagagaggtcatagagtttcacagtaccatctccgttaccattcagaagaaactttccgtctggggttaacgtggaagatccactatcaatatatggacgttcaggcagagacactgaatccaataatttcccgagtatagtaccttcgaatgcgtccacaactactagttgacctttgccaaaagtcacaataattttagacccatcgttagtaaactctactttgctcaattttaacggcagataatcttgggggagttcaaatgttgaaaatggagcttgctcgtaattctttatgttgtaaagacccagttttttcgtttcttcattgactatggcaaagaccaagcccgaagggtcaaaagctatcaagttgggtcccttcacgttcaagttcccttgggcatttggtgaacgcaaatcccatagcttgactgtgttatccaaacttgaactcatgaaaattgactctaagggtgataattccagactgtttaccaaaccttggtggcctttgaaatatctaatgtatgtgttgttctgcagggagaggaaacggattgtgtgttcaactttagtggacgcatacacacagtgcttttcgtcgtgactaaaccgggctaaatgggccccgtatttttttgagtagattggtttgagatgctttcctttattaatgtcatacaattggattgattcgtcgatggaggacgtgagaagaaattgacccgagtcatcaaagtctagggacgttatttgaggactgtccttcgtcgtaaaattttttgacggttggaaagtctgcagaacttttgagcttattggaatactcatcactgcaatacttgatgtatgttatagagggagacagagtaaaacatgttgagattttccctggctggccccaacctggaagggcaccgcaccgcccaactgagagatgatttcgcgattatctcatatcagtgtctgcttcactatcgtgtgtccctccctctgtcacctctctcaacttacccctctcaacaaacaatgtttaacgtaagtgccattggtatcgaaagcactcagaggattactaaccaaagacagcttggaaagattttccactacacggtggatcttgtgttaatctctattatcttagcagcgctaagaaagaatacgggactaaggtaagttacaagtatctatatttgtactcccagcactaacaactgtttcaagcctgacagcctctgacctgtcttcgtcaaatgatggtcaaacctacataaagaaatacctaggtttcggggaatattcctacaacctcctggtgtcgtttgccagaaggtccagatggttcaaacagaggcccataagagatacaaacgacctcagagacagaatcaaacaagaagtcaatggattcatagatgatacctccaaatagctttaacaaatgaatgaaacgaaaacgataactaatggaattcactatcttcccgctggctgttatgcatcaggcctgttgttatacaccctaacaccgatgtgatcacttggtggttttcctcgtgcgttattcaggaggaatccgatctagagatttctctaaattaaaaaaacacttctactggcaagtgtctgctacacttcggcaagggccatggagaactgcctatatatcactggattcggtaacggggtcaccaaagacgagcttagagatttttttgaagggtaagtagaatgaaatatctggaagcctataaggcagaaaagttcaatactcaatcaagttattagaaagctggcatactgactccccaagaagctacggtaagattgctcgagtagacattctaccatcaagagatcttgaaagtactccttacgcctttgtgcagtttcaggaggctgcagactttgaagctgcccttgcaaagaagtcccatctctgcgatctggctgtcgaccctgagaaagggttgaaggtggagaaagcaaaaagtgcaccaaatctaaagcgagaccgcatgttagcgtctcgtagaaggtacggaagtggagacggctatcgcagttataggggtggatatcgagactactaccatgacaggtactctgatcgtgggtatcatgaatatagtagagacccccatccacgatacagaccatcggattatgacgagggataccacaggaacagctatgaccattattatggaccggaacccccgtatgattacagagatggttactataatgagagaagatcaagaccaagttcaagggaccccagagactatgatcccgattattatcgaggataccaccctcaagatcgccactactactcttcccgtgactattctagggattatcagagagacagaaaatatgagcacccccaagaccatgaagggaaggcctccactgcctactatagggatcgctacccagtaaggccctcgaggaaagacgaggccctaccttcaactggtccaccaagcgcagatggtaaatcaccagtcgcaaacgaagaacaggactcgtctatacgcaacaactagctctatatgataagtagtagtaaagataatgttagcattgaggtttgtggggtgatcctatcagaaaacttgagttcaaaaaaaaaaaaaaagaaaaaaaggaaaaagcttatgctcatctcatctcatctcatctcaccaatgaaggaacagaaagaggtgaaagaaaaaacaaaagatctggaggcagatgatgtctaccattcgatacagggagacgtgaagcaggactctggatatttttccagatttatagactcctttaaacctatgccgtctgatgaaaacgatagtgatatggatacaggcttgacggatgcccagagaactgccattaagacggccagaaatccaatgaaacagaaactaaagtcccgccatttacagttaattaccattggtggctccattggaacaggtttgtttataggaacaggttctgcactgcatactggtggaccggccgctgtgcttattgcttggactttgaccggaaccatgttatactgcacaattcaagctttgggcgaactagcatccacgtttcccagagttcttggtgggttcaacacttacacctctcgtttcgtggacccggcccttggatttgccgtatcgtggaactacatgctgcaatggttggtgttgctacccttggagttggtagcttcatcaatgaccatcaaatattggaatacttcagttcaccccgatatctgggttgccattttctatgtatttattgtcgttgtcaatctatttggagtgaaaggctacgctgaagtggaatgtgcgttttcattattgaaaatcattgccattgttggtttcattattttgggtatagtgttgtgtgctggaggtgcccccaatggcttgaataacggagcaaaatactattatgacccgggagcatttgcagctggcttcaaaggtgtctgttcgacgtttataacctcagcattctccctagctggaactgagtttattggattgacggcaacagagacattgaacccaagaaagaccctccccagtgctacaaagcaagttttctggagaattctgctgttttacatggtttcactgactatcattacatttttggttccttcgaacgatccaagacttctcggggcttcctcagacgccagcgtttctccatttgctatggctatcgaagctggaggaatatccggactcccatcggtaataaacgcagttattttaatctccatcttgggagttgccaatacctctgtgtatgccacttctagagtgttattgggccttagtgcctctggacatgcaccaaagatactaagttttgttgaccgggccggaagaccaatggctgccaccgccgtgaccctagtgtttggccttctggccttcattgccgcttctgaaaaagaagatgaagtcttcacttggttattgagtatttccggtatgagtgccattttcacgtggttattgatctgcttttcacacatccgattccgttcagccctcaaggcccaaggtcacaacgtggaagacctcactttcgtctctcaatcgggagtcataggctcctggtacggagtgggcgttaatgtgctgatctttgtagtgaccttctgggttgctctatttcccattggagaaagagccaatgttgagtcattcttcgagagctatttgggtttcgttgtcttctgggcctgctattttggatacaaattgtggagaaaagacttctctttctcgttcgtccccgtggagaccatggatatccagagcggacgcgtcgacatggacgttgaactcttaaaggaggaaatccgtcaagaaaaggagtttatcagaagccagccgttttactaccgaacttacaagttctggtgttaattgtacacccatagagttaagcttagtaatagaatacagtataaacgttcaccccaccgcacaccacaccacccaccgcttctcaatctctctcgttctagaagttgaacgggggtgacacaacggtgggacaagctttgatttgacccctgcacgacaattttttggaatcctaaatacacaggggtttcgacaccccatgctgcaagatacaccagtacaccatcaaacctccattcatcccccaaggtctcgagaaagaaaccggtgacatatgataacccgaactcgaccagtactacccattctttcttcctaccctccttactcacccctcttagaaaaggcaactttaagctatgtcctggaagttgaccaaccaattgcgagataagatctataggtatgcgaggttccctcctactggtgtctcgctgaggcagatggttcaatttggacccaagccctccgctggtactttgttccacgcgtcccaatttgtagtagaagagctacctatacgtcttgcccatcgtgtgaaagagctagaagaacttccagatgatttaaaccaaatgccatcgatacagagggtcagggattggtatgcaagaagtttcgatgagttgacctcgctggccgcccccgacatcagtgacgaactgcgtaacttgctttatgaggatggtcacaaccacctttatcagccagaaatgaatgaaatgcctcctaataacatccaagtgcaacattccgatacgtcgtttgacgatgacggcttggtcatcagcaacagacaccaccactctaaagcaactagtgcttcacagaaccaaagctccaacaaaaagaaatactatctaagctgcccttccaatgtcgtgtatccaaaagaggtctatgagtacaacaagctggtcgcagataccctgaaaaccatcaagaagagacacgatgcgactgtgcctactgtggccagaggagttcaagaatggaaacatgcaaagaatcaaatgagtatcgagtcgaatatacagtcatttttagatcgattttatttatcccggattggaataaggatactgatcggacagaccatcgctctgaaccaggatattggcaacgacaactacgtggggataatctgtttgaatacgaacgtggcagacgttgcacgggacgcaatagatagtgcccggtttacgtgcgaggagcattatggattatttgaggctcctaaggttcaattgtactgccctgaagatctcactttcatgtacgttccaggccatctcatccacatgctatttgaaaccttgaaaaattcgttgagggccaccgtagaacaccatatccaattgaatcccggcgtggatattgaggatattgaatttccccctgtaaagatcatagtcgcagagggaaatgaggatattacaatcaagatatccgacgaaggaggaggaatccctcgttctgcaatttccttgatatggacttatctttacaccacagtggaagagatgccaagtctagaccatgataccgatgcaaaggctgatttcagagctcccatgtctggcttaggatttggacttccactcagcaggctttatgcccgttactttggaggtgatcttaagttgattagcatggagaactacggaaccgatgtttatctgcatttgaatcggctgtcctcctcttcggagcctctcccataatgaagaattatattttaggttgattggtatgaataaacttatgacgacataatcattgtagttctggaattttcaaacgtggggtgtgtagaaggttaggtgggagggaggaacgaacccttggtcatcctttcctgtaccccttatctgtgttcgctcgatggaaggtagtgtgcgtggaacttttacccctcctagcgtgcccgcctagaatgtcccccagactaatttctcgcctcgcagctcatcaccgactgacaatacgcatctatagctagaaagccaccacaatctacactcaggcatacaataccctattgccaacgcttagaagagcacattaccatcaaatggagaccaacagggctagtgaacactccattcaagttcctcctggagtttacccgctcaacgggcatgactctgtgaacgaaggtcccaaaacagagcttatctacccagatttcaagatttggcagcattctccacaagatgacattataatgactagatatcttcaaaagggttttttttgaagcgcctgtggtccaaaatgagtccttatctgctcgaagtctgatggccgtgagtctccatgaaaactccaacgagcccaatgcatccgaagagcagacagccaaggctccgaatccaaagataaagcttttaagtgattacattatacaagcaattttccaaagacgacagttgagtaagatacacaccaaagtgatagtcagacctcctccaagggtaactctgaccgaacacaagagagaaaaatggatggaaaatttggccaataccagaatccctttgtcccaattagctagagctatcccccatggtatcaagaaccgaatactgctggagcagtgctgtctgtataatgttcctgttgcccgtgctgtctggttggtcaaatgcgtggcaggtaacgaagtcagagtgttgagaaggaaggtccagcagtccagcaccaatgctctttccaccaacgcaattttcaatacctggctttctgattggaccgaccaggttaccaactttttagagcggttcatgattagcatatttactccaaatcaaaaagattggagggaaaggtccaactacaaccttactttggtaggaaatctcttcatggaagatcttttgagacaagacaagttcttgggttggattgtgtcttttttgcgccaatgcttggttaagttatcctctggttcgaaagaagagccagatcatgtatcgcagggattaaacttgcttaccattcatttggtaattctacgtctgttctggttcaaaatcctaaaatcagatcacatatcaaaggaagcaagtgtggtccttttacaattgcatgccaaattagtggacaaaagtacactccagtcgggaaactccccgtcaacatttatcatcgagctcaaggagaacattaattttttgatcaagtatcttttctattacagtcctgatgctttcatcattcccaactattggcatgatttgaaacacacattgaagaaaattttggacacttctaacaacctggttcgaacgcagttcaagcttgtaacctacaggaatgaatccctaattgtcaatctgccgcaatctttaaacaaacccttgaacttgaaccaagatgagcctttgcagagcaacagggatgatctcctcaaatcactggatacgtttttttcctcctctgattctattggcacgttgacgtcgttggtttttgaaaagatagacgaagatgaagaaacagagatcaaaacttttgctccagacatagaacccaatgaaccagaggcctctgagacaatagagatagattcgcctattaagaattctcccattcctaataataaagaagtttcacccccaatcacaaccaagaaaggaaacaagaaggataccagaaagttatggagttacaatttcagactgttgctaaattggtctatatcaaattaccgaaaccaaagctcgtctgttgttcaggtgaatcttgttgtttctattttagaacagaggctacgagaaatttattcaaacacaaccaatcttagagccaaaaagttgaaactggaaattgagcttgagctattggactggatattccagattaacgattcttacaatgttttgaagcagaataacgagacagaaattgtatataaactagagacattggaatatctttgtgcaagatgttaccaatctggattgttgactgtttcatcttacataagaaaacttatcgcttccggagttatctatcttccagattgcttcaaaaatagcacaatccacagcttagttctgaaaagcttacctgttttgaagaataataatttggacaatattctaagaaagctctcaaacaaagaggaaccgtatgatagtgccaaagacatcttattcttcgaagaagcaaaatcaagtttgctcccgtttatcgaatggattgtcagtgattttgagattaaccttgatcctgtctggaactgtttaaagtctctggatactaaaacggctatattagtctctgaatggtttatgagtgagacttttcgtcttctcttcgaacgaactgcaaacaagaaccaagtaaaggttacagagaagaaactaagtttaataacctacgcattggtcgaaaaattaaattgtttacctcagttctacgtgaagctcctgcaggcatttgctcttgagttgaagtcgttttcaatagataaaatgacaatgatatttatctccgagattatccagtttcacgagcaacaggcggctgttttttccgccaaggaagagactaatgcctatacgaatatgatcaagtctttgtttcaggtcgtcgatgagggtaagtatctgatcaactggacagtattcaaaccaacactggtcaatgataaaaatgttatatcagagctttctaagaggattgaactatccaaaaagagttacatcaaggacttatccaacctctatcaacttaacttacgttcatcttcattcttactccataacatgaattccaaagttgagaatttgttgaatttcaacggccttgtacacaacacacacacattagcgggtcgactatgggatatggtcaggaagaaatctttcactaacacagatataccacccgaccagtatgaaagagacctcttccagtcgctgaagctaatgaaattggaaaggccgaatgatttggtcaaagcagttctagcgtatacgaagaaaaacgttttggccacattgtccttggagtacacatcgataactacttatattttgaaactctttttgaatgaagttctagatttggaacaactttgggacttattcagcaccgttaacgatactttcactgacgtcagctgccagaagtttttgaaaggactcatgtttgataagtacttctcagacattgagtgtatccaattgctctcagattttgaacttttgaaattaaagatggttcgttctaaggtgaagcaaacggatttcaagtcatggtgttcaaggatgaggcaatgcttactagaaattgactcaccggaaacaaacaacgggagaacaaattctacccccgtttcaaccgaactggaccaactgcccacctcaaccacaaataatttgcctactccaatgcagttaatgagcactccaactacagtaagcaatttcgatagcatgctctccacgacacctttcaacagcttcttgagtagattcaaagacgaggtcatggagacgtgcaaggagatgatcaatgttcatacggagctttctataaagttttttaacggactaacctcttccttgcaaggggagggtatgagcataagaattctcaatcaacttctgctgcaaaacgatcaagtgatcgtgagttgtaatgatatgtccaaagtactgcaattgctagacccattgaatttgggggtttgccaactattgaccaagaccttacatgaaaaggcttttcagtacaaaagaaaaaagaactctatgaaccacgaagaaaagtccagtttaatggctgatttaacgctatgtttcctgaaagacctcatgaaaatgccgaagtaccaacattctgaccacaaaagtttggagttggtgggagaattgtttagattcctggaacctgatttgaaattgctgctgctgcattcatgcgagctgttttttcttacatccgagatgttcccgttggtaaactccagggaagataatccgggagacaacacactggacatcctttaccttatcatcaacagctgtactagatatgaagacttattttcattatcgtccaagtaccagaacggaattccaattccggacaatcttgttttttcgttgactgtgtcactggagaaaatgatcgggaaatgcgcccggcccaaaagaaagcttgataagcacgccgaacaaaaagcaatcgagtcatccattctcttggtgtgccggatcattctgattcacaagggttacctggtcggattaatactcaaaaggtctacaggtaacatcaataaagactcatttttgcagaatttggtgaaacttttcaattcgaagttcatcaaatccagctctaaactcgagaatttactgtatgacataatcgtttctatcaagattttgattggtgagcacataggctccaccaatcatgagatactgaatgtttcacctccggattacagcaataaacttaattaccttttggagaatgtttccttccaggacggcttgcgtatgagcaatgacagccaagaactattcgttcaaaacacgaagaccaaaaccttgagcaagttctacattcgcccttatgagttgctgcccgagactactacgaagatggaggagagctgtatcaacctgcacctgttcaatgcatccacagaactgaaaaatcctaaatgaagcggagaaaataacactgagcagcgatttggcgaaattattgaggctgaggctgccgatcgtccagtgtgtgagtcgagaaatgtgacagattttttcaccttctatcgttatgcaatgttatgcaccaggcgggggttataaagaaataatacacagcattgccccaaaagctaaccaaatttggccaacgcgataggatgatcacaatctcctagtcggacttggcagatcgcagaacaaaatttgttcccctatctcgtttcagagtactcaatcgcttacgccagtgtcaaaagttccatccccaaattcattcccttatgagtgatccgcaagagcagctaaagaaacttcaagttcagatcacccagtccaaaagagaaactaaacaattgtacttccatttggatcgagtgctcaaatcatgccaggattccaacttgacgacagtttatcggcaacaggtccctaatggacctccagtgagatttgataactttggactgtaccatgttctaaggggacacttcaacaagatctctcaaatacgatggggtccagctgactcgtactacctactgagctcctcgcaagacggattcatgataatatgggacactttgactggctacaaagtcaaggcaatcccgttggatgttcaatgggtgctcagttgcgcctacagtccagatggtcaattacttgcatccggaggtctatccaacagagctactatctacaactttgagtcaggtacgtcaaaggccgtgcttaagggccacacatgctacattagcgacatgggatttctaggaccggacaaattgattactgcatcgggtgatatgaactgcattctttgggatgtcaatcgtgcaatacaagtcaatacatatgttgaccatttgggtgatgttttaagcttagctgttgatcaaaagaacggtcgcttcgtcagtggtgcctctgatggctatgccaaagtgtgggattgccgatcagcctgcccggtttaccaatatgtagtgggtcacaacgaagtcaccgtcgttgaacaactcacggatcacctatttgctgcaggcacggatgatggcacaatcaaactatttgacatgcggtcagatggggaaatcaatcgatacaaccccccatttttggcatccactgtaccccctgccctccaccagaatcatcagggggcagctgacgattcgagtgtgaccagcatagccttcagtagcagtggccgacttatgtttgcaacgtatgctgacaaaggttgtgtggtatgggatcttctggcaaaccagctattaggagagttgagtggacatagtaaccaggttaaccaagtcagggtcaatgggcagggaaatggtgttgccaccagctcatgggactcaactatcaagatatggggtgccacgtagagagaaaggtgttctaccccttaatttttaatggagagtgatatacttaagtaaattagtaatatggcgaaagcatgtctattcagtatatgtcattagttggtcgtaacctcgtggatggcattggcaaggtagtcaacgttttgttcgtagataccagctatggagatacgtccgtcagaggtcaagtaaacagaacgctcaatcaacttggcaacctgctctgggttcagaccagtgtaacagaacatacccttctgttgcaacaaatgggaccagtccagggggttgttgtatttgtttttcaaagtgtcgtacagcaactttctcatggaaaccagtctgtcactcataaccttgacatccttgagccattgctggtaaatagcttcatcggagagaacaatttcaaccagcttggaaccgtgagatggtggagatgagtagatagggcggataaccttctccagctgtgacttaacgcgcacagactcatcagcatcgctggtgatcaatgacagtgagccaacacgctcaccatagagacccatgttcttagcgaaagattgagaaagaacaaagttgtctagtctaccgtcgacaacggctttgttgaaacggaacaacaaagacagatcatcaattgggttaccagatcggaatccctggtaagccatgtcgacaacaggcaacaacttcttacgtgacaaaacatcgatgatctcatcgaactcctccaacgttgggtcgacaccagttggattgtgacaacaagcgtgcaacaaaacaggttgtccctcagcagcattctccaagtcttccaacaaacctttcttatccaattggttggtgttgaaatcgtagtatctatacttgcttgttgtcagtccggagcgctccaaaatggcgatatggttagcccaagttgggtttggaaccaggacgtcctttggtccctcgtggaaatatttgatgaactcagataacaccttcaaggcaccagttcctgaaatggattgggaagaaacaattctgttctgttccaataattgcttaccagctggatcattaccatacaaagtctgtttgatcagctcgttgaacttgggagaaccagtgattgggacatactccttgttgacctcagtcttgatcaagacctcttcagccttacgaaccgaaggtaaaatccatggcttaccattctcatctctgtaggctccaacacccaagttgatcttggagggattagtgtcctggttgtagagcacagttagacccaagatcttgtctgcaggagctttttcgaccttggcccaagcagacacctgtcttagtgatgatgatgagaagaatctctttcctgaagcaagcatgatgacttgatatggtctgatttggatgaagaaaagaacaaggggttcacgaaaaactcttgggcgttgagtctgatatttatatgcgcgcttggctagggaggggatatggcgcctattacggcggttgggagggccaagcggctataatcgggtgggttcggaagtatttaggcatgctgcggattattccggtagcctacagggtttccatgtgatgaaatatagggggaaccgggggtgacatcgcaccccgggtgagatttttcagatgatgcttataaactttaaccccgactcttttcgtttcttgaaatagtttctccccacccctgagtcattcggaaagcaccccccttacacccccctagacggtattctcctgctagtgtgctaacgcctcggtctacttaactattgtgccccggaacttcaacataataagcgaggcactaataaattcagcatgatgtccatttctaaacaggtcctaggagtagttggtctatactatgcatgggacacagtgaaaaatatcaaacgtattctgcacccggacccggccgaccgtagcggagtagagctgtcgtgtaatagttcggtgttggtgcctgcggtaataatttacaacttgtctgttatgagcaagtggatagttggcgtagcgactattgattatgtttatgactcattgaaggatattattttctgagtgttctatagttccagaaaagacgggtcttctgccaaatatttcaacacatgcactcctcggtctctcatattccagccttgatgttggtgtagaaccatgctggagatcatgctctctgccaccagatctactggcaatcctccgaagccggttgccaaaccgggaaagataacgttgggagttttcacttcgtttagtgccttccagacaatatcaaatatgaatcgtttccagtgaacttcgttcccatcgtagacatgacgaggcacgcgcatagtaggtatgtgtaccaccgtatcacattgcaattggcgccatcctcgggtggcatgggaaaaggtgatgttgtttagatgttgtaccggtatatagccgttgcacttgatcaatgctccggcgacgcattcttcaaaggatggctccagggatccagggtctgtttgcagcaattctcgtattgctacatcgatacctccgccgaaactcgcaaacgaattgcctggggaaactattgtagtgggggagtccagccgaagttgatcgaacgttccattgaaaacctgaaacggtatgccattgttggggtgtaaattggaaattctctggatttctttttgccacaaggagcagagctctttgtttagatccagaagaatgatcttttgaagcataagttagggacggaagtgatggatggaatctcgcagcagagatttgagttatctattatgataatcgcgcacaattcaaatagttcactagtaaactccaatcagtgcaaggcaacttgcaccttgatggggaataaacgtctaagggcttggagtctttgaagctgagagacagtcaaacaggaatagccatctacaacgcctttttcaagtttgtttatccaacccacttctctagtcgacctaatcaatttatatatatacaccaaatactctacaaataaatcctaggcaccaggaatgctgcttctgttggagtcactggagtctctaccaccaacaaaccattggcttcaggctcaaaggtatcaacatacagcagaggctggtatttgtctacaacccagaactggctattatctacttgaatgtccttggagctaggagtaattttttctccatctgctcccctcttgcgatcaacttctgagccaatcttagggagatcgtttgccaggttgatgtatgccaaccaattggtgttgtatagccagaggttgtctccgttcagaaccaaaccgagacatttctcaagaacacctcctaatgcatgacgagtgaaatctgtgttacgcttgctccagtcactgaccactccttcctcagtatctatagtgtattctgccacgctattatcgtggttaacaactattagtttgtggtcctcgtggaagacactgtgtagggcaattaaattggatggcttaaccagcttcgaactcttcaaagtgtccaggttagctatttcaatcaaaccattgactcttagaacagatgccagtttaccgtctttagagagacagaggctgtagatgttgttcaaaagagtctgctgaccttgaggaattctagtaccattaagttccacctcttgtaccgagtcaccggattgatccacaaaaccgtttgaatcttcaactagagattctttgatcttgtaaatgtatagttcgttgtctggtgatacgacgattagctcattgttctgatcattaaacttaaccaaacgtgcacccacttcctgaagcttctcatcggcaaccttttgaatctgcaatttattatcttcattgaaggcaagcttgaacactttgacggtagaaagacgagcgacaaccaagaattgcccgtcagaagtgagatcacaatgggtgatgttgtcctcatcgcttaggaccagtttggctaatagttttctgccttgctgaggaaggactttccatactttaatggtttggtcttgccacatgatcaccagcttctgggatttattgaaaagaacagtttgatacgtttcagggaatactgacagtctttgaatttcgcagtcttgaaacgattcaggcttagaaacggctatgtctgacaatgatgctccagatagtaacagatcgaggtccttggattggtagcaaacggaagcacgaatatcattaccatgaaccaatctgttgcaactgttgacccatttatcgttaacaaatttaaggttgtagatcttcctgtcgacacttccactgaaaatcttagtctgttcgaaattggtgcagatgttcagcacatctgctttatgaagatcgaacgtttgtaataggacaaatttctcggcatcccacactttgacagctccagtggagtcaccggatacaaattgagatcttttctccagaggaattacggaccacaccaaagtgctctctgttgttgatttatcgacattcagagtggagattaactggcctcttcctggaccttcctcgtaattccatatccttatacggccatcagaacatccggatacaattttcttatcgttgagccagcacaggttcaagaccctggcattagaacgttggaggatcgattcatgtactagagatcccggtccaccacttatgtcaataacgactacagttccattgtcacagcctacgcatatcttatcctgagttgtgttgatgctgatactccaggtgataccggagttacaatcgtagttgtttaagggcaaaccggtagcaatatcccattcggtcatcacagtcgaaccaccaatggaaaacagacgaggagggtaatcgtcataagtagaccaaaccaggccctcaatgacacggtctttacctccttgtagcacattttccagcaggaagttcttgtgaggattccaaatttcaatattaccgtttgattttcccactgctaatcttaagttctttggggcaaagccattggaggagaagtgagaaaacgccaaagacgtcactgtccgcggcttatacttaacgaatctgcaacgatgaatatccatttctatacgtggatctaaggttgagcttctgtgagtctttttcggcttacagtaggatcctagtagttcacttaatcacataatttttttttaggaacttttaaatttattgtgtggttagtgcacgccgacttttcagattttttttttttttctacctttctcctcccatcttcaacatcatctacaacaacgtacatgttgcacgttgtacctatcgcgtaaccgattagggagatttcgaaatccccatcgcatcatcatgagccacagtcgttatttattatagtactgatgagtatcggaagcccgatgagcacataccacctccagtttagtatttaagggtctgaaatcctggagtagttgccagaaacacagagacccacactatgaagttgactgtaagctctttcgtgcttccactggtggcaaccttattcgaaaccgccaagggagatgatacatatctctcaagaaaagacctgaacgttcctcaatggaatattacccgttatggtgatgtgaagcctagtgaaggctacatctttgtcactccttatgaaactacctcctctcaaccgggagcctacatttatgaccaagacggagacttggtctggtcaggattctcctatttcggaggaactccgttcaattttcaagtatttaatgaaactcaattttacgcttgggagggttctgtgaacattcgcacaggccatggacatgggcatttcagtttctttgacaacagctataagcctattaagcaattgcatgcccttgaacatcgtctaggtgacatccatgagttaaccattcccaagaattcaagcagcgcactgattgaaatttttgagcccactgaccagtacgatctttctccttatggaaatggtacttgggtgaacaatgccatcatccaagacattgatcttgaaactggagaattgattttcgagtgggtttctctggaccatatttcaccagcagagtcagttttaagccttgagtccgggttggctggtgtcggacagaattcctcaacagcttgggatgttttccatttcaactctgtggacaagaacgtagaaggcgattacctgattagtgcccgtcattcttccactatctacaaagtgagtggaaaaactggagaagttttatggagatattcaaccagctcttcattgtctaatttcacaatcatagacaactctgcagagttagaagtggacccagaatatcttaaatttggattccagcatcatgctaggtttctcacgcagacaccaagaggtggcaaggaaattatcaagttctttgacaaccacgcttatagtcatggccacactgaagccggtcatggctccgagtcttcctcagtcaccagcagcggaaaaatcgttgagctggatttgactcttggtaccgccaaggtcttggagattttcctccctcctactgatcatccccttttggcaaaatctcagggatctctacaactgctacagaatcaccatgcagtgatcaattggggatctgcgggaagtatcaccgagtatgacagtcaccataatccaatctttcatgctgctttagatgcagactctgatgacgttcaaaactacagagctttcaagtatccaagatgggtgggttattctccagaaaagattgccctgttcaaacagggttccaaggtttacatctcgtggaacggtgacactgaaactaaaaaatggaaattatcgacccagggaaaagagatcggtgtttttaagagagctaagttcgaaactgtaattgatcttcctttggagttccaggatatctctactaagtcaattgaggtccaagctctgtcgcaggacggtgaggtcttagggtcacttaatagtgctcccaaggaggaagcttccccaagggttcctctgttgggtgctttggaagacggtttccaaaactacttctcttggagagctgcaagaactcacgattagttgactaatatatttcattagttatataatatatggttcaatatattaaacaatatctatatattaatttacttcccgccatccgaaatctatgtcactgcggagacgacatatgagtccgaaatggaaactcgaatctatgaacagaattattatatattcattccattatccatgatagcatcccgaggtctactcatattgaggagatcgggactaaaatacctaagtaccagcagtatccggttccagttatctccgctgcaaagatatgacgagctagttggtaacgggaaactccgagatgatgagtttcaacgaggcataatatccaaccttgaaggattgcacagtcaactgaaccaataccatccaccaaaagtcgaagctccggatgttgaaagccttaaaccggcccaaggattctctaggatcttttcaatctttggcaaaagttctaaaaactccaaaaaaaaatctccggatcacattactcctaacggagtttacctttatggagatgtaggatgtggtaaaaccatgttgatggacctcttctacgatacaatacccggccatttgacgaagaaaagacttcacttccatcagtttatgcaatcactgcataagaggtcccaccaattgaaaaaacagcatggaggtcatgatattgacgtgatcccattattggcatgggaattagctcaacagtcgacagttttatgttttgacgaatttcaagtcacagatgttgccgatgcgatgcttttaaggcgactgctaatgttagttcttcgaaatgaccatggccttatcttgtttgcaacttccaacagagctccagatgacttgtacataaacggagtccaacgagaaagtttcattccatgcattcaactaatcaaagaaagaacaagtgtgatttacttgaactctcccactgactacagaaaaattcccaaacctatctcttccaattactattatcccaaaccaggagtgaactttcaaagtgcagcttccagggaacaacagaagaaacatactgaacagtggtattcttttttctctcaaggacatgaaattgagaaaaatgttgaattgtccatctggggaagaaatctggttgtgcctctttgcacaccaccatacgtcgcaagatttacattcaatgaactttgtggtaaacctctagcagctggtgattacttgacccttgcagagacgttttctgctttcatcataactgatatcccatatttatcaatcaatgtccgagatgacgtcagacggttcatcacatttttggacgctgtttacgacgcacatggatgtatcgcagtcactgcagctgctaatttccaggaccttttcgttgaacctgaagacttatcggaggggaattttaatttgagagataaaaagccagaagaactggaaaatgattctacttttgaaaatgatgagttggtaagtaagcatggtttcgataagaaaatcgctaaaaaggcctctatgtttgccgtggatgaagaaaggttcgcctttgcaagagcattgagtagattgtcccaaatgagtactcaagactggattgacaactccagagtgcatgaaaagaagtagtagaataatgtccatatagtagaatgatatccatacttttaatcacttagatcatcaaattccagatcgatggcatctgggtttatcttcttctccatattattagtggtagcagaacctacttggggtcccgtagacgatgcgacaaactgtacgggagcgttggactcgactaaggtctcgacatcttctagtttagcttggtcgtcaattgatctctgataccgcagcattgatttgaatgtgtcttcattaccataatgcaattcaaaacgttcccaacgttcccataagatgggattcttcttagtggggacaataagatccgcagcataatgaaatatggcccttgctcgtgagatttctttgagcttaatttccaactcaacgaagggaataacaattgattcagtgaatccatataatgtagcaggtagtgactcgagagcttgttcgtaaatctttcgagttttctgatcctcttggttcagcaaagacacttgtatgtatatcttgaaaatattatatttctccttttcgtcttccaacttttctatagcttgctcgtagattctaaaagctttactgataaaaccatgatcgagttcaaactttgcgtacccaatatatattggctctacaagattcagaggacattgttcaatacattgttcaaacaaatccctgatatgttcgtttgtgagcttgaactttgcctgctcgttgaccattttggaaagatagacattccaaatctcgaaggaaacagggaaacgaaacaaatgtacacctttctcgtaacatcttaagcactcctgatatcgttggtgttcttccaaaaaattacaatagtttagaattgttaagggagtggctatttttaggtcaatcactgtatcatacaatttgattgtatcaggaatattgcctgacgactctaccaaatccagataaaatgaccataatttggtagattttttcaatgcgaattcttttagtgaggttttcatcacatctatagcctgaggatagtcatcattctccaattccatttcagcccaggaaatgacaagatctgccaaatcttctggaaaaggaaagttcgccttcaaagtagcagcgtatattttccgggctgttttcaaatcacccttcgatttgtatacatcaatgtatcctaaccaaagtttgggcaacactccaggttcttcgatggtgccaggatcaatagttctaattgcttcaacataagtggctaaaacgttttgtaattgtgtctctttatcaaaaatcgcaactctatctaaccaagttgcaacatcattcttgtcctgtctcaacagaacgtcgttcattaataactctcttctgtccattagttgttcgaagctatgcatcctcaattccaacattggtgaagtctccagcccttgaagctctaaatctttcaaagtagtggagataacagtttcttcgaactctaagtatgtgtcgtagaccacaacaaaatccttcaccgtctttgatttggttatcccgacttcaaagatttcccttactttatggaaatttcctctgtttatccagtattgagtccaatgtattatcatggatgcttgttggtcaggaaacttttcaattaggtattgaaccagtttttcgatcttcgtgtcatgcgacttgtaatcaatgttctctgattcttggggatgctttattagcacattaagatagtctgtatacaacttcaattcggagagctctactgttgccagaaactccgtattatccagcaaatcttgaaaagttcttgtgtatgctgataagtctgaatgcgcttgactggttagtttatgaagtatagtctggtaagtaacgttctccaatttgtactgatcaggaataaatccggtttcttcttcaattgacgaagcatcctggagcctcacataaggcatgcatgttttcttataatagtaaaatcttgtccaaatcgacaaggaggtgatggctccaacatcgtcagcaaattgcaggagaaaaggccatatcaaatgatgttttgcaaaaggaagtgtttgtaaacactggtcagatttccgtctaacaaaggttatcccagggatacatgagtatttgactagtgccttcaagtacaaagcccagattatgggagaagacccattgtaaagtaaagattgttcgaacactttgattaaaccgtcaaactcctccaattcagactttcgctcctcccaaagcttcacacaggttttcagacacaggatccaaatttcaggtgctcttttcaaagcgttagcagctctgaacagtacgtagaactgttgatctacaggggacgagtgctccttgtgacgataataagcaatccaggactccaatgagtatggatctagcagcaatgactcctcgtaagccaggtcttcataagtaatcagcttctccatgaggacgaaagagtagagcaacaagagcaaggctggggagggggcagctgacgatcggaagggaagtactctgtgaataaatatatattctaggtacgacacgggcaatgtgataggggaaagcgaattcttacaaatagttttctctcacagtgtcccacccaatattcacttatcccaaggcagccagccatagggacaagtgaacgaaactcttcctgaagtgtaaacctccaagaacatgtccggatcaggaaacaggtaagtggactgcgtttgtattgtcaatttgattgattgacgatgtgtatggtgtgtaagctactaacattttgttcagggaacaagtcttccccactcgtatgactttaggtctcatgaagggtaaactgaagggagctcaacagggttactccttattgaagagaaagtctgaggctcttaccaagagattcagggagattacgcgtcgaatcgacgacgccaaaagaaagatgggacgagttatgcaaacagcagctttctctcttgctcaggtgacatatgcaacgggcgacaatattggatattcagtccaggactcagtcaagagcgccagattccaggtgaaagcccgtgaagagaacgtaagtggtgttcgtcttccccaatttgagacccatatcaacgaagatatcaatgatttcaagatgacaggactgggacgaggtggtcttcaggtccaaaaggctgcagaagtatatacgagttcggtggagacattggtggaattggcttcattgcagactgcttttatcatattggatgaggttatcaaggttacgaacagacgtgtgaacgctatcgaacatgttgtcattccccgtacagaaaacaccattgcatacattaactcggaacttgacgagcttgatagagaggagttctaccgactgaagaaggttcaagagaagaaacaacaacaaactgctttgcaggatgccgaggctgctgcaaagaaggcccaattactggaaaagaaagccaatgataagttggaggcagaccagaaggccgaagaaaacaaagataatgaagctagtgagcaagctaaagcggagtacgatcctgaggaagaggctagacaggtttccaagttcatagatgaaccggctgatgatcttactgcccaacaggaagaggatatcattttttagtaatagactagttgacattggacatagggcagtcggccttcagcggaaagaagattgtgtagctgtagaagctctgcgtgtcttatgacctcgggcaaaccttgggcaagtagtttgcgaatcctggagcacctttgacattcttcgcactctttacaaggtcctcgactgggaaacttcctctttcctttccccacacaaaactgccaacgatggtcaaactcatatcaattatagccctagttcaacttgtctctgcgacaattgtaccttggaatctccagaacgtcttatctgacgtccatcacccttctctccatctcttggattatattcaatccttgaagaacgaggtaatgttcgatggcgacgatcgcagaataatcaagttaggcccccaagaataccgtattatcactgaaaaagagaaataccagttgaaaacagaggggatatcatttatcgatgtcacctatcagcatggagacaatgtagagctgctctattccagtgcgccagttaccgttccagactatctttatccgtccaatgatactttccatttcaaacaagtaaattctttgataggtgagattgacattggcagaatgcaggcgtttttgggaaggttctctagcttctttacaagattttacaaatctgacaaggggttgcagagttctatctggttacaaggtgaattggttcaattggccttgaaagatccatcgaggttcaatgttactactgtggaacacccttggaagcagaattctgccatctttacgatatacggtgaaaatgttgatccttcgaaaggaaaaggggacattgtagtagtgggatgccatcaagattccataaacttgcttttccccaacattctccgtgctccaggggctgatgatgatggatctggtgtaacttccaaccttgaagcgctcagaatcatagttgaaagtggcctcaagtttcacaatacagtagagtttcacttttattctgccgaagaaggaggactacttggctcccagcaaattttcagctcgtatagagctgcagaagagactgttgttgctatgctacaacaggacatgactggatacatccaaaaagctttagaccacggggaatccgaccacttcgggctaatcactgaccatacaaacgcaaatctgaatagcttccttgcacttttaatcgatgcatacacttcaattccctacaaagaaaccgaatgtgggtatgcctgctcagatcatagttctgccttggaacatggttatccatctgccatggtctttgaaagtagttttgcctacacaaatcccttcatccatagcacccaagacacaattgacaagatcaattttccacatatggcagagcatgtcaagttggtcctgggttacgttgtagagttgggattagaacattttaggtgaatgggggataacagaggggagggagacttacgcgtagcgaaattctgaaattcctcaagtctacatcagaattgctagtaaattttgaatgaatgatttggtcaaatctaacattttcgtttgctcctggctattgaaagcgttgaatgaggtcaaagatgaaacagtttcaaaaataccaaagttcaacagaactccccgggttatgaaagttttgcggttaatcacggtttctagagatctaataaggctaatcatatgtgattctgcaaattcgattctagcggaggtatcagccgatgccatagctgagattgagtacaacgaaagacaaaggttctccaagggtataatgaatactgaaatcttagtagtggagtcctctcttgtgtttacttcactgcaccaactgatgccctggtacggttcttacttgcccccacgtataacaaaaaccaacggtgaagattactatatttcgaagtatgcagtactggaaatcacaaagctctccattttcaatcgggatcaggtgaaggaattggttgatatccccctagtttatctagaaaaaagctactcttggccaaagctggtgacttcgcatgttgatgatgaaccgacattttgctcagattagaatatatacaacaaaataccgtcaaattttcgtctatttacacttttgggctaattgcgttgagaaagttttcctcttggtctatctctgaccttctgtttgttgatgttctttcctcttctagtcttgaaaccacccttggccaatacaccccatggcgacatggacagcttattggacttggattttcctctaccaccacccataggatggtcgcatttattctgggccacacctctcacagtgggtcttattcctctatgcctggaacgaccggctttaccgagactttcatgttgatgatctggattagaagttactcccaatgtagcgcatgcgtcaatggaaacatatctctcttcaccggattgcaaacgaaccacagccttacgcttctcagggattttattaacgattctggcatttgctccagcagcacgacaatacttagcaggaccatgcacggtctcgctgacattatggacgatggtgcccactgctatcatagagattggaagacaatttcctttttgagcagtttttgcgttcaaaatagctggatcgatacgaccgcccatctcttccatcaaatattcaggaataccagatctaaacgattcaacaatatcaccttctcttaacccttgacaagcaatgatgtaactaaggtttccggtatcattatgtttcagcaaagcgatatgagcagttctgttagggtcgtactcaattcttaccacggtttgtctacccggttctttacggtggtagtcaataaacctgattctacgttgatgccctccacctctgtgtctaacgacaattcgtccggtgtggtttcttcccgatctactgactctggtcttcgtcagggctcgaacaggtttacccttccataaataaggatacattggtttcctccaccatctcaaacctggagatgtaggttttagttttttcaattgaaccgtctccttagaaagcttcgtctgtctagcaatgatttcgtgttgtttctccaaatcagtaaggtcaccagcggcttgagtaatccttggagtaggttctgtggccagagttcgagctccggtgctgaaaaagcttacagacccaaacaaatgggtttgcaacagtttcttaccccagctcgcccgtggtaggcttctgagtggtaggttaaacatgcgattaagaaccagagttggtgatggcaggaaggtcctggaggatttccatacaaatttttgatatcgcgagtaagatccaggcacacatttacgcataagcacagcgtaaacaccttcccattaacgagcgcgattcattggctcgttgaattttagggaggacagatcccattcagtcaacctccgtttcaagagacttgtacacttcacaaccagtcacctatcaaactaccatgtttactcgttcttttgttcgttccatggctacagctgccaagaccgtcaagccaccagttcaattgtttggattagacggaacctacgctactgctctgtacactgcctccgtgaaagtttccagtgttgaccaggctgctgggtccctgaataagctgaagacttacttggacactgattctaccacatccggaattgtgagcaacccagccttgtctctgaacgacagaaccttcgttgttcaaactttgaactccaaactatctctggacaaatcagtttccaaccttttggaagttctagctgagaacaatcgattgggactacttggcgacattgttaagcagtttggtgttttgactgatgcccacaacggtgttgttgaggctaccgtcacctctgcttctccattggataagaaatcgctgaacagaatccaacaagctattactggctctgaatttgttggccaaggcaaatcattgaaaattaacaaccaagttaaccctgacattttgggtggtcttattgtagaagttgctgacagaactgttgatctttctatttcagccaaaattgccaagttaaacaaggtcttaaccgagtctctttagatgacatcgtacacatattatgattagaatggtaaagtgataagcgttgtagtgggtaagagtgagggcacaggtaagacgtacggattgtgtccacatgaagttgtttgttgtaagacaaatatggctagcccccctcctcccttcagccctcgaaagttccttctagataaatataatctcttccccttctccttctaggcgactgatttttttccccccctccccctcaaggccatctcgatcatcgcctttttttagtaaggtgatataagagtagagtcacctaaactttccatccccatgctaggagagatatcggatcgtaagtgaccacgtctttcagccatcaatgtcgcgtcatactaaccctgcagagcttaataacctcgagttagacagttgggtagatatcactcaacaattctttgaaactgccaaaaatgtcaagcatgggaacattgtcaaattggaatctttggatctgatggagggaaccgatgccaaagagatcctgaacccagctctagacactggtcttattgaagacgagtcctacgattgtgaccgggacctcactttggatgagactgtcagagtagtggctaatatcaccagttgtctggttacttggctggatagcagctctctccccgtgaccttattctcttgcaggtatattgaagagatcctgacccggttctcagctttgttgtcatcatcaactatcgtggaaaagatttttcaggtctctaatcttcagtattctaataaactggatcaatctgactcttttacttacagaattttgagagcgtacttgattggagttttaaatttcacagcatttgttttaaatatccccgtcttgaaagatgaggaagacttaaaccgtgtatccatggatttgaacattgacttgctccttcaattccctcagaaggacgttgcggacttggtaaactctgcttacagcttactagagaagagagatgacaaaaacagtaaagttttgcagctttattttgacatattgaaaaggctgcaaatgctataccctttgtcagcaagcgttaatcaaggtgatttccaggataccctctttcttcacgaggctactgggttcattgacaaactgtccgaagaaaacgactacattgactccattccccagataccccatttgttcacaaggggaattcaaaaacgaaagaacaacatctttcctccccgccccattaaaatgcattcatttactatttgcatttcatacttgcattatctttttgacgacctcaagttggcgatggacgtcctatgctttcaggatgctgcagatttaaggaaccgactatatatctttggatcaaaaagaaatgaaaaattgcctgaccaagaacacacgtcaactcatattgtggctgcattgtttttagaatcaatactcctaagagatggactgatattaggagcaatacctgtttcggagttcttaaagcaagacctttcaagtttgacagcaggagaatctgttgtcttatcattgttggaagatgataaactgacaaatgatagggcgataaaagccagagcatcttcattgttgcaggaaatggaaaagacctacatttcatggattcaatcatttttgcagaatccgagtaagcagagagatttttttttggattctgtagtagtttgggatacaatacaggtaactgctgacgatctagaaacatcactgcccgatgattatggtttagaggacacattcaaatctattcaacccgacgggtctttgtctgaactacctgtcatgcccttatcctcgtacgtttattacatgaaactcgattccatggttcaagttgtattcaggggcattgagttagagatctacaaaccctgggagatgtaccaaatgtattggtatgggttatatcttctctccaccttggagtctcatatcgctcgcatgaaagatgtcgccaagtataaattgtccaaagctgaaggtgaaagtaaggatatctggaaaaagactttagatcatattaatttcctcattcaagagactatagtgtttaagacactagcgcaagctcagcagtacacatggactatactggataacctaaaacttttgaaacttccaaaatacaatcgaactactccacaattgttgtaccaattgagaatgaaaccgttttcgtcagttggtataccccaattgccgagtatacagcattttcagaactttgcggatgaaatagctgagggtagtctacggtttaggacggaaagggagcgagtgcaagatatttgttttcgttgtagctctgctgttcgccaattaacaactgaagttaaaactgcagcatcccagctgaaaaagattcatccatctcggggtcgtttcaaggcagattacgaaaggggagtagaccaaatactccgatccagtattggcgtggctgtattttccactaaagttaacaagaaaattaaagatgctgagtttgtaactcaatgcctgaaggagaatccaagcaatcaagcatacgatgtttcattgagcagagcccaataccatcggttttttccgcctgcggagattaaacatatgaggaagtgatagttatgtagtggtctttcttgtacagctttggagtatgatagtgaatggccatgccagcccccaagtggagtctccgcccagtgtatttctttgactacggatcaaatcgttaagcagagcgaggaatcggttgactttgagcctttgtacaatagttattatttaatgaaaggttggataagagtctaccaagatcccttttgagcacgacaattttgactaacgactttgaacacccaaccacctggaaaacaggtggttaaagccatcggtcagtcggtcttccatccatgttccttgaaccagtacgaactatacgagctcatcttatcaccaaaattctggtcacctggatttgtgactgtgaaattctaacacttagcgtaatgatctgaccggactcgatacttcacatgtaaactttcaaagctccttcgcgaatcatatttccagcctcactctccttccaacaagtaagtctccctggtagttgtcttttcagtgccgtgagaaaaacctccccccgatttcctcgcgaagaatattctgaaaatgaaaaaatcaccatccatttttttctttcctagtaactcctcacagaaacaagatgcctccaaagttcgacccatctgaagttaagtttatctacctgagagccgttggtggtgaaatcggtgcttctgccgctttggccccaaagatcggtcctttgggtctgtcaccaaagaagatcggtgaagacattgctaaggctaccaccaagttcaagggtatcaaggtcaccgtccaattgagaatccagaaccgtcaagctgttgcctccgttgttccatccgcctcttctttagtcattactgctttgaaggagcccccaagagacagaaagaaggagaagaacgtcaagcacagtggtaacatcccattggaagagatcattgacattgctagacagatgagagacaagtctttcggtaagaacttggcttccgtcaccaaggagatcttgggtaccgctcaatctgttggatgccgtgtagaccaaaagaaccctcacgacgtcatcgaggctatcgatgctggtgagattgatatcccagaaaactaaatgtgtaataattgagatatttaaacggttttgatgaaagatggtttgacttccagctggtttttgatatttgatttgactttcattttttttccattttttctccacctgacccgtttgccaacactctggtcccattttttactctgtactgggttccaattttacaagcaaactagataaaaagcttatgattattacggagtttgtttagctggaagtttcgttaggggggtatcactattgtggtactttctggagctgtcagtatgatgaggcctcgtcgtggttgttagctgacattgtatttaagttttgttcaggcagaaaattggaaaaaaaatcaaacaaataatcaaagtctccagctattaggtagtaagccagtaggttgtaagttgtagtgtcttctctcacctttttgctaggaagtagtcttaggttaggacgaagtctagtgagcgttaccatcgctcacgaggttttctagcacgtatgaatggtgaccacggtccatgataccagtttcattcgttatagaccttataatgagttcgtcactgcttctgacaggttaaccaggcttctaactaaagcaccctggccatccgttaaacttttcagctcatcacccaaaagtcgtgcgcgggctacattataatatttttttttgtatttctaaggctcatcaggtatactagctacagagtcttttgaacatcaatcacgctacaacatagagtgattcagaccacagagcaagcacagcatttccactaagactgcattttattcttacacaattttttctcttgcatttgattgtctggttctagatttcactatggataatcctataaggttagacctacaagactcattgaacaagttcaaagagtacttcaacaagctggatttaccacttccggctccattcttgttagaaaatgagagcgtgccccaaacgttgaatacgctggccatgttgtcactaaatgacgccctgacattaccactattatatggctttaaacctatttacattgacattattggaagactattgtccaaccaggaattggaaaactcttttcgaacttccagaaaaagaaatatccctggttcagatgttttggctacttccgctagagtgattcaactgctggatggagtgactgttctcattgattccttccttaacaaacataacccgttgaattttatttccaaccagcaaatttcccaggaagaactacagacaattttgattgcttttcacaggttattggtccatgatacacacagattcaaaaaacacatagatcctgtaattctctatcagagtttggagaaccagtccacgaacgaagtgaacagatatttattgatccaactactgtcttcggtcttaaacttttctgagcaggtagtagatgaaatgatgatttcattcaacgttcaagaggccaagggatctttggaaggtgatatcgatgtatcatttcgtttcctgagcatcttggaagctaatagactttcaagattcacttctatacccgaacctgagtttaaagacggatcatttattgtgcaacaaactcaccttagctctaatattacatcggttggaggaattcttatcccttattcccacgtttccaaactgaatcaagttccggatttagttcctatccagaaaagtttgacagctttgaagaacatggctattaatgttcagcaaggttccccattcatgatcgtagggaaaccaggctcaggaaaatcctttctagttaatgaattggctaagcaattaaacatggacacctcaaaagatatcatcaaggtgcatctcaacgaacagactgattccaagatgcttctgggtacgtatacttcaggaacaacacctggaagttttgtttggaaagacggtattttgaccaccgctgttaagcaaggaaagtggatcctggtagaagatattgacaaagctcccaccgaagttctttcgatcctcttaagtttgctggaaaagaaagagctcactatcccttccagaggtgaagtaattacagcaactactgggttccaaatcatttcaactattaggcaaccagccaactcatccataattcctgatattattggaatgaggttatggaagatagttttactcccacagttagagacagaagatttgtcgtccattttaacccacaagttcccaacagtaaacagattcctccctcaaattattaactgcttcctaaggtgcactgaaatattttctaccagagggtttatcaccatgaacaaaggtcatcagctacgaatcctctcattgacagacttggtcaaattatgttcccgcacagaaagattattggccttggccggaattaccagctctgatgatcttatagctgatgacgtttatgactccatattccaagaagctgtggactgtttctgcagctctataccggagctaccagctctggaatatattatttcggagattgggctttgcctcaatataccatcttctaaaattacgctgctattatccaagtatgtaccagtttatcaggacttgggtgatagtctaaaaattggaagagcacacttgtccaagaccaaaacaatttccatgtacaaaaataataactcaggcagttccagctttgccaaaaccaatcatgcattaagattaatggagcaaatatctgttgccgtttctatggcagaacccgttttgctagttggtgaaacaggtactggtaaaaccactgtcgttcagcatattgccaaacagctcaacaagaaaatagtggctatcaatgtctcacaacaaactgaagtaggtgacctattaggtggttataaaccagtcaatactaagttacttgcaattcccatccaggaaactttcgaagagttgttttatgcatcattctccgtcaaaaagaatgcccgttttttgaagcttctagccaaatgttttaacaagagccaatggaaaaacgttttcaagttatggaaagaggctcacaaaatggctaagagtctctttgacgagaatacctcaagcgatgatgaatcaggtcctactaagaagagaaagcttaattcgactgaatcaagacaattgatggacaaatggaatctttttctggaacaagtttcagagttcgaaaaaacaagtaaccaaacggagaattcatttgtttttcaatttatcgaagggactttagtgaaggctgtacgtaacgggtattggctacttttggatgaaatcaatttggcctctccagagaccctggaatgtatttctgatttactctctactcaaactgatgataggaatattgttttagctgaaaagggatccatcactcctatcaaagctcatcctgactttaggttgttcggaaacatgaatccaggtaatgatgttggtaagaagaaccttcctgcaaatttccgctcaaggtggaccgaattgtgggtacattcccctgactcagatatttctgatttgctgatgatcattgacaagtatgtgggtaagtactcgttggctgacgaatgggttggaaacgatattgcgcaattctatttagaagctaagaagttggctgaggacaacaaactcgttgatggtgcaaaccagaagccccactttagtatccgtactctgacgagatcccttatctatgtgacagatatagtttccatttacggattaaggcggtcgctatacgaagccttctgcatgtcattcttgactcttttagacgctgattcagaaaaaatattacgtccgttggtgataaagtacactatcagtcgagttaaaaatttcagaaaattgatcactcagtgccctcccaatccctcagatgtaaataatcctgatgagtatgtgcagttcagacattactggatgaagcatggaccaggagaggtacgaccacagcctcattatatcattacacccttcgttgaaaagaacatgctaaatcttgttcgtgctacaagcatcagaagatttcctgttttaatccaaggtccaacatccagtggtaagacatccatgattaaatacttggcgaacataacaggccacaaatttgtccgtattaataaccacgagcatacggatctgcaggagtacttaggaagttatgtctctgatgacaatggaaaattggccttcaaagagggtgttctagttgaagctttgagaaagggttattggatcgttttggatgagctgaacctggcgcctactgatgtgttggaggctttaaatcgacttttggatgataacagagaactttttattcctgagactcaagaatttgtaacaccgcatcctgatttcatgctttttgctacacaaaatccaccaggtatttacggtggccgaaaagtgctttctagggctttcagaaacagatttttggagcttcattatgatgatatcccacaagacgaattggaaattattctaaaggaacgttgccagattgccccatcgtatgccaccaaaattgtgcaagtatatcagcagctttctctgcagagacagtcgaccagattgtttgaacagaaaaactcttttgccactttgcgtgatctatttagatgggctgaaagagaggctataggttacgagcagcttgcggctaatggatatatgctgctggcggaaagagttagaaggcaggaagaaaaacttgtggtgaaagaaactttggaaactgtgatgaaggtaagacttgatatggatcagtattataaagaattagagaatccgaagatactacaaatggaaacacctattgtttggaccaaggctatgcgtcgacttgcagttctagtgtccacagcacttaagaatcatgaacccatacttcttgttggagagactggatgtggtaagacttctatctgccagttgttggcagaacttttgagaaaagaattaattattgtcaatgcccaccaaaatactgaaacaggagatttgctgggtgcccaacgtccaattcgtaacagatcagaactgcaaacaaaagtttcaaaaaacataactgatttgttcaacgaagctggtatctcttatcacgagtctgcaacactgcaagatcttttggatatttttgattctataaacaaatttgaaggcatttccgaagaacgaattaaatccgtcgaggctcagagagcttctttgaatattctctttgagtggactgatggtcctttagttcaagctatgaaaaacggagagtttttcctattggatgaaatatccttggccgatgattctgttctggaaagattgaactcagtgttggaacctgaaaagacccttcttcttgcagagaaaggtgctgaaaactctttcattcaagctgacaaaggatttgagttcttagctactatgaatccaggtggagattatggaaagaaggagctatctccagctttaagaaaccgtttcactgagatatttgttccttccatggatgatttggaagacgttcatcgaatcgttgcttcaaagttgatcgaagaagcttctcaatacgtggaagcaatagttaagttttccgaatattatgccttgaaagtgggtaatggtaacaggacaaacggagtcatctcattacgtgatattttggcttgggttaattttattaataccacagtcaggaagcgtaacgtctccccagaagcagctttgattcacgggtgctgtttgacttttattgatgccctcggtaccaacaacactgcatcgttctcagaaaaccctgatagtttagctaaaatgaagttatcttttgtgaaaactatatctgagctttcagggatgaaccttttgccttactacgaagaagaagtttcggtagaattattagaggatcgggtcaagtttggacaattttatttgcctcgtgtacctttaacgcaagagtcagtctcttttaacctaaaggctccaaccactgctaagaatgcaatgagagtgacaagggcacttcaagttcataagcctattcttttggaaggaagccctggtgttggtaagacgagtctggtgactgcgcttgcaaaggttactggaaatttactcactcgtataaatttatcagaacaaacggatttgttagatttgtttggctcggatgctcctgctgaaggcggacaaacgggtgagtttgtatggagagatgctccattcttgagagctatgaaaaagggggaatgggtattgttagatgaaatgaatctagcctctcaatcggtactagaaggtttaaatgcctgtctagatcatcgaggcgaagcatacattcctgaattggacaagacttttccatgccacccaaactttgtggtctttgcagctcaaaatcctcagtaccagggaggtggtagaaaaggtcttccaaaatctttcattaatcgttttaccgttgtttatgttgaaatgctctcagagcaagacttaaaccttatttctcagcatctttacccaaagattgatcccgagatcagtgctaaacttatcaagtttatctcatctttggagtctgagattgtgttgaacagaacatggggttccgaaggtggtccatgggaattcaatttacgtgatacattgcgttggttgcagctatacagcgagcctactgtttcaacaactgtgacccctggagactatttggatatagtcatcggacaaaggtttagaaacgaaaaagacaggactcaagttaagaagctctttacttctgtctttggcgaaaagccaaagagaccttctttttttgcattgtccaaaacttttgtcgaaagtggtagaattgtctccagaagaagggatctgatacattctgttccaaaccagaaactatactctttgcagtgcaattatcctattttggaatcattgttgatttgtattaatcatgcctggccagtgatccttaccggagccactgattcaggtaaatcagctgttattcaatatgcagcaggtcttattggatccaatgtccaccaattttcaatgaatagtgatattgatagcatggatatcttaggaggatatgagcaagtggatctgatgcgtggtgtttcttcgatttgcaacagcatcaattcattacttcttgatcttgttgctgtttccctaaaagacaggtcggtttcgactagtgtggcttcaaatatcttgtccctccttcaagcgatctcgtcaaataccgtaaacactgataatttcaatgtttttgttcaagacctgagtactgtggctgctgtcattgcatctcctgaattcgatgaactgattcaggaatgtatattatttgaaaaaaagattcaagacaccaagactgttaagtttgaatggtttgatggtctgttggttaaggcagttgagcagggtgattggctgattttagacaatgctaatctatgtaatgcctcggtattggacaggctcaactcattattggaacctaatggtgttttagtggtcaacgaaagtagttctgtaaacggggaaccaagaattatcgttcctcataagaacttccgtttgttcattacaactaatccaaaatatggtgaactatctagagctatgagaaacaggtgtattgagattttcttaccatcacttgaagttcgtgcttccaagtatgatagaacattgcttggtgacgaatattctaaagagtacaaccaagcccagactttggaacaggaaattgcgcacttggagatttctaaggcaaattcagttcctatctctaagtttgtgaacttattgaactctgaaagcatgaatttcgccagactagttgattttattattcagtctagccaccaacttatttcaccagctgttgccttttcactgttgcagctagcaactactcattcttttgagaaactttcagacaccatatgtagtagtctgtggttttccaggaatgtaaaagccaactgtaacaagatttcagattacttgagtcaattcaaattgcttgggttgatgggtaatgttttcaaaatctacgattcagcaattgtgcctgctttgaacgacaaggatgctattgattatcagaagactcaatacttgaatcccacagtgaatccttttttactggactccatcagtcggatatatccttacgttgattctgttgaagccaaccttatttacgtggttggaagttttttggtacaagctgaaagaacactatcaacattggtctccagatctatcacgaagaaactgaatgacttgaactatcttgagagatcagctgctgtcaataatggacgtgaagtcaggaatgcaccaccaatcaacattttcaaatttttaaaagatatacagattttccttaccaattctttcattgaagcagcttcttcgttgttttcgaccagtgatttttataccgacatttttgaactacaggttatctggatccagttgtatgaattggtacagaaacaagatgaagccaaaatcagagttttccagcaattggtaacttcttggtttcaaaaatgttccggtaatccagttgtttcctctttagctaaagattcaacgtcagatttgaatgaattcaactcgtcattggctttgactagaggattttcaattgaaaagatatgggagagtttccggaccacttatccgtcttctgaagtgtcttggagcagctatgaagctgtgtgcaagctgtcaaaggattttgacagcattgcccaagaacagttttcggagaatgctaatatggttcaacagttaaggttactgttgattgagctgcattctgattcttttaatcttgatattgaatccgaagatttcgatgaaatgcagaagaagctaactgagggaatagaaaaatttcaagaagtatctagtgggtttattaacaagaggaaacatacttacagatcgttgttccaatctctacttgcaatgtcaaagttgccagtaactaaggatgatgctggcccggaatttttcagaattgcccatgaagcaaacatgtctaccgagttgctattcaaagctttatctgaagatgatctgaaacctttccccagactgttccactttttgtggactgatgaaactggagcaaagtctcatgtatccaaattgttcactgatgaacttttcagagaaatactaacttgttctttcacccttactgaaactgaaggaaaagatgttgcgcagaatttggttgacttctcattactgacacaatcattgatcaaacaatcgcctagcattttggaacacaagttctctgtcgttgcttcacttttgcgaaaatggaccttttccatcatattatcgcatacgagtaagaattccagtgaataccagtttgttcaatctattagtacagcgcccagtttgtcagaagacgatatttcaaaagtggcacagatttattcaggctttgaacaccaggaagctcaagtgtttacagagtttattcatccagttttaattgcactgaattccactttagattctggaagtcttggtaaagcttttgtatcatttgctcttggaaccattcaactatatgttccaagcagccctcatgatcctgcgattactgatcatgtcatatatgatctgtaccatgaacagctgaaattggtatcctctatttgcgagtcccttgacacggcagcccatgtctcaggctttgatgtgaatgcgttctcagaaaaaaatagagtcagcattgagtcatcattggttccctcaaagcctcaagtttaccgacccaaatgctctatcgacgctttatttgaggattggaactcatttgttgactcttctgctgctactcatccagttcaaaggttggtacagtctttagaagactcaatggagcttttttcaaagaaggttgatatgtttcaaagaaatgcctctcagtttttggatagattacagagaaatcactccagatacgcagatttaaatgatattctagctggttacatttacagtttgaagttcggatttgatctgctgaacgttcatgcttcagtcccttctgcccctctcgatgttctcgctccgattgatgctacggtactatcttcagccactgatattgtgagcttttttgatccaattaattcatatttgaagaatcgacccttgaacgaatcagatgtcgaatcagtatacgtcttctttatgaagatatatttttctcatgcagatgaagcgttagacgacgtattaatcaagagtttccagggtctttactacagatggagtctatttaatatcaagaaaaaggaagaagagtctcttacaaacggagttttcaaatatgctgctcctgagtttgacggagaagaagaatacaaaactatgtttcctgactatgaggaagtagtggattatcaagagaaagtcaacacagacgtttccaaggatgacgtatactatgaggtagcctctgcctatatcgagggatttgcaggcaaaaggtcggatcttaatagtctgatcagtgaaggttctaaaatttctcaacttctgaatcttgggttaaaccattcagcaggagatatttcgtcttccaaactggcttctttagctgttctggtttctaactctttgaatgaattcaataagccagctcagttcgacaacttctacttcggtttctcttcttctcaaacaaagttggccgattcagtcattcagaagttacagtatagcatcttacccttgcttaagcagtggccagagcatgctgtcttgcagcaaattcactcactttgcgatgatctactcagcttccctgtgaagaccccaattgctcaattactacaaaaagttgagcatatatatgtggcagttgcagagtgggagaagtatgctcacagtaaaatcagcttgaaggcccataatgctgatgttatcaatttagtcgtttcttggaggaaactggaactatcttcatggcaaagtatttttgaagatgaggacaagaagattgagaaaaatattggaaagtggtggtttcatctttttgaactcacaattcttccaataattaaagaggaatacgtcgatttgttcagtatcgttacagccttaaatgtattcctcagtcagaccaccctaggtgaatttgaacttagagttcgactgattgaagcttttgctaaccatgcaaacatgatggctcctcagtcgaaactagcaagcactttgaataacatggtcactttttacgagcaatttttacctaatatccgggatcaacttgccgtaaagcgcagagagttggagaagaaggtcaaagaaatgattattttgacaagctttaaagatgttaacgtccatgctttgcaacagtcctcaagacattctcatgctaagttgttcagaatcgttaaaaaatatcgtgagctattagctgtgggagtctctggagtcattgaatcagggctttccgcaaacacaaaagtcgttcttaatgctccagtcttcagcaagaaaccttttgatcgagttatttttgagaaagcagcacaagaatgtttaaagatcccaagttacaatagacgccctgaaattttgaagggaaccgtcgttttagacagagtctcatctctaatccaaactgctgatgaatatggaagtttcacattgtatgaatatgctaaggaaattttacaggagatggaaagactgaaaaaacaaacccccaatgaagctaccgaagaaaacaaaaagattgttggtcaactaaaatctcaaaaacgtaaacttctcagtgatactttaaaagaagtgagacggctgggtttaaaactccatgtaactcccaatgtcagcaaggagttggcctctgttaatcaaattctgtccgatgctacctccttccgaaaacttgaaattgcgggcacagatgggtacttctttagagttctggatttattcccccggttaagggccagcgttgctgagatgaacgaagaggtacctgtcagtgatggccaaaaggccttagctgctgttgaaaacttgatgtatcatgttctgagaagtcgtaattcacttaatgctttagtgaacgcaaagaatgagattagttcatatcaaaaggaatttcaagacatgtcttctttagatgttatcaaccctgccagtccatgttctgcatcaagtttcttggcttccaagtctgcgatcaagtcttgtttcgaatggataccaaaaattttgaattttgcttcgactgttcttcagagttcaacagctcttacgggcttgaaatcagtagacgtttttggttcgtttggaaatgaatttgagaaattccagttgcacaataagaatcttcttacaactgaagagatatcaactgtgaatttgtttaacaagaaagttgatgaactccatgagagactcttattatggaaaagagagaatccattgttggcctttgtcgctgatctggtcatacactgtattacctctaagaaaaacattcgacttgacacatctgactcctttaccacaacagatttagacactttgcaacacttgttttcagacctcacaaagtccttaattgttgtatttcaaaagtttatggatctctacaaagttcctattgttgaagatgatgatggctctttcaaatctacataccagaatgtgagcaaggaagtcaaactattacattctagtgccattttaggtaaaatccgattactatttgaaaagcttcaatcaataggagctaccgatttcaagtttgctacagcccttaatgccaatatttgtccgttgctcacacaatattacaatctcattttgactctattaaacaagcaacaagagctatatgtcaagaactcgcatgcattgtttattctaacaaattgtgtctacactttgaccaaagaaggtttctgttcacctcaatcaccggatcaaacaaacgatccaggtaacatgcaagatggtacaggtcttggtgatggagatggagcaactaattctaaggatattgatgatgatgaagacttttccgagcaggctcaagaagccaataaggagaaggatgacaacaatgacgatgaagctgaggacaaagaggacgatgctgtcgatatcgagggggatatggcaggagatcttgaagaatccaaagaaaaggataacgatgatgaggataacgaaaattcagaggatgatgaggacaaagaaatggatgaagaactcgatgacatcgacgatttagatcccaatgctgtggatgaaaagatgtgggaggatgaagcccaagaagactcaaaagaaaaagacagtgacaagatgccagataactccaaaaacgacgatgataacatggaggctatggaagaggatactaaggacaatcaaaaccgtgagaatcctaacaagcaagatgagaatgatagtcttgaagataaagacgagcaggaggacaacgctcagaatgaaggggaagaacaagaagaagaagaagaagaagacgtgggtgaacaagaagacgaagtcaaaaacgacgacggcgagaagcttgatgactttgttcccgatgtggaaacacttgaacttccagatgaccttcaactggaaggagaagacgataaagacgatacagagaatgataatgaaagtcaaccagacgatgcatttgatgatcccatgaatatggatgtagagttggaggagaataaccataaagatggagatgaggaagaagaagaagaagaagaagaagaagacgacgaagaaaacggatctgaagatgaaggaaatgatgaagtagaggctccatccatgagcgaagagaaagcagaagaagaggctcaggaagaaggagatgaaaacatgggtgaagataaaaaccaaaacattgacgaagaccctgcgctggattctgaaactgaacttaatccaatcaaggatgaggaagaacaagaagaaacaaacgatccagccaaagaggaagaagcagtagaaggtctagatggggtggatgaggaaggtggtcagcaagataatattgatgatgatgcggctgttaaacaggaagctggtatatctagtgaaggagccgaagcggctgctagtgaagaacgagatgatatgggcgcttcgggtggtgctgcagagactcaagctcaggatgaaattgaagagaatgcagataacacgcaagacccttcctccaacgaggccaaggaatcgttgaaacagttaggagattcgttgaaagagtaccatcgtcgtagacaggagatcaaggaggcaaatgacgtagatgattctactgaacagaatacccataatcaacctgacgaatatcaacatttgaatggagaaaacaccgagctggaaacacaagcacttggtgctgctgataaagaccagattcaaactattgatgacaatatggctatagacgacgaagagactatgaccgaaaaccttgatactgagcaagaacagaatccagacaaagagaatgacactgcttctgctgaggacattgatgaccatgctgcagatggcaaccaagatatggaaggcgacaacagaaaggctacgattggagaaagaaagatcaacgattttgaactaggcgaacttatggaattcagcgacaacgagacagaagatgaggcagataagaatgaaattgaagagttgaatgttttagatatggccaatgaggatgacgctgcacccagaactttggatgaggctcgtgacttatggagacatagtgatttagctactcaagatcttgccgctaacttgtgtgaacaactccgtctcattcttgaacccacggtagcaaccaagcttagaggtgactacaagactggtaagagacttaacatgaagagaatcatcccttacattgcatcacaattccgaaaggacaaaatatggttaagaagaactaagccaagcaagcgtcaacaccagattatgatagccgtagatgattcgaaatcaatgtcggaatctaaatctgtggagcttgccttccatagtatagcgcttgtggcaaaggccttgacgcagctagagtccggaagtctctcagtagtgaggtttggggaagatactaaggttgttcatccatttaatcggccatttacccccgagtcaggcgctcatgtattccaatggttcgatttccaacaaacgaaaacggatatccaaaagatgtgctctcagactttgaaattgtttaacgaagtcaaggctgatgccgatgacttgtggcaactacaaattattctgagtgatggtgtgtgtgaagatcatgctacagttcaaagattggtgcgtagggctcgtgaggacaaaattatgttggtatttgtagttattgatggaattaattctaacgaatctattctggatatgagccaagttcaatacgttcctgatgcgaatggaaacatgcagttaaaggtcgaaagataccttgataccttcccatttgagttctatgttgttgtacacaacatcaatgagttgccagagatgctatcactgattttgagacaattcttcagtgaaattgctggtatgtgatcaccttcttcctggtaaaacaaacacgaatagtagtagaagtacaaatgttaataatacgaagaaacttactctcacgtagaaccaaaagcctagtttaccttctttatggtacttgcccaaaagtttaccgacattcgtcaaggaccactggttcttttctagctgttcactagcttccttgagaatggatgcatcttccttgagtttcccttggagagaaagtgcggactctttaagctgggatgttaagctggaaatgtcaaatataatgtcttgatggatggactcgtggtaaacattttgctcttccaaggatctggcctcgtcaagtttagacggagcatttgtggacaacaatcgctttctcaatgcttcaaagtcatcgcctgatgatgcttgcccgatatcctcaaggtgtgattccgcatgcttgtcaagttgagattgccttcgggatttgagtcgttcctgctcctcatcaaatttggtcttggaatcttccagcttcagcgtgttgataaagatatcttggtctattcgttgactaacgttgtgcaattttgctttggtggggctagatgactgatagttgttctgtattagttgctttctgacatataagcagtcactcgccaaagaattcaagtagagtagcttgacaaacgtttccgaatcaccatcttcaacctggaactggtgttgctctgccaaagtatttaggtcgtcgttttgggggtcgctagatgcagttttgagtgaaccgtttgatacaatgctgagctggtcactgatattattcagcagcttatcaaagttcatggtaactttccaggcgatgaaggagcaaggttgagtagatacttgagatttgccatgtagcgaaatctgtcaagtcgatggaggtgatgagatgacaagactggtaacaaaaaatacactgaacaggctacgataatactacagaacgacatcctatcaacacacagaaagtatgaaacaaacacttctacaggagcacggtctcagcgaatacaaattgtgctgaccgttgcccagaatgtgtgcctacctactatcaacaacgatacattgattgttaccggggttagcgaaggcggcgatatcaatctcgacacccgtgggtaagaactacccaccaacttcagatccacattcaaagttttgtggctactcaagtcttctagtgtcttgaagagagaagaaagtgaaggaaaacgctaagcatttataccaagagcatattgagtaatgcacgataaacatccaaattaaatataatatacattatgtagcccgacttaccatctaatacatttcagtattcttcacattcttcttcttgttcttcttattatgcttcttacctgcggatggagcgccaagtttgtggaaagggttggagacaatcccttttcccgaactcatcttgaaaaactctttatcaagctcttcacttgcgctgaataaagcggcctgcttaccaccatagttggtaccagtgtaagctgctcccttggatgatgaagaaccaacgtgacccgaaaatgttaacttggaaaggtcgctctgtaagtctaaaatgtctatatgcttttctttagcagcttgtagtaactgttgtcttctggactctggaaggtgatcaacagtgtacaattccttattgaaatctttgccttgttctatggtgattggagtgttgtcatcattgggaggagggcgaacatacagcagtttaccgctcacataatcttttaagatgtaacgggaagctcttgattcgtcagcagctccaaaaccttgagtcatgtatcctctagctctagcataagcgtttagcaactcttgaggagagggataacctaaaccaccttcttcaactggtttagttggaatggcaataccatagacggcctccaagaagaatttcggaatacgttgacataccaactcaactggaccagtgtgttctcttagctggtcgattggcaaaacaccattacaaaccagctcaccattggtgtatgcaaagttagggaaaaccaaacctggacaatcacataaaatcacagagtcggaaagtagaattgtttgaaagtgcttagtcttaccaggggtggaagaaactgaaacttttttagatcccaccagagcgttgatagtggaggacttaccaacattaggatatcctacgagaccaatttgtaaacgttgtgtttgaccttcaaggggttcggtaagtggacctggggctgcacgaagcaggagatcttctaactcattaatggttatgattcttgtgtgttcatcttcatcctcaccgtcatccgttgtctcattttcatgttcgttgctatcgacatggcttgatgatgggagactattttccttatccgtttcctcttcagaatctgcaatagattcttcgtctgtatcttcaaattcgtcctcagaatcgtggtcagatgagctatcttcctctgcattttcttcattagcttccgccaaaagcagctcattagccttagcagcactgaagaaagtatatctaatattattctttataaaatactctgcccatttgactctttgggcttttgttaacaaatctgctttgttaactagaagaagattttcttttctaggatctaactctttgacacttttctccaaatcctttgacctaaacaaaagagggtttcgggcgtctacaatctgaaccactagatctgacctctcaataactctccacaattgtttccaaacttccaagtttctttcaaacggagtcaatagcaagtccttattctcttgcaaagcagctagctgtcttctccatttcaaaaaggcctctttttcctgtctctctaattgaaacttagtcattgaagtgtcccaagcaggtctccttgggataatcagatcaacttcgtgttctttttgcagatcgtgcttcttcctttcctcctccttagaaagaaggtacggattctgcctgttgtcaaccttgatgatcttcaccgtagatcttttctctgcagtgaagtctgtgtctgccagttcagcagtgttcaaaaagtcttccagagcattctcatgagtcacggatctcagcttgacccagtcggcctcccgcttgtcggtagtaaatctgatatctccatcaggaaggtactggacctgattttccttggcacggacactggcaattgtttttcccagtccaacaatgttcttgttcttgtgatggacgggttttggacccttaggaggcttccacttcttgggagcgttcttttctgggggcattgtggtggcaattactaaggaaactagagttgcgttaagattattttttttatcgatggtagaaaattttctcgaacgtacatccagcaacttttgattgcgattcctcttggctcagtgtgaacctgaaccctccactacgaagggcagagttggatagatttgtcatttctggttaccgagacagccttggaacatggccacaaggcatcaaattactgaataaaggagcatcaaaagcgagggctgtttatctgcatcggggccatgcagggtgttagtgtcttgcaggatcgttgatgaaaagaaaaagatgctgtgctggtagggttagtcaaaattggaaataggcagcccgaaatgatgtctaagaatgacactaccctgtaaactgcattcgccaagataacccactgaatcaagtactctaagacgatcgcagtcttccctaattctctgatacaaaaatagccttccagttcactccaaacgcaggagaatgtttcaaactaatccatgccgtcaattaaaagtagtccattctccaaatcatttaagcagcattactcgtcgactttcccaaaaaaattcacatatccagccgtaacaggtccccatactcactcttgacacattcaccctttttggcccggattaattaaaaatagaccaaattcatacctcgaaaaagaaatcttgaagtcacgtgaactctcattaaggtttaacggttttgtagttcttggaacttcagatcggtttcaatgaaaaatctcgccaaaaacagactaaatcgccgtggtgaaacatctcattcttccctcgtacatccctgcgacaaaataactcggtagtgttattcttagatcgaaaaccaatgaaagtttggcccttgatcgagatcccatcacgtgatgtgatgtaccttttgtatcccaagtttttccctcctttccatccgtaactcggtacctaaaccgtgctccttgctatcaaagactcttcaaagtcccaaagtgataccaaaggacaaaattgactctaaaatgactatggtaagtttttgaaagcttgtcaacatttttcccacccaactccatactaaccttctttccagcctaaagctatatcggacgctcaatcacttcaaactactcattacaccgacgcagagtccaacttttcgaataattcacgaaacatacaagacagggatgattcaagtagtgggactaattcggcagatcgaacgcaggaagttagcaccatcaactcacagcccacagttaccgatgcccccatctattctccttccaataaaacagcagaccgttcaaaaacggataacatgagtgacacctcctcttcctctagtgacgaaccacagagaaccagatcccaaattattagggactatagatatcagcaacgtcaaggattcaagggctacaacgaacaaaacatcgcagagaacagtaaaagctgtttggtccaatatatcccatgcttaggcaatctctcctgtgaatgtattggatccctctgtgtcaacagcttctgtaactttggtcaagttgtaaagagtgctaccacaataagataaactcaaagtcatattaaccagttctaatgcttgcaggagaatatttatatatataacgaacgtctagataaattggaacgcttcaagatcgtgcgttaattcgggaccaaagaactcagcgacagtatccctttcatacttggtcagtttcaccagtttctctaagaggtcgtaactaactgagtctgaaacaacactatcttgcttgtattctggatgcttaattacaaagtcacggataaatcttgcggtagagggtatttcgccactggtacggagtccaatgaacttgatatacaccttcaactttcctaaagcatgatcaaattcctgagatgaggaaaactctttcgaccacagcttcgactgagaatcaatggccttattaacgagggaaattaaaccttcaaagtcggatgaaccatggaaaacttctttgatggtcagctccttgattatggcgtcgcttttgactgactctgtgttgactctgaagtggaatttgtcctttataatagagtctacacgatgggcagtaaccatattctcctctatcagggagacaggtaagtaaaaattgggtctgaatagtaggatagccttggacaacaaagtgaaaaagacagagtaggctgcgttttcaaaactggtgatgctaatctccattggtcttaactctactctccaacctggttgatccttttgatcaggcgttgcaaactgagtagggggcttgaatctcaaggtttgccaattagtgctctggatgttctcaaaatgatcgttctccttcgtgttgtcctggtggactcgttcattgaagatcacaataggatccctgataaacaggtgggcaaaatgatgagccaaggtactgtcgaacccatacgatagcaaggttttgtaggcttcttcgtttatgggagaatccaagtcgttgtaactctcctcattgaatgaatctgaagggtcactaaggtactggtcaacggagtcatatcgagactttggaattctaataactggcttaccttccttaatgttgcccttggcaccatggcctggtaatggatcgactcctctttcatacggagttctatcatccacggcaccagatataacattccacctgacatcctgatcagccaagaatcctctaaatataggtgcggaagcactggctgagagtgccaagggagcaatattcatcaacgaatcgtacaagtatctggcagtcttcaagtcctgcgcttgcatggtgatttgtaggcaagaagaacccataccaaaacccatagcatccatataaatatgaccaggtaatgcggcaccttgaccagcttctgcgtcactgtatggaaacttggatctgttgaacgggatggtaggatccaactcgtcatcctttctggtatacttgtccttatacaaaggaatattgatagccactttacaacctcttcggcgacgaatatttgctgttaacgtgggaaacctaacatgtctattggtgatttcctcaggtacaaataacgactttgcggaaggtccgccgacgatggcagctggaaaggtgaaatcatctgtccccatccttgggaaagttgtcagtgaaatcaaaactgcatcagggtctttcaagtacttctgagccaattgcctcctagtgtccatgttttcttggacatacaaataatgagacagactgtcaccatcgtaaggtctgtaaggagtcgcctctatcatgaacctaccatactctggatggtaagaaacatcacgctcatcgcagatcttctcgtcggctaagtcagcaaaaacgtgatcttcatcgatggataattgcgcctttttggccttcgaatccatatgtactaccatatactcgacttcatctccccaaaaatatttgtcgtcactccggttctttgctgcttcgaaacaatgatacagttgctctaacgcgttcttcttaacgtgatcacagtagctcctgctttcgaaccacgagtaaggtgtgcccaacgataataatcccatatagtctactgcttttcttctgctttgctgggctctgattctgagaggagtttttccggtgtcagattgaaagttggagatctagatctttagttgcaccaatatgccgccacgctgattgccaatgaagaactaacaccaacactagggcctattcggtgatgcaggtctaaaaagttgacgggcagaaaattaaccagagactaacacacccagtggaactgggaacaatttataatcgaccccgagctatggtgcaatcaatactatatagatcggttttattaaaaatgaggcttatataagcagcaatgagaataacaataatcattcgacaacagcctgatggatattggcctgccatggttcatcagagtcgtgatatttttctaatgggaacgcatatggaaccctaatgggtacaacattgtctttatctctgttggggaagctgtctctcgataaaataggttttagttggtagtcttcgccatatagtttcggatggataaatatgccagcctcgtaggaactgatcttgtattttagcccattgctccccttcaatgggtatccccatgcttgtttggagagattggcactcgttaataagtaccacatgaaggtctgaaacccgtcgttggacgcacagtatgttttaacgtggggtgccaaattgctcctaccagctttttgattcagatttggatcagaattggtccatctgtacatgaattttctgattatattgtgctggttcgttagaaatggtactttatgacttgagtcatcgatgttgtaaaaaataccactagtgtattctttcagtacggaaccaaacacttcgttcttagttggaaacaccaagaacgggttgaatggatgaacatcatcgtttatagctttctgtaagggctccaagcctccggctatcgggaatttggttccatttattaacggtgctagcaaatgagtgaaaatatttgatgacctgaaatcaaagggtgaggctattgtggcaacctgggccaagatatcggtagactctgtcgctttgggaaataaattatttaatttcaataattgaaacaactttccgtagccgtattgcacacttctcttcaaccgatcatcctcttctggaattgtaaaagtccctgggacagaggaaaggaactctgctttaacgtttccaaaatcatataacttcaactcttcggctagaagatccagatcgtgtttattgtatgcctttagataagcaagaaaatcattcttaaaggatgattcccttccattgcctttagaaagcattggagacatccaaagcccttgagtgtttcccacaaaatccatctctgtcatattagcactcattacaacaatctgggcagtgccatcacgaaagaagttgaccatcatcttggtatgatgcgtggcaaaccgttccagttggatatccacatgccgtagtttaaatctcattctgttctgctgggtcatctcaaccaaatattcagcgctattaataaagtatatttctgtgctcaaaggatccgaagtaatgtatttgaggaagaagtcaacattgatgcagaaattgaactggtatgtcttgcttaattgcggagacgacaccaaatcttttaatgagatacagtctatgttgtcctggggtttatgagcgggagagttaaataatcgtatcggactctggacggtagtggtgtcaatagcagggcgatcttccgcatcttggtcatctgtaagatcgataacttgttctttctcttgcttttgtgtcttactatgtttctgtggctcctcttgggcatcgacctgctgttccttagaaccttgggcctcagattttttgggaagtattggtattgattctggctttccatcggagcggccaatttctacccatttcacctcgccttcaacgttaaccttggacttttttgaccaatgggcagctgctcgttcactggcagcacttcgtttcccactcattaaaaggtaccctgagcaacgtagataggaagaggcagaaagaaacgctcctcctcccagaaggacaaatcgtacttgcgcgcttttcagacctcttcctagttccttcaaatgtccccactacactaacgtacaggtttttctattttattaaatacacaattcgataaactagtacaatctgtaagatggacccatactggacttgatgaccagagatccaacgttttgccagttcttcttcaacaaagaaaccaagaagttgacggccatcatgatctggttgaccaaaacgtcctcctccatctcgacgttaccaacggcaacagccaaacacagaaccttcttcaattggaacttgatggtggacttgacatcggttaccttagagtacaagtcgtcgttgtgggagactggagttgggaacttaccagccttcgacaattgtggacccaaaagtcttgggacttgcttgatcaagacgtcagaagcaatgaaagagttgtacttcttagccaacttcttgatcaacttcttgttcttgttcaatttcttcaagtcgtcaacggacatggcgtcaattcccaaagacttggctctgtcgacgtcaaaagcgtcaccgaaaatacaaaggttcatgtttggtcttgggacttgaggcaatctcaaagaaccagagaaacgcttgtctctctgtgggtcgtagttcttaagaccaacttgcagctcgacggtctccaagaagtttctcttcttggtctcgttggagaaggtcaaaagctccttgacatgctcacggacttgggtggtagaaatcttggacattttctattaattcgtctccctagcaaaaaggttgtaggtaatcccgtaaaggtttgattcgacgatggatagagaagggaaaagttggaacactgaaaaaaaatttaacgaaaggtaagaattctcgcgacgagggcgcgagccctaagtttcaagccggtgttggggcaaaaataatatttgtcacgtgatactttatatctagactagcaagataagataaacgacacggaattgtcacacaggttgtgcttagctacgttcatcacatgatacagcatccttctgtgtcgctgctacggaggcagtttgctaggtttgtttccctgaaagtaaaaggaaagagttcatcctctaggaaatggctggaacgtcaatcatctgaccccttcacaaaggaagctcacgcaaaggcattgaaatcaagggcagcgtttaagctgctccaaatccatgagaagttcaatatcttccgtccagggcaaaatgtcgtggatttggggtttgctcctggtgcatggtcccaagttgcagccgataaagtgacttccagaggcaatattcttgggatagatatcctagcctgtgagcctccaaaaggggtgtcttcaatgcaggccaacatcttgagtaagaccacgcatgagatgataaagactcatttttaccagttgaacatggacaaagaccttagaaagcttcaagaaattgaaccaatagcggatggaccttcctactttcaggctgaagtagacgataacctcgagataagtaacaagcagaagcagcaattccctgtggatgtggtaatgagtgacatgtgcgagcctttttttcagtcttcaggttttggatcagcaattactaacaaacccttccataggatggctaacaccactgggatggccttcaaagatcatcttttgagcattgtaagttgaatatgagaaaatggggaattttaccggttttactaacaagtggtgttctaggacttatgcgatgccgctttaattttggccatcgacattcttaaagttaatggcacatttttgtgcaagttctttcaaggaaaggaagataaactcttagaagcccggttgaaaaaatgcttcaaagtggtccagagatataaaccacctgcatctagaaaggagagcaaagaaaattatttcatttgctttcaaaaattacccaaccttgataaaattcaagtgttttcatagtaagagagataatttgtaaaatacatgtatagaggtgagaatcagattctgtttacaccaagttatcgagttcatcatcgatgttttctccgtaagcatcgtcttcttcatctgtcagttcgtcaggtttaatggcctcagcttgaaattctggtgctacctctggggtagatgctggtacaaatgctggtggtacctgtgctggcgtcaaagttggttgtactagctcctcctcaacatgatcaggaacttctacagcaactggagctgtgactggggcccctgaagaaacatctacattatcagacacgtctatcaagtcctcctccttctcttcctggttatctccgactaatgggaacttgtcagcatccacagctggagtacagatacgctcagcaatgctctgttttccctctgcaactagcgacttcttccatagctccacacagtcattaattgttgtcttgtcaccggtgtatgtgagcgcaaataatgatgcttctggaagtctgttggactccttcaatagttgcgtagcccctttgacgtcattggcagcccagtaggccgaaaaagaaacattatactttcctacactcttggataggtctgctagctttttcagtccttcagtatcgttcaatgatgtgtacagcaacaatagagattcgtgatcacttgacttttcgaatgcttcaacggcaacttttaaattccatgctgcaagggaggcgtcacctagcaccttccatttttgttcagaatcagcttgcaaggcaatttcataggcagtatctaggtcttttagttgaacagcaaaatcgaacttctgatctttgttgtcagtaattttcagggccagttccttatatccttgcttatcaaggaatttaaccacttggggtaattctgattccggaatagtctttaaaatctcatttgcatgttccaaatctcctctcaacacaacagtctcatattcaagcacgttcaatgataggtggtaagatacaacgtttgcattcttgtcaacaacgtagatcttgttgtctcttggaaggtaccccagcaggaaaacgttcttatcaaaatgagcaatgttgctgattgctcctcccaccaggtagtttagtctgttggtggcactagtatagatgaagacatcaccggcccatttaccacttgctatggactcgttaacgtcataaagaacttcaaacgactcttcacagccctcttctgggtccagattgttgcttgcgagtgcttcagaaaatatatcacgatcgaatcttaaagcataggctgactcagatgatataatcaagacgagctcaccagattcagaccaaacaacatcggtagcctcaacgtcgactcttcggactaatttcccagattcccagtcaaagaaggagacaaagccttcagatttgacagcaagcaatgcacctccaaaaattttatcggctgagtaaaccaattcaatagggttattggttcgttcttggaaattcttgaaaattttaaccgaatcaactgactctctgatagcatacaagttggaatcatgagcccacacaaagtctagtgccgatccatatgatttgtttctccaagccaaagctgtgtatatgatgtattcaccatcaccggtaactgtgacaaatcttccgttaggcgaatgcgttagagaagtcgggaaaatttccacagatcccaactctttatgtgatagtggcagcacctctccatctggagtgttggcagagtcggattgtttgataacagaagtgaaaatgtcggtgttcttggcataaatcaattttcccaaggagtccatagatacagaaggcttgtcatctgccaattgcaaaaccacatgaccagcgtcaaaaccaacagccactaagttggatccttttctgaatgataccgaccaggctctttcaagtccgtaattgagggatttttcaagtttataagtgttggcattccaaaccttgatggtcgcatcctcggaaccagagacaattaaagggagctcagggtggaatactgcaaatgaaacattagatatatgtccctctaacacagcaacgcatgatttagtttgataatcccaaactttgatagtcttgtcatccgaggacgtgattatatatggtttatcactttgggcataatattcgacatagttgacacccttggtctcatgagccaacagagtgaaatttggcacactcaatcccaatgaccaaatcttcaccgatctgtccaaagaagctgaagcaaaagtgttggggtcttttgggttgaatgcaacagacatgacataatgctggtgaccttcaaacacttgttctaacttccagttgtgatcccaattccataactttattttactgtcatctgaacaggtcaaaacataggatagtgtaggatgaacagcaatagcacgaatgtagtctggatgggcttcaaactgtgccactttttctccagtgttgtagttgtagactcggatctgaaagtcatcagaccccaatacaacccaattcttacgagcaatgaatctacctgctctcacgggaacattggtgatgtcaaaggttttgaccaaagtacttgtttcgtaggaccatatttcagcctttccactgtacagagtcgttagcacccagggctcagatggatgaaagtcaattcctttcacacgatctgaccgtgcagaaaaagtctttttgatatctaatctcattaggccagttttgacggtgttgaagatactgacacggtgtagatatcgatctggtgagccaaaatggaaggaagtgttgaccacgcgatgggggtcaagctgtgctaattgggcggtacactatgagtattctttatatgaacgggaggagcttcgcggagatccaggctgggtgatggtgctagggaagggagggcttatttttcaactaacttggaaatgaaggtaattcagctggaggtcatttaacttgttatgaccaataagattacgatcttttgcctttagtctttcattgctttcatctcgatagtatagtttcgtcacgtaaaattgacctattcaaacactacccctagtgggagtgtacttaccaattgtttcaacctcctcattgtacttctgatttgtaactacgatcttactccgattcatatcaagactaatcataaacaaaccatcaataatgtgggtactaaactggtgtaagtatcttattttggatgtactcctccccttttgtcgtttgccatagaagatctagttcaactaactgttaaagtccaggatgtgttggcatctttagggttatggaataagcacgccaaattgctgtttctaggtttggacaatgctggtaagacaacgttgttgcacatgttgaagaacgataggttggctactttgcagcctacatggcatccaacttccgaagagctctctatcggaaacgtcagattcaccactttcgatttaggtggtcacgaacaagccagaagagtctggaaagactacttcccagaggtggacggaattgtctatcttgttgatatcgcagaccctgagagatttgaggagtccagagtcgagttggacgcgctcttgaagattgaagaactttccaaggttcctgttttggtcttgggtaacaagattgataaatctactgccgtctctgagaatgaactcagacatgcattgggtttgatgaccactactggtaaggacaaggttcaattggttgaaggtcaaagacctttggaggtatttacctgctctatctacttaagacagggttacggtgagggtatcagatggctctctcagtacatttaataggtgggtaattgtatcattttctcacttagtatgactccatcttatttgtgattcagacatagtggtctatatgggttttatttatccgtttaatttctgcgcttttttccaccgttccgtgctcctgattgggattcacctcctaagcttctcttcttaccttctttagagaagaaatccttcttacgctgtttatctttgtcagatttgatttcttcctccttggccagcttcttcagcttttcttcgtattttgtccttttcttttctgcgttcttggcttccttggcctttttcaaagttgatatcttttctagcaacgctactgccttcttttcttcatcatctagaataacagctcgcttcctggtcacgttgaccaagtcatcttgcttcttgggtcttggaactggaatctgatcagcaaatggcaattcagcttgaagagcttttggaattttaacaggcatgaattccaattcctctctttcaattttcttgtaggcactgttcttggacgctggaacaggaacgttgttttcatgtcttacctgtccggtcagcctcattcccttccattcagttttatccttcaacagcaaggatgttacagggttataaaacttcttggcttgaacaggataccatgttcgcaaaaatacaatgtctgacatctgaatcttatcttcaaatgctgctctgaagtatccatcaggcttggacaaggcacgcttgatttcaccacggattcctgaaactgtcttaatggaggcaccctcaaattttgcaacttccaacgcagaactgaacatatctttgataaaagctgtgtttttgaaaaccttgtaagggtatccgaccaatttcagctttttaacaatttctacatctgcattaagatcttcaacaacaccagtggcggcaattctgaagcttcctgtagtagcagagttgctcacaacttgaaccccacaaaatgtggtatttggagcaactaatggtccataaaacgtggcaccgcagtaggcatgctctggggtgtatttcaacattctggttcttgttctagaatcagttgtggtgtatataggtaacgtttgaaatctcctccaacccaaagataagaccaaaggatcgtttgttttcaggatcttcttatgccacctgtgtcttctaattctcacgttaaggtatccaaatttctcctctgtttgcaacaggcctccaacaataacaggataaataggattgaaattttcgacaaattccataggaacattcttaaatgtcagcttgacgtatgaaccggctctataaccttcaatgtgtaatctcgtttgctcgtccagctcttcaagctcagacttgttgatctctaactgcttagccatcttagccttctggaattcataccatgtatcatggtcttcttgcccttcttctaaaaagttttctccctcttcatcttcaaactgttgacgaagtttttccttctttttagcgttcagttgtcgtttctcttccaacgtgagttcttcagtgccttcgacttcggactcttcttgactggaatcctcgtcatcttcatctttttcttcttcagcctcaaaatcagcaaaatcatcaccatttacagagccattgacttctttgctttcattttcgtcttcattatgcgtgttttccgcctccaaatcttcaaagtcaccatacgcttcatcctcgtcatcatcaatatctccattcttatttttttcagaaattttctgttttggacttttgaaaaatctctttttcagggtgtccagggggtcaggtttcacccatttggatttcagctcgtcaagcggtgcaaactccaactgagaggtgtccaaatcttcagatgaaccttgaacgtccttcttctggaaaaacgcttcctcctgttcgatatctgcttcggaagaatcctcattatccagttcagcctcttctgatttccatctagcaatgacatctgcgggatcaatattgttaaggtaaatcaacttgttgatatcccatttcctctgtacagaaccggtcagtttagaggccattccttgccagtcttcgttatcttccaactccgaatcagatgcaaactctggtttttcatcatcttgcaggtagttcttgtcaaactcaaactcaaaagtgccattttcattgtcctgatcataaactttcgggtcatatgcgtcttcatcaatgttgtccagatccaagccctcgtcttcattattggcagacttgtaaactctaggcttccttagttgagatcttcctgtatttgatttcgatttggggtcgaattcctcctcgtcctcgctgatgtcgtcttcatcctcttcttcattttccttattttcaactttctccaaagcggtggaactgctgaacagttgaactccagcagctccgttcaactgatcttggaaatccttgtcaacagactgaagatcggtaaccaattgttcacctaaaccagattcttcacctttcttaaagctctcctggtttcccatgtctatatagactgcatctctatcaatcaagacaccgtgaacatcagacattggagcataaatgattttctgtttatcctctagtctttttctgcctcttcttctggggagaacagtttcaccattggcagccgcctctttaacggcttctctctcaatctcgtctagtttctgctcgtaatatggggttggacaaggatctggaagcttttccacagcagcaactgtaaaatcaccagctccaggtatatgcaccctagcattggtaggttgaagaggcgtaccgtgaaggtatccgtataatgctacagttctgtcgattttccgattcttctcgatttctcttggatgtgttaggtcaatcattcgatcaaccattaaatatggatgttcatttcgccacttgaggggcctaaacttcataactgagataaatctggtaaggttcaacgtttccctgtctggatatctaccattcaacacaccactgaggtagaacaatttagcacccgggtagacttctgaccagaaacggtgcttcagctttttcttggaggttctaagagtagattgtgatttgaataaatctaaatgggtggcgattcctataaccctgggcataccatgatgttgggcgatgttcagaaactccatagtttccatttccaaaccaaaattaccatcgaccatcaacaagaccaaatctgccacctttgcaatatcaatcattgagttcatatcattggaaatctcgataaatgtcactcttcttcgttttccactgaccaaggttacaggtcctgttatatcagtcatcgtggtctttgacaaccgtttgaccagggaacgaattaaagtggactttccggttcctggaggtcctacaacggcaataatcaccggaggaggatcgtcatccggggtcctattcaccattggaacatgaagccttttctcattcatttcactgcttctcatggccatcttctgtagcttcccaggagcggaaacggcaaatgcctttgcattatagccctgagtatgaagcttcttcttatgaccatccttcttggcagcgcccctatgggacttgtttgactgttgtgggtccatgaaggagtgatagaaagggtagaaactgactgtactatgggaaaaaaaaattaggaaagggaaaaattgatgatgaggtaaggaggaactagatggaaaaaaaattccaaattatggaactactaattataaaagataccttgaaaaagtttttccgaaattataattaatatagcagaaatcggatgaatcctcctcccctgccttgcgcaaaatcacaaccttgaaaaaaacaattaactatcttgtgcctccccccactccagttgccgactcctttcaccttcgtgctacccccaccccccttcaaatgatagacatatcctcaaagttaagacgggatagcctgtctgacacagatcttaaccaagacccaaaccaaaaaaagattaatagtgagccaaccaagttgcttctctcagagatcgcactagaccctattatacagtcgttgccccacgttaaagatctgaatgtcattcaaccagcggaggctttagctctcttgaataaacttgccaccgagttgctctcattgtatgctgaatatgagcagcatgggtctatggatttagctccattgctgtacgacagctcaaagtatgccaagccaggttctgacagtcaagaagagtctccaacgcctgtctccggttttctggagcggaaactttccatgattgatcacagtgatatagacaagatgtctgattcgagtcaagctgatcagttcaaaattcgtactatttccagcgattcgtttgacataccgttaaagtcagaatcgaagctgggttataattttgacgatttagaagagggtagttcgacaaatgaaagttccctgagcaccttgaataacacctacgtcgacaattcggtcgaacaaactttccagaacgaggtaagctttgaaacttgtacaaacattgtgaaaatattcaacctgaaagctataccgtccctttctatcaccgcctatttggaaagaattcactcgctgttatctccatcgactgcggtctatcttacggcttgtttatacttatacaattgtgcttttcatttcaaaacagtcagactcaagcagaggtctcacttcaggccgagtcaacacactaatattacaatgttgccgataaatgaactcaatatattccgtttagtatctgctattatacggattgcttctaagttgattgaagacaagaactttaagcaaacatattactgcaaagtcgcagggcttcagagtatgaaggagttacaaaatttggaactatcattcctctttttatttaatttcaatctgtttgtgagccgggaaatacttctttctcatttggatcagttatacgtttttttcaaccgtcgaacccagcttaacgtttctgtatagctgaccgctgaggctaaggagactccttctcccgcccctgcagcacccccacccacgaaaggagatagtatatttgagtgatagtgtttttgcgacattagggttcacaagtatcatcaatgcctctcaagttatacatctcatttgctttatacctgatagctttggttcattgtttaatattgccagccacttccccaatctgtgagttgccctatgctaaatccttcccttactggggatacagaatacaaagagagtactctctcagaagtattaggggacctttatttcactacagtgtattcatacgttgccggcaaagctcattagactatgaacacctcgtaagattgggcagagaagaggatattccttggaacacaactttatgcttttccaatcgtctaactaagaaatcaaaatctactgtcaacaacaagtcgaaggaatcacggaacactaccgattcagcagcgaacgaaaagccaactttcagtccactgaatagagtttacaaaaaactgttcaagagatttgattatgtcttgaccaaaatggcccgatctcgctttctgcagtatgcctcccaccgacaagacgacaaggttgacggaataagacatctaccttctaaggaagtactgtcagtttctcttgaagatttgaaatgctataaattggtaagaaggaagaaatatgtgacacgtcagttatctctctataccccttatcgttttatcggaggtctatttgaatgtcctttatccaaagaaactaaaaaggacatgctgaaatcggcctcggccctagacttcatcagcccgtaccagattccttgtgattcaaacactgctgttccgattgcacctctgatctctgacgatatttcgcaacagctggtaaaccataatattttctccagcagaatcacagactttcgaatcaatattatccaaagaataccataccttttcacaccatcgtttctggacccccgcttttattcctctggtgtctttaaaggccgctacagtaattggtttgacgaactagacatcaatgaggattacgatttaagctcacttgatgaaagcgtgatgtcaaaatccaacactctgtttgctaactatattgcaaaacactttcgattcaagaatacgaatcctctcttggtgtgggagaggaatacatccaacacacatgatgatgacaatgaacaataccttaaccgcaagagcgatttacttaaccaagtcctatctcagctcgttgaatggccttgggatgttgctaagcaacatctcaccaacattcatcagatactcgacgtggattcatgaatttgcacgaacaaacataatataattttacaataactactcaaatgtacttatataaactgtctttatcctctttatctcctccactaggatttcttattgagttgcccgacaagctgggcgagttttgaaatacaaatccccttggatctccgacgttatcactagtgaaatcactcgtcataacaggttggggaatcaagtcaggaaaagatgaatcattgcccacacgcgctgcttggctgttgactattggtgtggtggaatcagtccgtttatgaccgtcatctccaaagtttaataaagtgtccgaaacacgcttaacttctgttgtgctatcatcacctttagtcacatcgcctgtgttacctcctctcttgaaagcattcttgaatgacttgcctcgagtaagctttctagtaaacatagcaccaagagaaggcttttcttcaggctcagccagtaattcgtccttctcggtaagttccgattgagatggagatgaatcaaccatgtccttcaatttgtacatttcactagcccagttttcttggtggttttgagcaacctgtcccaaagccgctagctcggcagttccatctggagggtagtcgtcattcttatcatcagcgccgtgcctttggaatgacgttctgtcgtccttagcgggagcaaagcgggcatctgggttgtttgtgaagatagccatacaagtgtaaacaatgatcaaaatcaacaaaatcacggtgaaagcagcatttagaataaagaacacccaacccatgattggggccactgacacattctggttaaaaagttgagaaaaaaataagaataagaaagaattaatggtcattaccacgcaaatcatgatgttagcaatgttggtaagtttatcaaggtatggcatctggtgaatcacgaaagctgtgtagaacaaatcaatgatgaaaaatgccagcgcctgggccacaccagaaccttgacccagaccaataaaaatacatcgaatgaaagtatggataagaacaacaataccaaaccagtatttttgagctttgaataagctgtagaagaaaccatactttcttagaacctgtggattaccatataataacgctgcggggttattgtgctctctgatggatttggaaccaaaatacattgttctataactggcccaacccatgatgataagagcaagcaataaaaacagcactgccagcactactactgccggagaatcatttctggtaaactcccagaaagatagaatggtcaactgggtaaatccaatataaatgtatcttagcagagcacctttcaaaatttgtctccaagaaatcttgaaagctaataatttcgagttcttaatccagcccattctctttcccaaggccaccgaacttctgaaaagaacaatgattatagctagaacataaccacacaggaagaaaaacgtgaatccagtgcaaacaatactagttggttcaattccagctttgagacccacacgctcaatacctctcaagattcttaagtgagcagttgatctcaacgcatacaggtcaaagtctctagtttgatatctgccagcaactagttcttccaaagtgtcagctggagttgtaacaaaactgttagcaaaaggaacgtagtccgcaatgaaatcgattgaccgttgaaccaaaatagaaatagtggtggatgtcaaatataaggtaggagtaccaccagttgcttggacaaaccaacggaaaatcttctgcatgaattcaactctgataagtcccatagaccaagccaggttttctgaccaagcaccagcgatggggggaacctcttccacggcctgcatgcaaacaactactacagattggaaataaaggaagagtgatatggagtttgcagaaatgtgggacgcagaaatagaatttccaaaggcagaaagtaaagcacctgcgagcaaaccaataccagcaataacagcagtagcccattgggcggctatatgagacaccgttctaccgttggagaaggaggcctgcaaacaacccaactgggtgccatttgcattatgtaagacgacacgaaccactgcgtcaatatcagggacgacataggctatacttggaaccatgtcagcaaagtctctatcgatatattcaacagagtcaatttccaaagttcctggatacaaagggcagaattgtttccagccaatggtacacatgtcgatctctctttcaatgacagcaaatccataagcgtaaaccctaacgtttgcaataacattatcgctgatctctgaagtcatggaaatatcgtaggtcaaagcaccggtatctggagagaaagtcacgttaaaataagaaggatcaatcaaagagttgtcctggcaggtcaccaacgaagtagcagagagcgctctcctagcatctgccgcgcagaacaaagctcctaacgccacgaatatccaacctggcctcatattcaacgtttaaaccttggtttgaagacacaacagggtgtttaacgagtggggctaaaggatgtggtagggagaagtttactttttttttgattttcttaagaaagtaggcgcgcgcgacggatggaggtgaaaggtaatctggtgggaacaaatcgtctgttgttttggggttaatttcctccggggaagctacgagaaacattggcaagaagtagtatgctatccttggcttagcagcgtggtctaatggcgcagctgggacgaaagtttgttacgaaactggcagggccaagcaataatatgagggtttttcgcagttaacgatactgttcaccccaatcagcgagctatggtgatgtaatcaccttaccgtgactgggtggtacactactaaatcccagccaaggctaaattgtcacgctggagttatgagagcactggcagtgtttgcctagtggaatgaggcttagacgtgacatgcgcttagagcaaaccagtttgtttttccaagcgaagagaggaactttctgttttgttggaaacttttggggaacgtgctccccagtatcagacagtgtgttccaatgctggatttgaaaattatatttatataatattatgaataatctttcttatctatctatttttagctttcacaattgcaagagaagtactatatattaaagaaagttcaaaaaagaggttaaaactcaggaaccgatttttcgacacttccactttcctttgagtattgaaacggaaagaggagaaggcaatcagaagaggtgaactcaagttaaaggctcaattgaaaccccagacagaagctttatctggcaagtgtttagcgaaaaaaggcaaaggcagtgagtgactgactcaccagtgattctaacagtggagagctgtagcatgaataaatagaaactatttatttgtatacttgaccaaactacaaaaagagaggcagataatgaattcggtgaaagaagatttccacattgctgtaccgactgcttttcatgcagacgaaagcttgaatatagaagagacacttaagcacattgaccgtttatatcaaaaaggcgtacgttctgtaatgatatgcggttcaaccggagaacagcacagcttgagtacgtctgaaaaaatacagctgatagacagcttggaccaagaagcccgctttgctcctgatcttgaaattttggttggagtctctggtatccgtcaaaaggaggttttgcgtcttgcagagagagttgagcgatcaaatgcaattaaagcggtacttttgggctatccgccttatcttgttcccagtcaggctgaagccgtttgttatacagaaaaagtgcttgaaaaactaagcaaaccagttatcctgtacaataatcccttacgcacaggctttgatttagccgttgagtctattttgcatctgtttgataatcatcagattataggaattaaagaagctggtgatccggagaaaatacaagccgtacaaaagagattggatcggacagtctactactatgccggaggagagcaagacttggaaaagaaaatctctttggggtttaatcgtctgtcttcgattgccggaaatgtttggccccaagaaataagcaactggttttttaatcttttggaaggaaaaaatgatgatacagacaagatcagtcttttgctggagaatctttacaacgacagttttttggttcaactgaaaaaattgattattgcaacttcagatgttcagatgggaaactgcagagctcctctgggcaatttagagaaagagtagtttattttcaaatgctgttaagcatcatttcaccgttttatcttgatcttcaatggcatatgcgatcgggatcaaccgtctcaaaacttgtggtttctgggtatagagagttgcattggtgaaggtgcagacctggatccacattttctagaggatcaaaaagctgtcttccggacaccaggtcataccccgctaaagcattgttccatgttccttttgcaatcttagcttactggcaaagccgctcacttacgatgaaagttcaattctctgtaattctattcaatataatattactaaaattttattcaaaagtaaacttcccagaattgaaccacgcataaattgactaaaagtctttgcgggtattttcatcgttccgcctgacaatagattggcatttgaaacttcttttaaaatatgtaaagacagctctattacaggataaaaggccaagaaagataatggcaccgcctacaaataaactcatagccttgcgaactctttagtagctagctcgtgtaatttggtgctgtcaatttcaacctgatcgttccagacaatctggataacatcccaaaattcttccacgtagctcacttgaagtcccaacttctcttgaacccatttttcaggaagcccgaacactccaattcgttcggatttatttgagttggacagtaatgactcctcctctttgataagatctaccagtagcttatccctagaacttctgttattggcttccaagttagagataaagtcttgaatgacatctcttcgattacttcttggaaggatcacccttttaacggttccagttaaatgtgctcctagtagcttctcatgaacacctccaattggcagtaccatccctctcaaagtaatctctccagtcatggccaaatcccttggtacaggtttctctagcatcaccgacagaaggcacagcgtaatggtgattccagcactgggtccgtctttttgaatagcaccagcgggcacatgcatgtgaacctgagtagtgtcaaacctcttcaaaagatccccagaagttgaagtttcgtcatcctttaattgtagtaagttgtgactaaacatcgatcttataattgttcttgcgatcttgacactttctgtaagaacatcacccaatctgccggtcgtaatcatgttagtgttagtactattaggtataccggtcatttcaaagactagggtacttccatgtccgctactattgtaactgaggccgttcacgattccgtactttttagagatagctgaatcattcctcatattcttgcctgtagacaattccgggggtattccaatgtactttgaaagattatctaccgtgaccttggaaacgtatccctttggaatttcgcctggagcttgagtactactcatcaagctagagtattcaatagccttaccccgacagatactccctattaaccgttccaaattacgaatacctggctcccgagtataattgacagcgatgtacataatcacttcgtcaggaataaccaccgatggtgattcggcattcgtaggcagtccgtttcttttgatctgctttggtaataagaattgtttaacaatctccactttttcgaaataattgtagccattcagttcaataacctccattctatcccttaatggggcactgatcatgctcatatcgttggacgtacagataaaaacaacacgagacaagtcaagtgggaacccgatataatggtcagagaagttagaattttgctctgggtctaacacttcaagcaaagcagcagctggatcaccgtttacacgactaccagggccttgggatccatcgacaaccttgtcaatttcatccaaaagtatcactggatcaaaagattgagatttcctcagtgcttgggtcaatagtcctggcattgctccaacgtaagttctgcgatgtcccttaatttcggactcatccttcaatcctccaagacttactcgctggaactttttgttcagagcctttgcaatagattttcctaacgaagttttaccaacaccaggtggacctgttagtaagagaatgggtgctctggctttgatttcctcgtcttcttgcttggggttggacgttttaatgtgatcgtggagtttaagaactgctaaatactctaagatcctatctttgacggagtccattccgtaatggtcctgatctagtgtttctttggccttgtctagatcaaaaatttgttgttttacaatattttttgtttcccatgggatatccataataatctctaaataagttctgagcagttggtactccgatgaacttggttgcatttgagtcattctgttgaaatctttggtaacgagcctctttccatcctctgagatcttcaatttggagaggttgttgataaaatcacgcaattctttattttcgtcgtctgattctccagctttcggtgcctgatttgcagaatttgtattgggcgaaggcgccaaacgagttctctgagaaggactgacccgccttcttgaagttccttggatgtcttcaatcagtactctgaggcccttcaagtggttagatactaattgagacctggtcaaattggcagcaattttgccgttcttagtgtcaaaatctttccatgtctccagaacataatcaacgttcaaatatgtttcgaaaagtggattggcaaagtccaacgcgtcgatagttgtttggatcctgtctgtagaacttgaaatagctcccaagacatccaccttttgaaccatactgaaggggaacactgaagtgagaatatcattagttttcaaaatcttcttgagtaaagactttctgtttttggttgaatctaattccttcttagcggacttgtactggttggatagtctagtataagcatgagtggattcttgagatgagacagtggcgtagatcaagtgagacaacggagccaaaatcatcattgcagactttagacgggagttcttttccatggtagtatcttcaaggttcatcatgtcattttgataggtgactagaaactgtttgatattctccagtagttgcagacccttatcaatatttgtcaagatgagcttgttactgatggtctggtcaacctcagtaaatggtatatccacttccacagatatggttgattcattcatggagatggtctttttggattttaaagatcctctggttaatgcttcgaaggatagtacaatatcctggttaacgacggacacctcagttatctgacaaattgtagtggcaatggagtcctggtctgactggtcgaacccagggagacaggcaataacccagggaagtgacttgtcatcagacccaccaagttcaagttggtctttcaggacacctatgctcttcttagcattgctgctcaaaaaagggatatggtcataatcgttttcctgttgttccttctgcgagcgggcaatatcacctagaacgtcatttctttcagaaaaagactcatcgaacaggtctctaaaacgtagcaagatgttgaccccctcctggaacttgaaagtcgtcttgtagacaactccaggcaggaacaacagtcttggactcagctgcaacagcggcagtgttaggtctacagtggactcctttgaaacagtagctcccatgctcatcttgggcagaaaaacaaaaaccggctcagtattcttataggggaggcaacgaaccgatccgtgtagcgtattcctttctaggggatggattgtccaggataggataaatgcggagaatcggttgacatctcccaatgcgggaagagggtgtacaggtgttgtcacgtgaaagatacggtactaatgatcttcgtcacgatacataataacaaccataatacgttaaaggttatttatctgtacttggtgcggaagccgctatttctgtaactgatgcagttttgattgtttggctgtatatgtagtggttcgtccagcatggtgtaaatagattgagagagcttttcaaattgaacgtcttcggctggcggaaaggtacttgaagctgagcttaggaactggttacggtgacccttattgtcgatgctaccacggtgttttctttcatgttctattcggacatgctgagctggacagcaagtctcttcgctctgtctgctcgaagtcatatttggccagagcagttcttcctcatccttctttttgaacaatgaggcaaaaatatcacctagactgccagtcataagtaggatgaagagagatcgaaagtaaacaagccgagaggccgtaatatatgctactgaataccattgcagatcaagttcactagatgtttgtttctgttttgaatcggcaggcagtatgcgggtagagcgtgtcaaatgaaatttcaagtacggaatcagtgtggatcaatgaaaacaacggccagatttggtaacaacatcttctttcaagcatgagtgcgcacttatcttacatgcagcagatacaagcttggcccgcactattggcagctcatattcatcagttctgctttccaagagtactacctatggctggcttcataagcagctaatcccaatgccataacaggaaggtaaacaataggtgatagaaaatgattattacaacatagtatataattataatataataaataattataattataataaataataaataatcgttcagttagtatacattaaatagtcaacataaatttctatgatagccttcaaagatctgctgaggcatccgcagcgtctctctgtttcttgatctcctccaattccttgacccttctcttgaaatccagatactgacattgttcgtagtcgtgtctctcttgaacacaattccaaggcatataccatccctccttcctacacttgttgagaggaaccaacagtctggcacatctgtctctgtaggcaagaggaatcttgttctgtttcatttcctcatgggaaactatcaatgttagtttaatggtctcattggtgtgcgaatgtgaatagttcaaaggataaagttttccctctctcaattggccaatgtccttcgccgactcctccccggacattacacatcagaattaacgctttacttacgaagttctggaagttcactcacgcccatgctcttttgcaataatcgtcttttgttacctatgggccaaccatttttttcaccaatcgcttattggatatatattgggtacggcacgacgggaagtcaacttgtctttccgggatttcttttttctttctttttcgtagtttgtttcttttttttgctttcgctaggggagtctccacagaaatacgcctccgagttatcccgccccgtctaatctccccacgccttattgcaggtttttggggccggaacataccagaaataaattttttatccgtgatattaaaaggtcaattttattcgagaagctaatttaatccggttgtcaaacaaaccagaatcacccaatgtatatcccacctacaagtttcaacaggaagcagttcaagtactcgggtgacaactacaacactcccagcgagtttaaggagcaagctcgtcttgatatccaccgaaaattagcgcaagctcaaagcaacctacgacatggttcctcccccttggccaccaaatccataacagcttcgtcctcacagttcagcgggtcagacgtcgaaagtctcgctagcgtggccagtgatggctctgaaatgacgatagacgagtccaagaggaaacggaaggcttatttgggcttcttgaagaagccagaatccaaactctccagaacaaccaccaggagaagttccctgttttccaacaacctaacacagcaaccaactaatcaaacagaggccacctcattatttactaactacttttctgacaatggatttgtcactgaagttgatttgaacgaagttcttccgaaaaactttgacgacatgtacgatcccgacttaaccgtggaacggttttacaacgggcgaccagtgttcaccaaaaggaacctggtcaactgggaactgaacgatctgaggtctctgctgatagttagtgaactcaaaccagagtggggcgggtacatacctcgtataagagataatcccgacttccacatcgttctcctcccactgacgagttctgataacgaattcattgagatccttatgcgatcggacatttacaaagagtctaaattctctaaagaattcaaaatgaagacagctgcgtacatagtgcagtctgcaagatacagacacaatctagccattcaggctagatactctgacatgcccacaaaagatccaactttgcaatatttttcaaaagtggagtggagaaacataattgaaaactacttattaaacctgggggttgagacgcaatgtcgccttgatttccagcatcgatgctccatactgaaaggacacccagcacagaaaaacgatttgctatccaaagcaatcctgaacaatacacaaaaacaattcaatggaaatggcctttccaaggaggagaaggctagaatatggtcccaggctcagtctgaaatttataagcgactggggttggattggacgccagataagatataaaataaatataattatctaattgaatttcaattcattttcactactgcgtcctattgtatgtttctaagcagatagccagctctgctggctccgtgccaacgcctcgttctactggttagatctggcagccgtgccttacatagtagggtgtagtatctatggaaaaattgagcaaagtcgcgaagttataaagcttaaccattctctcccttttacacacaacccatcacacagccacaatgggtaaagtagcatccaaactgtccagtgatgatatacacgagctgagacagactaccaagtttgatagacgagagcttcagcagtggtacaagggttttttgagagattgtccctcgggcacaatgactaaagacgatttcatcaagatctacaagcaattcttcccctttggagatcccacagagttcagtgcttacacgttcaaggtattggacacagacaattctggagagattgatttcaaagagtttataactgcgctctctgtcacctcgagggggtctatggaagagaagctattgtggtcattcaaactgtatgatctcaacaacgatggatttatagaccacgatgaaatgttagcaatcgtaacttcgatctatcagatgatcggctcaatggtcgagttgtcagaagacgaaaaaacaccagaactaagggtagagaagatcttcaatttgatggataagaatgaagatggaaaaatctcgctgcaagaattccaggaacgctgcaagttagacccttccattataaacgctttaacgctctacgacgggctagtgtgagatgagttcacctacgcaaagaagaaaaaaccaagatagacttttcattaaactctctctgcagtccatatagcaccccgacaggtcagtttgattgcttctgtaagcaaccagtagggcctagcaccgtgagcatcatgttcaacggctgtatctaagtgctccagttcctcatctctgaactgactgaccaacttctgcatatctttgatctcctcggggacggtcggagtatttactccagtttcctcattcacgacatccacatggaactggttagttagtactcttaattgctggttgtaatgccctccaattacagtttcaacagcctctgtgcaagccatagcagcctctttccccatcagtcctgtggcaatacctaatcccatggctccaaccttccagagaggggttagcaacgacggtctcactcttctttcaacctgtagattgttgaaagtattgtgatggtggatctcctgttcccacatatgctttagtataggttttaaatccggtctcttatgtgacagggccaaatactgcccattgtatatgaaatttgcacccaactcccctgcttggtctactctgataaccctatccatgtaggcattctgtgcgtctgataagtaacccagcctcaaattttccgtggcagagttttccttgcccttagtggacgcatatctcactgattgcagttttatcaaattcctgctatgtctgatcatggtcctcaggatgacggggaaatttcaatagtgaacgagagtgatagagctgtgggatcgtacggtttgcccatatgtatactgaaacccttacatcatcatcaaggggggtagagtcgcggcgggaaacgagaatatcagccctctatctcatctcctctacgctcacttgctaacgggaagcggaccacatcatgatcatcctgctccccctacttttcctgtttgtggccggtctggtacaggctacaaaggttcacgaagctggaatttgtgctttgagaggaaattgtggcaaaaagaacttcttcggttcagaattgccctgtcctgataatacgttctctacgccatcctccccagatgattttgacctacttgaacaaatatgtggtaaagagtttgctgatataaatacttacacgtgttgtgacacttctcaactgttgaatttgcaaaagcaactgaaaaaggttgatcctatcattgcttcatgtccagcatgccgcagtaacttttataccttgttctgctcattcacatgttctccagatcaatctcagtttgtcaatgttacggacacggtaaagtccaccactggagaggatgcggtgagtgaattggactactacatccaaagcagttgggcagaggagtttttcaattcttgtaaggatatcaagttcggagcatcgaacgggtatgccatggacttgattggaggtggcgctaagaattactcggattttttgaaattcttaggtgatgaaaagcctttattggggggttctccctttcaaatcaattttcaatatccgtccaattcaacccctcaatgggttgaataccccgataaccctgtgagagcctgtaacgatagcaatccagattataaatgtgcatgttccgattgtccaggatcttgtccagttcttcctagtcgacacgctccaaaacagtgtcgtgtgggtattcttccttgcttttcatttgccgttgttgtgctttatgcaattgtccttttgggatatattgcttacaaaacctcacgatataccaaatccaggaccagcttacttttacatgatgatctggctttggatgaatctaggtatgattacagctccgaagacgaacagttttttaacaatgagtttgaatataactcttcttattatccaataaacagcaagttggaagaatggttctgcaagttggggttcttttgttcaacctctcccaaaactgtgatttttgtctctttggtggtgtcgttgacacttacgtctttcatgcgattcattgaactcgaagaagaccctgttaaattgtgggtgtctccgcaagccgaagcattccaacaaaagcaagtttttgatgaaaagtttggaccgttttatcggacgcaacagatatttgttatcaatgaaacgggaccagtgctctcttatgataccctaaaatggtggtttgacaaagagtcaaccatcctttctttacaagctaatgcatcagattaccagagggagacgatcacgctacaagatctatgtttgaaacctatcaacgatgcctgcgttgttgaatcattcacacagtatttcggaggtgattcttccagtttaactgaagataattgggagaagaaactatcctcatgtgccaacagcccagtgaattgtctcccttcgtttcaacagcctttgaaaaagagtcttctttttggaactgaacaattggaagattttgacattctaaaatctaatgcgttagttatcactctcgtgatgaacaactctaatgatgttaatagcacacagtttcaaaattctctagcgtgggaaaaagtattggaatctcacttgttggatcttaaagaggaatctgcacaaaggggtctgaagttgagtttcagcactgaaagctccttgcaaaaagaacttaacaagtcaactaacactgatatcaacatcattgtaatttcctacctacttatgttcttgtatgctgcagtagctttagggagcaacgcaattaccagagaatggaaccttacctctctggttcacaccagattcactttaggcttgtcaggaattatcattgttcttctttctgtatcaagttcagccggattttggtctattttcggacttaaatcgaccctaattatagcagaagttattccattcttggtccttgcaattggtgtcgataacatctttctgatttcccatgagctcaacacagttaacatgaattatagcactgagagtattcccctaagagtctctaaagctatgggaaagattgggcctagtatattgcttagctcatcttctcaagtgttctgttttgctctggctacggttgtttccatgccagcagtgagaaactttgccgcttattgtacaatggctgtgttattcaattgtattttacaaaccacggcattcgtatcattgttaacgctagatcaaatccgcctagaggataacaggttggatgttttcccatttgtaaaagttgacagaggagttcaatttgggaacaacaatagccaggaaggattaataattgatgagctattggacactagtaatgacaacgtcttctcagagttgattaaaaagtattatgctccctttatattcaacaaaaacataaagccttgcattttggcaatcttcggaacgttcaccatattttgtcttagcttattgccagatgttcagtttggtttagatcagcgtattgcattacccagggactcatttttgattgactatttcgatagtatctacaattacttgggagtcgggcctcctacttactttgtagtagatggcatgaatgttacggaaagaagcaaccaacaaaaactgtgtggaagattctcaacctgtgatgaattttctttggtaaacgtcttggaacaggaaagaaaacgctctgaaatctctaccatttatgaacctactagcagttggatagatgactttttcctatggttgaatccagacctcacggattgttgcaggtttcgaaaaggtactaaccagactgagatgtgtccaatatacgccccttcaagacagtgcgaggtttgctacgaaaaccacgagcctgggtggaatattactatggaaggactccctcaaggcgaagaattcatgaagtattttgatatttggattgaatcacctagtgatccttgcccgttgggtggtaaagctccatattcaagtagtgtcttcactgatgttaatggaacaaacgtcgaaagctttgttttccgtaccagtcatgttcctcttagatcacaaaatgatttcataaaggcctataaagagtcccttcggatcacgaacgaggtcaaggagtacactggaattgagaatttgtttgcatactcaccattttacattttctttgtccagtatgcgtctattgtcaaattgaccttttccttgattgctgctgcccttttggtgattttcttatttgcagtaacccttttggggtctttcgcttctgctctaatcttgatcctcactgttgttatgattttgattgatatgggaggcataatggctctttggggaatcaatctgaacgccgtcagtttggtgaacatcctaatctgtgttggtctaagtgtagaattttgcactcacatcgtgagaggttttactattggtgatccagcaatcaacttcaacactagcttagataccacatatgcattctccagcaagcaatcgagagctttcaagtccctcacgaccattggaggttccgtgtttggtggaatcactctaactaagatcgttggggttacagtgttagcgttcacaagatcacaaatttttgaggtgtattatttccgaatgtggttctctctagtggtgttagcctcattgcatagtctgatgttccttccagtcatattatcatatgttggggggagaggctatatatcttcaagttatgcaagtttagtttctgacgaacttatcgaccgattacaagagcagactttagattaatgagcttgcctgttatcacaagaccctattctgatgcatgctataattatatttactattttagatagggaacagagaccatattgttatctacaagtttttgtttaagattgctcgtgtaaccctctttgatgatgctgattcgatctctataccttcgggataaattatgcattttgtccttttgtttaaaatctttttgtatggcactcttgacagacttggctctgttggccaggtgtatgtagtttcctttctgttctccgtttttggaaggtttagctctgtggtacccgcttgtaagagcagcttttacaaactttggcccatgtttctgtgtgtttggtatggttgggaatttcttggtttctgtattgatagaaagatcattaaaaagttggtgacggatgtccagttctgcggttgaaagtggagtttttaaattcaacggagcttgattatttttcagatcaattaaagaacgggctttggcccgttgaagatagtatcctgagaagttatttgtggttcctgtaacaactaacatttcatgatatagaatcctgaggacctgtctccaattattatgaaatccctgcttgacagctgccgcaatcaagtagtgaaaagtggtagtgttaggggaaatcttgaacttgtccagcatgtaattgtaaaagacaaaacacagatcgactcgggaattgtttcggagagaattgagaatgctattgagagtggacaagttgggagttagtgtagtttcatggagcaattcccaacatttctgatattttttctctatgaccaattgagaaaacaaaatattgaaacagtttatgtccttcgatggtggtggagtgctctgcagcaatttcgtcatttcattagaacacgagagcgattccagttcgaaccgtgtcaaaagtgcagttctggaaaatcccagttgatccattttgtccaataacatttgcttggaaattttgtctggcaaaatctggtagatcagatgccatgtggttgaatcaggagaaatgtattcctttctcattaaacccaaatacttcaaaacagtaatgagggggtttgtatagtgtacaggcatgttcctcaaatgaccaataaaaagattgtatgtcaatctatttggcctaattccttctgttctcatctgagccaacaacgatttcgcatatggtaggtcgttcttagaaagaaagaaacgaataacgttgttgtaggagtgaatacccctcagtttcatacagtgtctgttatccttgtgaaagaactgacgcagcaacattggaataacgttttcctcgttagaagcgtggttatgcacatatcgattattcgtgatctggtctacatactccgtgaaaacctcgatgttcagtgattctggtaacttaggtgcccttgacaagactcttggttgtctgtaaaactcttgaacagttcctggatctaggattttagaatcatacctgaaactggtgattaaagagaatatttgttggatgaattcttggttcagttgaaataactcgtcctgcgagagatacttggagattttcttataattcgtcaatttttgctgtctactgcgtagttcgtggtcatcatgtgattggttagagttggatacgctgttaaaggagttgatataatgagtcttgaacttggatccctttcccacataaggtaagaactggagatactcctgattgttacaggcagtagccatttgtgcgaaacaacgatcccacacatacgtacaagtctgaacagttctccaacggttggagctacctagactttgtagcatctaaacacgttagggtctcgttgggaggtatgcactatcactagaattagtgttcagggagagaaatagtggtcgtgcgtcgtcctgaaaaatttactatccttacaaatacgattggaaacactagtcaacccaatctacatacaactcccatttcaaagatgagcagagaaggatttgtagctccatcaggcacagatcttgcggcagccgcttccggtgtagctccaaacaagcactacggtgtcaaatacacttgtggagcctgtgctcacaacttttctctgaacaagtctgatccagttcgttgtaaggaatgcgggcatcgtgtgatttacaaagccagaaccaaacgaatgagtaagtttttgacaacgtactagatcttgagaatattgcagtactaacatagtattttagtccagtttgatgccaggtgaacaaaaatgaactttcaagtaatccggtgtgggtgcccttctggtcaaaaacaaacaatgtaattttattattagttaatcaaagtgattcggttgaaactcaagcagcagtagccagtaatctgagctgctgacaatctcaagaccatctctgtcaagttccctcaaatgccttgcacctctcggtagcatcagccatccagcaactatcatctaacatcgaaatctgtggttctcgtttttctgtgatcgcgaatctttgtttcaatccaatgacgtcgtcattacgttactcctccaaattttcgtttttttttctgttgaatcagtaaagctaccggtctgattcaattgctattgtgcgtttattgcgctgcccgccctacatcatatacaccagtacaccaaagagagaagctctgacccagtctcagtctcatgaactccgttagtcctcctaacgatttgggaaaaacaaccaaatcgggtttagaattggagcctaacccgtttgagcaatcgttcgccagcaagccttctagcgatacaaaagataagaagatcgctctcaatcctaagcagcaacctaaccttaccacagaaggtgcttctcccactgtactaacgcccggcgggtccaagaagaacattctgccaccgctaactggcctctcccctggtggttcgggtctttcgataactcctggtgctatgtggaacgtaaattacaattcgaacacattcccaggactcaccaaccaccatagctcgcaaagccttatgcaacagtttgtcctgaacgctcgaaggtcgggactaacgcctaacgaatcttatcttcgaacagggctaactccgattccccaagtcccggtttctcaagtcccagtccatcaagtaccggttatgcaaggccaggttcttcagggtcctcttccacaagctccccctcccccacagggtgtcggttcacaggtgccgccgaacgtcaacaatccgtatccagttcctccggcgcttatctctaacttatcgtcgctgttggcatttccaagcgcagctgaacctccacagagcttgaagaaggaagagacacaacttcccacgccagtaacatcattaaatagcacagactgcgacagtgccaaggacttgaaggttaaaaaagagggttcgaaatctaagaagagaaccgcgtcggttgcaacaacagatgagaagtcagctgagcctgactcaaagaagacgcctgctgacgaagagggaaagcggaagagtttcctggaacggaatagggtggctgcatcgaaatgccggcaaagaaagaaacaaaaagtgcaacgtatggaagaggaactaaatttctactcacaaaactacaatgctcttaatttccaagtaaacatgctccgagaacaggttctaaccctcagaaccatattgtattcacatcacaattgcccgactttgatagatcagcttggtggtgttgaaaatttgaatgctatcttaaattccactcaatacgttgaccaaggacggaagcctgtgggtcctgaagaacaaatggagttagggtctacgatgatgggaaagccagcaaatcaaatacaattaaacgggctaaacacactttcaaatcaaaattcacaaacagaaaatactgcgttaatggcttctaacaatacgagtttgggagagaggaaaagctagaatttaatcctcctctttacataataaattttgaggggtcgtcattaacgccaatcaatcccgatgccgaccccggtcctgtatagactttagaaatatatagtcaaagcaatcgcgggtactcaaacaaccacagtatggtgtaatttcaaagcgtcctctttctcctgtatactagaacgaaatgtcattcaactttgtaaaagaggcggggaagtttctctgcattggcagaaactacgtggctcatatcaaagagctaaacaacagaacaccctcccagcccttcttctttctgaaaccatcgtcatctgtgctgcttccaaaggacggccccattctggtacctaagggggttgtggttcaccatgaggtagaattggctgtcgtactcaacaaacagttgaagaatctggaccctgaaacatttaccgccgaggatgcgctcgatgcaattgcaggttactcgttggcgattgacttgacagcccgaaacgttcaggatgaagccaaaaagaaaggtttgccttggtcaattgggaaaggatttgacactttcttgcccctttctcccttcatttccaaatctcaaatccctgatccttataatgttcaattgcacttgaaagtcaacggagaaactcgtcaagatgacctgaccaatttgatgatattcccagttcatcaaatcttcgctaccatgagctcaatcatgacccttgaaaaaggcgatgtgattctaacaggaactccaaagggtgtggggaagctcgttcctggtgaccatgtcgaagcttttatttctgttgatgggaaggtaattccagaatccgttatcgacgtcgaggtggaccagaaacctggaccatatgagtacaaagaaacctaaagattgagaagtaaagaataaacattttattacatgacgcctccttggggtggagaatactgacgaagttttactccagcagcattcaatgcctggtaagaaagtgtatccatgctgtaactctgggaatagaccacctcttgaatgccactctgaataattttaatggagcatgtcaaacatggacatgtgttacagtagagaatactgttggtactgattcgatctcttcctgcttccaacaatgcgttctcctctgcgtgtaggcataagcaggttgataggccgttccctgacgagtttcccgaattgcatctagcgcaccctccttgattgcaattaggcatatttcttggtgtgccgttgtaaccagtagaaataattctgttatctctgaccactacacacccaactcttcttttcatgcaattggatctcaaagctgccagatctgccaatctcatgaagtaggcatcccacgacggtcttaatcttgtcgggttcaacaagttgacattggaaagatgtgaatacaactggttgatggagtcatgattattaatgatggtaatgtcggctagattacttatctctatcaatttatgatcaaaagtgtatttatcacagtctatgacgaactcctccagagaaatatcccccgcctttgagcatcttctctggtgtcgtttgagtatagagctttccaatgaaatatgtaaaaagaacggccttttggataacttgcttagaagaacaggattgtcaatgtgtgataagacgaaattttcagagtagttcttggtgacgaaatcgaccagttcatcttcatcttcgaacttatggtcaatattcaatattgaaggctctaacgatatgtgtttgaatccttggtatgtcaaataacgagctacagttgtcctgccggaacatttggttccagagatgcctatcagcattgaaatgcagactaggctaggtgggcggaaaactgacgcgtatacagcatttctgatatttctactcagaacaagtagcttcgcgggacacaaccgtgaagggccttctaacaacagagctcgaatatctccgaggagattcctctttctctgtttacaattcatcttcatggcacaagaaattgtgctaacccggttccagccctatagggttcccaatctctttcaatggtccaatgatggtgacattgccataataaacaacaacaataatgttgttgttttagaaagcacccctgtttctctcaatccagacatccacaaaattcatgcacttacagatctcctggtgttgaaaagaaatgtcctcaatccctctccacttctttaccttcaacgacatcagacgtacgatgatgacgtgaatatcaccgatacggtcatggagcctcaaccggtgtccattcgatggtcttcaaaagggttctccaaagaccagagatcccagttggcagtattgtacaacaacctccaattgtacatttttgaaactggtaactggaattgttcgttacatgtcaactcagcgattcaccagttggacttggagcatgtcacgcggctcccagatattcaaagaagtaggattaccggtttctcctgggcgcctctggtcgatgatgtgaggcttgatgatcaccatttcatggcaatttctaatggaaagggtgaaattaagctatttgaattattttctgacaaaattgatgttaaaataacaatagagctgccatcagttgccggcacattggaatggtcaccttggatccagagtcagggtagattggtcagttatttgacagccattactagagacaattccattcatgtgatcaaagtatgcttggaaactgatggccgccttatctctgatggccagttaaaacaaatttccaagaaatacagaggattacatgctaatagtaaatggtataattgggatggaaagctaacatttttcattgttttcactaaatctttgaaagcgttcgtttttgattctgaccaaatttctcattttgagttagatcttcagtctcctttgtttttccatgactttgagctatatcgcatggacggcttattaaaattaatactcgttgaatcttctggtgactacattagaactgaattttcccccgcggaaggttttgcaaatttcgaacatcttaattttatgatcaatgagccgacagccgaggaccctctttacaaacaattgtataaaattcagaaaatgttagttcagtcggcggatcctcaaaaattgcttatagctggcatatctatggatcccactagtaatgtttttggaatactgtacaccaagcataaactggcatcgccagtttttgccaaaagcttggcctactggaaagtatacttcaatattgttcctttgaggagtgtcaaaactatggagcttggtaaactagtggactatttttcaggatcggtcattaatgaactgttacctctccaatattctggttctttgattacacagataatatcaatgtactcattgagaaacaagaacctttacaaagagtttgaatcaagaatccaaaacttaactccctttctcaaaaataagtcaaatgacaaatctttgactacgttttctcaacatttaagataccatctgttcaaagatacatatgttcaatccctgagatttctgaactggtttaaaatggacaagaataacgaattgattcaaattgcagctaggttgattataactttcattacagacaacaaaataacgctatccaatcctgttgatgaattcatcttacaatcgttcaacttaatctcaggtttgaatctgctccctcaaaaagacaatgttgttttgcacaactttcagcacaatatagatgagtcatttgattttacaaaccatacttcttgctcctctttatattctatcacttcgaaagaaggacacgtttggagtcgttgcgccattacattattacccatcttgagcaccaacataatcaaagatcctattagtggactggttgctttgaatgatttttcagattatattcaaagtgaacatcaatgtatactagttcccattctgcagcaggtttgcagtgtgagtttatttacaggcgggacttttgttagttagtacctttccttactgtgatggttatgctcacgcaatgcagagaggagccatctttaattaattaatacattactactatacaatatatgtttatccagctaacggaacttggcctgatccatggcatccaaaacttgatctggtggaactttctccatcatttctagttctcccactcttgcatcttgcttctctaggaacgaattctttctcttattagaaatagcatataatgcaaataaactcccaagaaggagagtggtacctagtgctaatgcaaagcctattccaacgactggtcctgtgcccagctgtggtgcctgcaataggatatcatttttcaaagatcttgaagaggtagaattggcatagatattgttgatggtagagtttcttagtgctagatcgttggtggtaactgtgtaaggtatccacgacgacccattatagaaagcagtactgtagttaccaatatctgatccaaagttgaggaatcctgacaccagtaggatctcatcaagatcaaagaaattattggaggctggacgattgttttgagttcggctatccatgtctaaaagtgccatattggtaaaaatcgttccttcaaagaagctgtcgccgtccaatctcgtccagttagttccattggatcctattataaaattgtttcccaatgcaagagctctgccatttaaagaactgtccaccagtataaactgagaaatagtttgattctcgtagtttattatgttggaaacggacaacgctgatgaaacattcacttcattcttggaggagtcaaacactacaaaaccgtcattttgaccatcaactgagaggtttccagcaaccaccagcttggtgtttgaaacatagctcatatcatgtatctctccagccaaagagttagatatcgacggcttgacccatcgggatcctgaaatttcgtagcgacagaacgcttcacatgacaagctaccggctgattcaaagtctccacccacaagaagatagctttcttcagtattataagagagggcgtgaacaatacctggttcgtcagactctctgtttaatggtgcaggttggtgaaccaagggctcgttctgggataaatcgtagattaataggccttggacacttgtgttgttgagctcagcagttccattgtaaccaataaataggtaatcatctttttgagagattaaaaacgttgtgaccactgaatcatcgtcccattcgataccatttagcccagaaatttgaacggatccattcctgagtgatgtaactatcgcaacattggaaagtccatcagtagttttaaatctaccgccaaacagggctgctgactcattaatatagtaactggttaataaactgttatcgaatgaagagttaaattgaaacggggattcaaagaattcgccatcaacaaaacgtgccagattgttaatggaatactcagaataaaccaaatctccaaacaaaagtgtgtcattaagctcatcgagactaacgctgctggttaagttaaggaagaaagatgaattattttcgacccatgatctggatccattattccagactactgactgtccttcttcatttgtgaatagaaaaaatgtggaattattcatcttgaatgaactagtgtcagaaacggtgaaattagtatctgccaacgataagacattggaatctctcaaaaggaagatggatgaattgctgatgacggtaatgtcttcgccaactgttgatgttagactatccacggttccattgaattgcaaaagcctcattccctcagtgttaaaagaattatcggtgttgttgatattttgaatagcaacttccaagaggttaccttcgtcattagcagacagtttaccaccaacataaagtttaccatcctgaaaaactaacccattcactgtagcattctcaagtaaggaggatccaagtagatttatggaggagtttccgacaaaagtattgtttgataaccttaaagtgtcaaaatctgtaaagttgttgagggaatactcaaaaataccatttaaaggcactgtcaaattcaaggatctggtactattagttgagttgatagccgcatctgcatcaatgtacagtatgtctacgtacaactgatatgcggcaaattccaactcggtttctgaatttcccggtatagttgattcgacctctaaggtgacatacggatgatcttccaaggttgcattgatacgaccgttgtaaagaatgtcatacttgtcaaaatcattgttttgatatattaagatggatgcgagttgctcattgtcgattccattgtgaagtgtagcgttgacaattcctctggtgctacatgagtcggttgctaaacagccaggtgtgtaaacataaaattcgtaatcaccaggaaaactaatatttggatagaatgtcacacccactgtggagtctggaatttcaccattgatcaatgatatggtcgtggtaatggacccatcttcgtggggggtccaggatccaggtgcctctacggatacactggaagaatgaaactcaaaatcatcacaggtaggttcgttgaaactttcgttaccataaacgtagattcctgattggtagatttgaagtcctttaagagcaccgatttcattgtaagcggacaatacttggatggttacttgagtaacgtcgagttcattgtggaactcgaattcttggtaatctccagaccacgttaggtagcctgctgttctggttttgtcattaaagacggtgtcttcgtatacatctgaagagtttgcgttctgaagagcgtcttccaactgtgattttgagaggagtggacaccacgcgtcacaatattcatattcgttggtttgtggattcacatatgtcaagttcatgatactgtttgaagggccagttatgagcctaaagtactcgacaccataaccctctgcagaagttgattggaatagacggagcttggatggaattattgtgtggtggagcatagctagccaagtcccttgggagcctgaaagaatccattcattgtcttgatcgggacaagtgattgacttggggtctggcgaaagggcttcgttggtacctgctgttgacacgtcggcgatattaaaacttgttagttgatctggactgacatcatatatggtcaactcagttgagtttgatgaattggtggacacattatgatgaagtaaggattgattccccaaggagtaaaagtttccaccgaaaatcaagttctcatcatcaatgctaacaattgcgttcactgatgcgttttcattaaatccttggaagggaatggactcgaaggaggaagattcatagttgaagcagaccaaaccaaaaatagaactgttcaacgtcaaatttcccccaaaatatatcaacttggacgtttggttgacaaacacggtttgaatagatccttgaacttgattactccaattttcggtcaggttcgatattgaaacctgagaagcttcctcgttcacttctaggatcagaggagcttcattttcttcgatggggattaccaacacgaagttattccccaatgagtaggactgttttattgtgccgttgaatgtggaaatgaacgataacgactcatcttgacctagtttgaaaatgcctaaactctttgaatcttcgttcctaacagatgtcctgtactgattggtattattgggtgtagaaagtccgttgaaccgtcccagcaaagagatatcatttgaaaagttgatcgcctggcaagagacgattattgagaccagtaggaacaacaacgccgccatagtttcaatctgaagttgacttgtgtgatttggtgttggggggattgagggtcaaaaacgggggtcagaaacagaataaaaaactagcttggaactcgaagtaggagaagagaagtggtgaaaaaagaagaggggacgtgacgttaaagacctgaactctgcgtgggtgcaatgtggttggaaggtgaagtgcaaggtatggtttttttttcctgccaggaatcaaaaatatcattctcatttctgaggaaaggcatggcagaatatttacctgttgccagatctggatatgaagattacataataaacacgtagacagtgtagattctgcgaggcgtgccagacgttgaggaggacaagttggggctccgtaaggtgtgcgtccatatgcggacagagtgtacctattggctgattggcaacacgttacattgttgcattcctgattggcgttggtgtgctcttgttgaaacagggatgcatacatattattatcaaacatggactgaggatcgaggatctgcaggtcggacagccacccgacatcgtttaagcttacgtaagatttgaaggtcccaacatcttgacagatctctcaactttgcttaatcttacataaccccaagagccaaccctcaccaggttatttttttgccttccgattgtcttctcctccccccgtttgctgtccaaccacttgaaagggtctgtctaggataatgaaaatattaagtgcattgcttcttctttttacgttggcctttgctgaggtcattgagctgaccaacaagaactttgatgacgtggttctaaagtccggaaagtacaccttagtgaagttttatgccgattggtgttcgcattgcaagcgaatgaatccagagtatgaaaagctggccgaagaactgaagccaaagagtgatctgatccagattgccgccattgatgctaacaaatactcaaagtacatgaaggtgtacgatattgatggatttccgacgatgaaattgttcacacccaaggacatatctcatccgatcgaattttctggatcaagagacagtgaaagctttttgaactttttggagtcaactactggtttgaagttgaagaagaaggcggaagtaaatgagccttcgttagttcaatcaattgatgattcaacaatagatgaccttgttgggaaggacaggtttattgcagttactgcttcgtggtgtggatattgcaaaagattgcatcctgaatgggagaagttagccaaagcttttggcaatgacgatattgtcatcggaaacgttgttaccgatgttgtggaaggtgagaatattaaggcgaagtataaagttcaatctttcccgactatcctgtacttcacagcaggctcagatgaaccaataagatatgaatctccagatagaactgttgaaggtttggttaaatttgtcaatgaacaagctggcttatttcgtgatccagatggaactttgaatttcaacgccggtctaattccaggagtgagtgataaacttaccaattacattaaggaaaaagaccaaagtttattggagtcaacgttagacttgctaagcaaccatgaacatatcaaggacaaattcagtgtcaaataccacaagaaggtcatagaaaagttgttgaagggagagaatgaattcctcaacaatgaagttgagaggctatcaaaaatgctgaatacaaagctatcggcaaacaattcagactctgtgattaaaagactgaatatcttgcgcaattttattgaggccaaaactgagtcaaaaccccagttattacaccaagagctataagtaaatgaaaaagatacctttctagataagtaaataaataacgctataactctaccactgtagaggctttgtagatttctggaccaatctcacatgctccggccacactttgccgccccctaggatggtttcttctatgataggtttgacattaaaggggttacatcttgccaaccagatattagccccagacttcaagtaaatgagaacatttgctgcatacttgtgacctccgacatgattgataaaatgaacttgcactccgcctggtctatcatctccgagatctctgtagagatcgtgatcacgaaggtgaatgcacatctccttcttaatgataggtgcggtgattccgcaacgtttatcccttgttttatgcgagcacaagaacacataggacttgtttgtgtctttaacgatctcataacctttgatttcggcgggaatatctattggttccacttgggtagtttcgatagagaaatttgaaaaaagaatgggcactagctcgtccaatacggcatcaacatcctccatacacaactgcttgacccatacaaagtacggaagaattaaaatatccccagctgtctgttcggcaattcttggatccttggcattagactggggtatggatgatgtggagactttaaccgcttttggaaccagcttggtagatgaagcccaatgagagattgattttaaaatcgtgccatcaacatcagtggcgtcacgcttccaatcggacttacccgttggaatgataatgtgtaaagagtacggtttagttgatttccaaaggagatcgtttttggagcctgggtcatctttgtaactgtttggataccttgtgaagcactcagcggccgaacaagtagcggggcactgtgaaagaggaactatttctgagatctcctcagccgcctgggcttcgccggatttgccccccaagaacttcgacaaaaaagccatactgattggacttaaggatgaaaagcgggagagaaatagaaacggtgcatcgcgcaatatataagccttaaccttaagtcttcggagatatcccaaagcggaataaaaaaccgaaggccgatcgctctttatctcttgaaaaagcgacctctacaaagtttgtaaataaaaaaattggttaattacgaagaaattttgctaaaatacaaccgtgtgaggtaattcagtgatcaaacttacaagaccaaagcagcggcggcaacagcggcagcacctaatccgacgaagttggcggcgttcataccagcggcaccgtgagattgggtggtgatggctggtggggtaatgtttctagcagtagtggtctgggtaacaaagtggtaagtggtagactcagtctcaatcttcttggtagaagtggaggatgggacagtcacagtgatggtagactcatggtgagagctggtcttagctggaggtgggacggtactagtagtcttggctggaggtgggacagtggtggtagtcttggctggaggtgggacagtggtggtagtcttctctggaggaggaatagtagtagtcttagcaggtgggacgtagctcttggtggtgcttggcaagtcacagacagtggtgacaacagtgacaacaccgtgcttggtgagggtggaggtagtgatcaatccggtggacttactggtgatacacttgtcctcagcacaagaggtgatagtcagaacggtggtctccaactcggaaacaacgtcagtgacggtggtgttgtaaacagcagcgttagcagcggccaataaggcggaacctaaaaagagagatctgtattgcatttttgataagtgagtgaaagtagttggaataaactgaaacagtgagttgaggaataagaagaaaggaaagggggaggcggcaggagtatttatattttactagtggatgtgaatcatgttttctttttccaagcttttattttggtgttattgtttttctctcagattgcgaatcgatctgaaaacaacgcgacaaaggatgttttgattagggccgagagaccatttttggtctctccgcctactcgctactgtgggacacagagagaaagtgagacgtttccatgacaactaatgtaggccgagataaggtttaattgccctttgaatggattgagggaaggaaatgggaggcgtgttcagtgcaattcaatgaaataccactggcaccgtctaattttcttgtcagtctttcctagtcaatgcctggttcttttgcttccaatcacagtctctcgattgctatgggtttgctattttagctttttctcaccacgacaacagcatccctgtgtgcgactgagttgacatttttcatgcatatccatgcaagcctgagcgtgtagggactcagacgggggaactgattggctaacaaactggtcccaagcgctgcctacgcggtgggctgctctgttccaagttggccagatcctacggcatcgcccatgcaacacagtatttaccctgaccttgtcgttaaagcggctaaaatgcggataccgacgcgtagtgatactcgcctagtattacgtgatcggaaggagtggtcgtttccaaaagggcccatcgaaaattatgtaagcacagtggtcatcccatctgccaaaaaaaaaaatacagaggtacggcgcctaatacccgaccacaaaacatgttcagaaacttgctaatcactctactattgctctacatcatctttggcctttagaaatcaattcctcaagctacataataaatacttaattacgcttcttgtagtggtcagatcctggcaagtgtagggcagtgacagttaagtaagagttctgcttagtagcaacaccggcgtaggcgttgtaccaggcgaagaacgcacaaacaactcccaaaacaccaccagctctgttacagttgacagaaggagccaagtggccgacagcaagcatcacgaaagtcagagacagaatagcaaacataccacagaaagtaacagtagacttgagcgtacagacagtcagcatgatggtgaaaatggcccagccaagtaggaaaaatccgacaccaacctcaaagtctctagcattgtcaccataggcttcggcaactccgaaccatggagtgttgatgacaccccaagacatccagaaaccaccgtaagaactcagggccaaagcaccgaaagtgttctcgattgccatttcccacataccagccaacagctggataaatccaccgtagaagaaagcggcaccaacaacaacgtttggagtggtgacacccatagcgtgagcattaattaaggacaggacgaatgtagtgagggcgaaggcagacagacccaatggagctgggttggcaaacttgtgaacagaaggagcagttaaacctgggttcaacgtaccaccgaaggcctcagccagctcagatcttctgaacttttggttaccaatgtgaatgaattcgttgttggcaccagatgtggctacctgctgaacatcgttgtggcggtaggagtcctcggagatttgtttttcaaagtcttgttcactcatagtttagtttataattaagaaggtgtgtagtaagaaagaagctcttgttgtactgcttgtctggtgaatgattgagtaaactggaggaaaattattctctatttatatacaagatggggataagtattctgctccgagaagtcattctcggtgtcatatttggggatgacaatgcgggacagaaccccaggtaaaagccattttctggcacaacattcggactgttgttaccgtccctccggtcaccttatttatttctatcgcgggctccggtgtgaaattgttctattagtgatcccttagtccctttggggccctaagggtttttttcccctacgcatcactagaaccccaaagcttagggcgaggggggtgacaaagatccaaggggtttttttaatgtaggaggggattaggataattgtttcaggcgtacttcatctacccgccccccgttcccctgtgccgattttgtggagtaaagcgtaatgtggagtccggggggtggatggcgatacttaatgcatgttccatatcttatttagctactatagtagtaagtgctaccatacaattgctcagaagtcttggcagcagttgtctccgccctctgtcggtatctcggagatgcctgagtgcccctctttttttcgctgcttctaataaattactttctggcaaattttaacttgcagaaaacagcgaaaagcttgcccgcttttcttgcaataagatttcagcggactccggtctatgtggaactgaaactttaggtgtacgggacaagcgcgtagagatgggctgacccgatgagctgataaccggtaggcgggtcgcagcctgtatcaagaaggtccgtcgggaactacatagagactttgtggaacttacaaaaaatgtattacgtaagatatgtgcgagtgtgtttcgttcgcagcaccctttatctagtgtcaaattttcgcgcaaatcggtatctctaatttactaagcagcaacattcgacaaaatagacagcttactttctacctcaataatggcacccaaaaagattctggtggtcaacccgaacagctctaagtctatcactgacaatctggagcaattagtttctgtcccacattcctatgagcttcaattctatacagctcctcctgaagcaccaaaatcaatcaataatgaagatgatgcattagtttctgctgaaatttgctttccagcgttgaaaaaacgtatcgatgagtctcccgtggatggtgtgcttgtatgctgcttctcagatcatcctttggttccgatgctgactaaagaattcccttcaattaaggcattaggtatcttccagggctcattattgtatagtttgggactggctactgatgatcacaagtttgccatcttgacatccaacaaccaatgggaacgaattcttgatgactctttgttggatttcttttacgggaaaggttccacaatagaaaaaagagaaaagaagttgccttcgtattgtctccccaccatcgccgccaatgttgaagtcctggagttgcaagatcccaaaaagttcaagaagctccaagagaaagtccagaaactggttgacgaaggtgccaaaatcatcctacttggatgtgctgggctgagtggcttggatctcaagttcaaagacgttttccctcaagtcaaatttgtcgacactgttaaggttggtgttcaattcttggttccattgattgagtattagcccaaatttcttagcatgactatagttgatagtagttgatcaatcaattcctctctttgagacttttccaagccttcatcaatcgttctttgaagatttctcattatctcgtgcactttaaaattatcatccacctttattttcttcaattgttgatcatttccaaccctcttcctcttaggactaaccgtagaattagtaatttcctcttcatcttctccatccgttagtaccaagtcctttgatgtgatctgcgaaattttcacggtgtccggtaaggagctctggggaagagagtctagagaaacagtcgcatattttgagagatcaggaacaacatacgattccgtaatatcaacctgagagaactgtgtgtaagaaagatgcaactgcttaaccaaaaacaaattcttcattgctaattggtaaacatagcccgaaaccctcggattgtacggagtcaaattgtcaatcgcattatagtattgattcaggtcaatttccccattctctagcaattggaagaggcaccgcggcaacgcgtttgaagatacgaactctgcggctaataatttccctaaactctcattcttgacaggtagcggattctccctagcaaattccttaaacaattttgtgatgatccttttatccgtaccgaaaaataattcttcactaaatcgagtcacaatattaatcgtgccttcaataagaccgctatcaatcccctctccgtcagaaaggattggtaccaccacatccgaaattacctcaaggtcattttctctggtggagtaatccaacaatctttgcaagaagatcacttgcatcctttcgatcgaataccaactccgaagcaactccttaatgggtaacttcgaagtcctatgataatgaatcacttccaccaacggaaacgatcgtatcatattctccggtcctcccgttaacttgacccaacagctgtagaaaacgttgaaatctattcttgtagacggatccatctcacttagggcactcgtcaaataggattcaagcagtttggcattgcccttttccaaagtgatattacgctgtagtatctcaagcattgcagaaacacttagtaaaggtagcaaaggtgcccatgagcaatcaatgaaacagggaacataattcactgccaattcggatcccgcctcatcaagcttagagccagttcccgtaaatgcttgattgaggactgcgacaaatgagttctggaatagttgttgtttacaaattggatcatttatggatttggaagctttcgttatggtaaagaaaacccaatcttgataacttgttatttctttgaataatttagatcctatttctatcttctttctgcggaaaactgctagtggctgtccaatcaaaagggtcattttgttgagtttttcagggttggagtttgaaggaaagctattcaacttttcagaaaagaagcaatattgggtgatgattttccaacatttaaaaacttccaacaaagatttggaatcctggggtccattttcctcaaagtaagctaacggagacagccacaactgattaaagctccagagatcaaagctattagtagcagtaaacacgttaaacaacaaggtaaactgggtccagatatttatggcagtggcgcattccatcgagcttatggagctcaacttgatcagattctgtaccagcacctcaattccctttgcgttcgatcgactagtatcagagtgaatcgattgcattgatgaagtcatgggactggtcaggaatatgttagtgagctcattcatgcttctgttgtattgaaattgagatgaacattcccttaaagtattggtagcagattgaatgattttgaagaacgtaggatgtgaagtatccgttaaacatgcaaagacaaatggaaaccaggaattaaaactcttaatcatggtacgtttgaacttgattaaaaagcatttgatgatgaaaagtttctccatgagtagcgtggcactatgaaagtacttcatgttcaacaccgaggatagcaatgtttcggcgaagtatggattcaaagatattactttgtgatccaccgattcctctttgatcaattgcaacagagcagccgacaaagatttacccaaactttgattcgtcaacagttcacaacatttgaccattatcttcgaacagagcgtgttggataacttgaaagataagtcagggtttgataagatgaaagatgaaactttaatggattgtatagttgttcgcaataggaaggggtccaattccgaattggttgtgttagtcaagtaagcttcataatggcaaatatcttccaacgtctcctgtatcaaatattctgagtattcacttaggggcgcctttatgaaattaatcttattttctcgcagtattccgttcattgtagcgtaagcttcaaatttgtatttgaaattgggatcccgtaacaccttacatgatccaataagcactgatattgctctctcggtacctggagctgttgcgataatggatccagaagaccagaaactgagatcagtcggtaagcacccacttccgttaggtttcctcaagggagacgagttagcagaggaggcaggagatgatgactttaaaataggttttgtagctgtgtgtctccttctaggagacgacattatctttggcggagataattggacatcttcagagaacttgacgccttttctgttaggtgactgatctaagccagaggcaactggaaggggagagaaccgctcaatgttgtaagtcggacccgacgtgtgaaaatgaccatcccttaaagtttctgtttccgacatttcaattggtgaatggcggttgaaaacgctgtgagacggtacttgggtgtctgacagctgagctggtacttgtgaggtctttgaggggatctggctcacgcgtcccgaacttttttttaattatctaaaaatctggcgcaccgcggacaggggaaatggaattccctgttgaaccttcattgcttcctaataattaagattaaaatggttagaagatcgacaagactagcaggaaaaagagaattggaggcagaggaggaggttaagcaggaggagaagcccaataaaaaagtaactaagcaaactaagaaggtgaagatccccaagggggacgaagaggaacacgacgtgaaacaatcaaatggctccagcaaatcctctgaaaaagctgccgttcctgtttctgctccttccacaaagttggaggttggagacaaaatctcagatctggagctgttgaatcaggactctgaaccggtcaaacttacagaccttgctgctaagaaaccaatcttagtcatttttgcctacccaaaggcttccacccctggatgtactaggcaggcaaagggttttggtaaaaactacgaggaactgaagaagtacgccacggtagtggggttatcagccgattctcctaatgctcagaaaaatttcatcagtaaacagagtctgccatatgatctgttgactgatccttcaagagaattcattggactattaggtgccaagaaacagccaaaaggggtggtgagaagtcactggatttttgtagatggaaaattaaaagtctcccaggttggtatttcacctgaaaagagtgtgcaaagtgcatatgatcaagtcttagaattagcaggtaaataattagttatttcatatgagggggtagatcctgctgatgagattgataagattctctgtcgctattatcgtatgtccgttcaccttgattggattgagagttatcataggagtgctgctgatgatccttttggtaacctccttgatatcctccttgattgctctggtggctaccttggtaaccattttgatattctccctgatactggttatcatacgaattattgtaaccctgagcttgatgcggggggggaggtagttggccagtggtgaaacgtgggttttcactgttctcataattacgattgtaagatctgtagccacctctttctccgcctcctccacgtctgccaccacggtagttgctttgccttgatctcccgtatcccccagatggcctggttcgactttggtacgagttatactgtttctgggaaccatctgtagcacgtccaaattgtcttccatcctcgaatccaggatccaagtctatttccatcttgttattgaaaatcattgttccatttaaatatttgacagcgttaagggccgaggtcggggagctgaatataacgaaacagaatcctgctggtgattgagtcttagcattcaatcccataataatttccctaatcttaccacatcttgaaaaaagctcatgtatctgttcttcagtaacgtagacccctatgcgcccgacgtaaacggtggcagactgaagggatttcttgagctcttcgtatccgtttggatttcgtcttgctttgtgaattaagtaggaggaaggtctatcaagtctggaagcagtactatcaaaatcaggagtatcaaattctccgagatctgacgacatgatggagcggtagttgccgttgaggggagttaaagagactgtttaaaggagtctgtctctacgcagttgagaatcaagtagagccctcagccctctgagccctcccattgcgaaaactggatagaacaaaaaattcgcgtgttcacgtggcacctcttgtgatcctcgcccaacggcaaagcttaataataccttcgtctgcctttcgtgctcatgctaattttgctttgtgagactcgaagatgcgtgtgtgtgcattcttacatttagtatgcacacgacattaactcctgcttttccatcaaaagtggatccctctctcctgactcttttacattacaaattgtaccaagcaacgaacagtttgtaccacacccccctctgacaacctccctattaaaccctacctggttttctttcaattttaaagtcaaagtttacaacataccatgggaaacagcccgtccaaaaatgaacttaatgcagcaataacaactaactcccacgccaacagcaacagctccaatggtgtcgcaggagacgaactaaacggggaactagacgagaagtctgcggcggcggcgacgtcgctgtctactaatcttaatcataaacacaaacagaggtcgcacaatatcaacgtcaacgccctcccccagcctaccaagacttcacgttcttcgccgctaacaggagtatccccttatgacttggagatctccgcccagatggcaagatgtctgtctaattttaccaacaactctgatgaccttcttttctcttcttctttaggatcggagtgttcgttgtcttcgtccactacacctcctacctccaacgctactggcaaggtttcgcaagaaaatcaaagtcgaatgtcgctggacccgatattcgaaatttcacaagagtctacaccaacacccgccacacccactttacccactgctttccctttgaaagaggaacatcttatttccaagagaggtcgtaaggagtctacgctgtcgtcgggatcttctcaaggtgatccactcgacgtagacatcgatgaggtaataaataaccttattgaagccggtctttctcggtcattctccaagaaaatatgtgtttcaaaccatgatatgaagattatctgtgcaaaggcacgagaggtgttcttgagccaacctactctcttagagctcgccgctcctgtcaagattgtaggtgacattcatggtcagttctacgatctgctgagaattttcaagttatgcggttctcctccttcgtccaatttccttttcttgggtgattacgtcgatagaggaaagcaatccctggaaaccatgatacttctactatgcttcaaaatcaagtaccctgaaaactttttcctactacgtgggaaccatgagtgtgctaacatcaccaagcaatatggattttatgatgaatgcaaaagacggacttcctcctccaaaatatggaaggctttcgttgatgtgttcaacacgcttcccattgcagcaactatcggaaacaaaatattttgtgttcatggaggactttctcctcatttgaccaatttagctcaaatcaactctatccagcgtcccacagacgttccagaatctggtatacttagtgatcttttatggtccgacccagatgcggacattttagcctggaaagagaatgaccgaggagtttcctattgttttggaaagagagtgatcaacaagttctgtaagcattttcaattcgatctcatcgttagagcacacatggtggtggaagatggatacgagttttttaataacagaaagttggtgacagttttcagtgcacctaactattgtggcgaatttgataactacggtgccgtaatgagtgtggacaaaggactcatgtgctcctttgatcttctaaaaccggacaaataacttgtcggttccatgcgttttctctttttatagtatatttctttttatcttttatgaaacggttggatttattatatattggtcgatggccatatcaaggagcatagctcttgtattagcgattcatctctaggacctgtgaattggctgaaagtttctggtttctgcctggatacaaattgaagaaccttgcgtatgaatgaaacgtaagcagagatgtttcccttgacattagagggaagtttctccaatgctttggtacaatcttgagcgacaatagcatgataagtggttagatcggagttggtgacttctttcatcagatgatcaaaaggaaaggttacttgtactatttcgttatccttgatttgtagaagaaaaatgtaggaggttggcagttcgttttcgatcaaaagttggcgatctatctcgttgataggaaattgaattatcttataaccgtcatcggtggggatgaatccactattgaaaaacaattttccaacatcctctaacggcaagtaagagatgaacaattcttggcttgattgaccatcaaaagcctcggaagagtactcaaatttcaaaacaatatcgttgtcttcgttgacatcgaagaatgagttagttaaactgttgctgtggttgatatagtccagtatgggaaccatagtaattgagattgaaaattgatcgtcatctaaaactttcccgggaatttccaaggtcctagatttaacagcagctttgaattggagaaattgttctatagacagcttgtcttgggtgataccatacttttcaacagattcaatgaaaagttcataaatagcatagtcacttttcaatgcttttaaatttacttgaaacaaaaaatctctcgacatgtatggctcgatagcatttaactcctccaacgaatctttctggatggaattaacttcagtgttcagtagaacctgcagataagacttgaacttgctaatttgagggacatccagtccgagctcaatgatacaatggtatcctacaacgtaaaaaaagacgatcaaggtttctgtgagctgatcgccgagatgctggtgaacaaaaagaaggcaatggcgaattatttcactagacttggaggtttctgatagtgattggagaaccctttggcattcctccaatgaaatggtggatgatctctttacaacgatgagactatacgtctttgacggaggtaattgacgtaatttttccagattcacgaatattcccgagcctccaccatcaatcgacgattggccaatctccactaagttgtttggatactccacgtccaacgataactccatttcccccatttcagggaaatagctgagatctatattgggctcgggtcgccctgacagcacacattttgctaaatgctccttcgcgcctttattctcactctgctcattcactctccttccttacctgattattttcttatctatccatataaacctggatttgaataacagatgcctctccgaaggacacgaggacgatcacaggactacagtttgaaaaaaagtcctgatcaagaagacctggacattgacgaggatctggacgaggaagttacccgttgtatatgcggtaacgaagagctcaacaccgatgattccagcgtcgacactgggttcttcattcagtgtgaaaactgttcagtgtggcaacatggctactgtgtaggcatcaaagatactgctgattcacctgaaaagtattggtgcgagcaatgtaaacctgaattgcatgcattgatagaacatggaacgaagtcattgtatatacccgtcaatggagaagtcaaagtcgaagacgatccgcccgaaagcctgaaggaaactgagcctgctaaccagagtgctccggaggaaagtgactcaagggatcaaatcgaaacgaaagacacgaaggatgccaaagagataaagaaaaacagagatgtcaagggctccaaagatggcaagcatagtaaagagagtaaggaaacaaaggactcaaaagatgcaaaggagaaactaagcgtcaaacaagaggaagctcgatcaaggctaagtgtcagagaatccagacagttacagcaggccctggagttgagtgccaaagagagcggagtaaaacctgagacgatagaggtattggagagacccagaagaactgctaattccaatggcacggaacatactagcgatgaaagtgagccttcgtccaataagaggaagaacgacactgttgtgtctaataaaaagggaaaagagctcaagagtaaaaggctgaaatctgcatcgtcttcatcttcttctaaagaaagcaaaaaagaagataaaaaaatcttacagttgaattctgaaaagccgttcaaaccaaagacgcattcttccaagatcagtatgatagaaatgcgcaaaagaatcgccggaatcttagagtttatcggacgaacacagatcgaaatggccaatgaagagaatgaaagggcccagcttaccaagcatttgaaagacgatgcagatgatgaagatacagctctcaaattgaaaattgagactaatctcattacttcatcgaaaaacactctcactatgatggactctcttacaagaaaactactgcgatgggagcaacgatttggtgcaccaggataattgaaaaagtaaaagttgtatttaaagtgtctactccaattctagaacttgagtcataaaactattcgtgttgtgtactgtagttccccctataactatcctcgtagacttgttcaccagattgaaattgttaattattcgggcctcttcataagtgactccaccaacaaagaaaataataatatcttgcagcctggctccatttagatcagaaacagggcgttgcttcttcaaaaaatcattgattaaagtcggataatgcgctgtgggtagcttatttttcactaacttgctgataactctttccaaccttggaatatgctgcatataaatattgtcgttttcatgactttgtttgaacccctgcagtagattatttgttgcctggttaaatatcgaagattcagagtcatcattcaatcgtttggtacttcccgagtatttcaacatcctgttgactgtatttatttcaaactctggcaccccctgctgtaaaagtattgacaacatttttggaagctggttgttgggatgaagttcatatcgtatggcatacaaacatactaatttaacttttaagttgttggcaatcttgaactcttgagatgtcaacagcttttctagttcttgaaggtcagcattatgattgtcattaacagctatggattgttccaattcactcacttgccataagtgattttcgttgatttttctatctaattctgtaatcaagcccatatgtttggaaatgttgtttgaaagttttttgaattctggaaaagattccagaaagtgtttcatatcattcaaatctgtcaattcattagaattgtgtttgacggttttttctttgtactcgtttacgtatgtttttatactatcggacaagtctccgaaattcaaatatagagactgagcataaaatggatcttgagagggattcaataccagtttgattagatctgggggcagatcagaaggagttcccgttaaatccaccgtattattgaaaattcctaaaagctcgtgtaccatagattgataagtccaaggatttaataatggagtgattgggtcgttttttcggtcaagaattaacaggacaggagggatatcattcaccgggaacttttccataattttagaactttgcccaaattcgtatgacaaatcggaagctagcttagaacacattcgactattagattcatacctgattataggattcgtttgcaaggagaagcagagtgatttcaagcttgctaaagtcaagagaaactgttgctgattccaagcatcaattgaattgaaaatattcagttgtttgaaggaaaacaagttcttgttcaaaatgtcgtaatctaggaacaattccatgaccttatcgaccatttccaaatcgtccctctccgccaacctctctaagaatgagttgggaactacattattgaagtagagcttgtaggatttgtatttgggagctcctaattcctcaacaagcaagtttatagttttttctgatactgataggaaacacacacaatccaattgctttatcgtatctctattctcgttctccaacttgtcgatcaaatacacctgatggttcaacaattctgattgggtgctcactagggaaattatggaagaagtgatatcatccaataaaagaaccttaatgcctgtgtctgtgacaattttatccacgtaggattgtccaaccttaaccaagtccatgttagttgttagtggcggaaactgtttataaggctccgattgttagagaagatgttgattgtctagcgaagatccaacggggctagtggagtaaaattcgagcaatgttcatttcttgataagagagggtactttgcgaatactttgcgagagatgccatctccagataacatcagaagcacataacttctctacaagtcataagaattttctggaacattggaatagagccaaaaaaggctctttgacctttcttgtcggtacttctccaaccgaaaaagcgcttcttcttctgtaagcccctggttgatataggtctctatagcctgtgctatccttctccttctctgcacagttttcctgatacgtccacgacgccagctagtaccatatttccgttccatttctgctaaagaaggttgtcctttgtatccaatcttgtactcccgccagatggcagagattgtttttgctttgttattgagaataatttcaggtattacagttgttgttggagcaggaggagctccagtggggttggagaacggaacagatactggagcaatgccatattgaccgtttgcaggttgtggaggttccattgaattagagactggctcagattgcgaaggtgttcggtgagctccaacttgtcctgctttagacactaaagtgagcatttccacgatctgtgtcaccttgttgttggtattagtcagcaattcttttaactgttgaacatccatggataatctgttaaccttatcatttgttttagctaattgctggttgagatatgaaatatcggttccagaagaagatgtactgctggaggaacccctcaatccttggctagacacaatcgaataccctgtagggggctcaattccaccgaattcatttgacagcagggatgggtcgctgtttcctgtgaacgtagtgggtatcagcatatttgaagagttagttgatgttggggtaaccgttctttcttgggccatctcatgcgattgagtcacgcgatgtacgttctgtctctctttcttgatctgcttcaaatactctttaactctgtcgtctcttggtgtcacccaatccgcatcaggctcgtttggatcgtctaatacaggtctaactttgaactcagtacgttgcctatgatataagtctacgatagcgctcacatatgcatcgaaggatgcaaacgagagggggatttctcgtactttggcgggttcaatatgagttttcaggaacaggaagagtctctttggcgtaacgatctcacgcaatttgggcggacctggaatgaatttcttcccctcattgtgacaccaatttaaataggctgtttgtttgctttggtatgggttttttctttggatactagatgcattcatggactgctcaggccatcaattttagtcccttagtaggcagcggattagaagaaaaccttgcagggaagaccactggtagatattagtttaaactttccccactatcttgatgctctccccccactatcaagatcttcgcgaacacttccttatatttcaaaacgtttctcttctgtccgatttatttcacaaagaaaatctctctttctagatccacatttccccccgttctgccgaggatgtcgcccacaaatcctccgccagttcaacgagggagatcactaaattccattcatgacaagaagcggcatggcacaccaaaaaagacccagtttacagctggaggtgggaaaaaactcgtaaggaatggctctcatggcaaaaacctgaataaactgccccgaatcacttcatatgaggccgtaaacgcgttagaccacacgataaggcctgactttaacaggtcgaaaagtacggacggcatattggacagaatggctttgaaatctctcacaaaaaatgagactagaagtccagagctaagtgaagaagaagtagaagaatttgacgatgatgtcaaggttgtagaaagcaactcaggggcaacattagaagacagtctgcctagattatatggaggggacgtcctgctatcacagtcaactggcatagagagaagcatagctccagttgcctcgttgcgagggtcattgataagtataccctctcaattattggcccagacaatgggtgaattcagaacaacaagccctcagggtcctccattagtcacatctgctccgcaaaatacacaggatactccctcgagaaatgcaagtctaatattcaacccttcgaatgtccacattgctggtacaggctacgaagacacacgaacccaacagaaattatggttacaaagagaaagttcgcttagagacgttaaaatgccagttaaacaaccacagacgaatggtttcttttctacatcccagtttcgtactgaatttgaacgatattccaaggagtatttaaacgttcgaaggtacgtaaatccggtagctgaatcgttgaaaagattagacgcggcaaataaagtgccaaaggatatacaaaaccggccttccactatctcagtaaaggaaatacaagcgaaggcagaagctatcaaagcccaaatatggaatgaagaggtgaagtaagagcttctagagcactatccataccagacctccaatgaaaacgccgagtaccaacactgtcaagatagcagcaccagctttatcctttcctgtgatgtccaaatcattcatattaattcgggtggaagaccctattccagcttcagggtcactcttagacgacgactcgttctgcgagtaaggagccggggaatcaagcaccaataactgtgtaattacctccaaagcactcatctgctcacctagcccatacatgttatcataagcacctatattccaattgagaccacaggtaactccatcagtaccaccagaacacgatttggcagccccttcagccgaagctgtcaggattgtcattatttggtcggtcaaagagggtactagcttggccgtgtagcccaagcatcgactgaaaatactcttgaaagaccgctgatcgttgttacaattcatagcagcctggcattgttgttcataaatgacattgtcattcaggaaaatggatattgaagaaagcaacgtggtcgttcgagttagccacacttcatcatgggtgaaatcgtacatataagcacagccagccattaagacaccgtagttataggtccactcgatagttgtaatatcagtacactctccacttacgatattcgcaccatcgtagataagatatgttccaccttggtcgttgataaacccaacatcatctagccattgccagacttgttccgccgtctcgccataagtctcattttgagtaaacctggccagacgcgcggcaatgtgcaaaagacacccattactgatagtattcttgtaatcgtagcctgaattccacgtgaaaatttgccaacgtaaacctccagaacaggtggcattatcccaacgagcccacattgtgttgtagactgcttgagtcagcgcaacccaacttggataatcttctgggggatcagtaaagtttctctcagcggcacccattgctgcaaatccccagaaaccctgatcatcatttccttcagtggtggattgattggcagggatatagttaaagttgtcacctgtttggtgcagtagagcatcataaatgatctcttcgtacgtgttgttgtcacacatgaaccagttttcgatcattcctccaaatgcttcacccgcctgccaccagtaatatggtgtctggaacattcccacagtacctccatacctcgttccttcatagtagtccatcataccatttataatatgtgtagtggcctcgcagatggagtccttagagtcaacgtccagcgatagagctgagactgtcgtcaaaagccacaagatccacatagtttatttatagaagtagggtcttggagaagaaagtaagtgaagtgaattcgcgagatgtttggtgtttcagaggagtttggcggagtcgaaaagttgcaaggagaatatagtggtgcttgccaagagacacagcaaacgctggtgcgtagtgcaagagaaggcaggcaggctgtgccatatttcgtcgttaggtggaataaaaactctttcccgcagacacatcaaaattgtaagaatcttacttgaattagtctacctaaatccgaatccggtcctaaacgttccctatgctatgactccaaatgcgtagatacctcttaattcgtcccagagctcctaagctcccttaccagattcattcatgccaaataaatctatcaacgccaacaatgaccgagccactatgaaccgatcgtgaactatcacgctgtcttctccttctttaaggaacccatattggccctttctgtctaacaaaacactcctaataccagcacgttgtgaacataaaacatccttcttataatcgtctcctacatgccaccaatggtcttttatctcggccttgctcaagcctttcaatgaatgttctccatttttcagctccagtagctttgtgcctatcttttcgaaaaatgctggatcgggtttagaaagctctaggtgatagctcaaaaatatgttctctttgccgaaataatcgatcagtccgaacgtgtgcaacaccaggtgggtcacctgttcatctgcgttgctggccacggccggtattaccccattcttagccaatgcttgtaggagaggctcgacatcttcaaatacgtggtaagctgcatgagaggagaaatgagaggcaatctcagatacgaccgcgtccatgattgtaggctctccatcgtaaaacactctattcaaaagcgttttccagaatatctcaataggccaaccagctgatttaccgtaattgggatactcctgacacaattgagagtagtgctgtctgtatctggtagaaatctcctcctcactcggccaattgcctttgtatctcgtaactattgcatggtattgttggtgcaccggtgccactggctcgtagatggtatcataggcatcaaatgaaactactagaggtttgacgactttcaccggacgaacgttcaattcactaggctggggacttgcagaatccatcaagggacttttgcttatattctttcctatctgattaactaatcgggtgaatttagtcgtatttaccgttttatatgctgggattgttggcattaacgtgtattttggtactatcttagctttcaaggagctcgcttattagaagcatgaacttttgcgcgatgtgagaagtagtgaggggtttatcttaaaattagaagaacatttgacacaatcagtcaatctacaataaattcagctggtactactacaggtgctctgataattgcgcctctaataaatatcagcctttcattgttgatagagacgtattcaagacagaattcctagcatgcactgattgcctgggagttaaaaggggacacctttataaggagtttttatcaggtgttgatcaatgatcaatggtgtttcttactgctgtgtaacagaaagggatttatttggtcttttagtccattggaacagtcgtcttatgatattcagaatgcctggctgaattgatccgagatcaaattcatcaatggctgctagcagcaagtacaccttcacactactgctaactctgtatacaagagtactgcttctgcaactgttattggtaatccagtctgagtaactcaatggaaccgttgatcctgcaccttttgtggttatgtccgtgcttatgtaatcatacatatggaaatttcaatttttttttttatgcatgcattctgttaaacttctccaacaaatcgttgttgcaagatctttacacattaatggaagattttggcccagtagtccgctatggaccgataacagctcttcagtttaaagacggaaaactttactctggaaacgggccttccattgaagtgtatgactatgtgacaggagagatggtgggacaaagaaccgtctttaaagataatagagtccatgggttacaaggttccaatgacggcagttcagtggctattcatggtgctaaatctctgcttatctctcgatgggatcatttgtttgatgaggagaggacactagatgaattttttgtcagtgattggattatctcaacttcgttcagctatgataactccttgttgtacgtcctgacggctcataatgctgttttggtaatctgtctgaattcacttcaaataattgaaactcttcattgcaacgagagaagtattttgtactcgggatcaatcagagttcttcctgataaggttatcgtctgtgcaggaacagtgatgagtggcattttattatgggacttgagctctcgttccgttattcacaatctaaaaggtcatgaaggctccatatttggagtacaagctgacactaacggagaattggtggtgtcctgttccgatgatcgatctgtcaaagtgtgggatcttgaatctggggaatgtctcatgagtggatggggtcacggggctagaatttggagtttacagttttatgacaataataccaaagtatttagtgcttctgaggactgtacagcccgctcttgggctgtagacagagaaaaaggggaacttaagtgcttgaaagtttttgacactcattatggaaagcatatttggggtgcagctatttctcaggatgaattaatagcggctactggaggagctgatgggagaataagactagtcgatctgaatagtaaactggccaggaaagggtttcaagaattagaattttctgtagactccatcagtaaatcgaccggttcaccgtttgccaaagatgaaatcttgaaaggagttgcagagtttgataacctgattgtggcagttacttcaaagggtaaaatcttacagaaaacggggcaagataattggatactaatagaacaagacccatccctggaaaattttgtcattatgaaaagtcaaaaagaaagaaggttggtattattatccaacaataaaggatacattcgactcctgcaatttgatcgcttgcttattcaagacattttgatacctaattctgtgtttgaacatagtaaatccaacatttctaatgtcttgattgccgattacgacgaacattcagttcttatctgtactgaaactcccaaccctaaagagccatttcttctcaccatcatagacttggaggagaacatcaagttcactcagcacacattaatcaaaccagacatgagatttgtctctagttgtatttcttttgatattgtcaacaaatggttactaattggttccaggtataccaccatcgccttgtatgatatctcaactttgaaaaatgatttagagccttttaaagtgtggaagaaatacgttcctggtgacacgatctcatctttgaaagtgttatcctccattgaagatgaatctctgataattttaacaactagagatgggtggttctactacattcaattgtcaaaatcaaacaatagcattactgatttaattgttcaagagaacagagttcagaaaggtttcgtggagggctgttttattcatccgtcaagtggggatttactgctctacggattcaagtcttccttattttttctgtggaatgaaaccaaacaactagaagtttttaatgagatttgcggagggcctcatagattgtggcaattcaacatcagagatgcaaataccaatgactactcattcatttatactcgagcctccgttttgaacgtcagacataccggatcctccttgtggaaaggagatagtattttaaggcaaggaacacatggaagggaagttcgtgatatatctatttcctcaagctctgtgaacggaaaacgattactgctcactggctccgaagatacaacattgaaactctccagcatagatgaaaactccttagaaatcactcaatattggactcttagaaagcatgttagtggtcttcaaaaggccaagataattcatcaagataaggagcttggtttacaatatgctttgagttctgctgcaagagaggaattctttgtatggttgatctctgaaagtatccagggaagcgtacctttgatctctaattatgctactttgccaccatcaagtgaaatacatcctgatcttcgtattatggactttgatgttatgaaacgagccgatgaaagcggtaaagttacgggcttcttgatatccacagtgtattcagattctactatcaaagtatgggatttttcaattacaaaaagagagttccggctagtaattgacggaaaatataccaccatttgcatatggaatgtgaagttccttcaacttggaggcaatctgtacattttgacggcaggtactgacgggcacgtttgcatctgggatatcacacattctttgaatgacagtggctacagccttttatctgggggtcaaatccagggacattgcatcggcggatccaaattgggagagctactggttaaacagcaaatccatcaatccgggatcaaagctatggactttgttcaagcttccagtactgaactactcattattactggaggtgatgacaatgcactggggttactgaatctgacgtttacacctgaaaaatctactctaaacttgagcattgttgattttaaagactctgccgctacttccaccattacgggcctcaatgtaattgattctagcacgtttttcaccacctctgttgatcaagtagttcgaatttggaagattgaccaggacaaactagttctacaggctcaaaaacgaactgctgttgcagataccggatgctcagatgtctgtaatatttctggcaaaaactacgccgtaatcggtggagctgggttatcactatggggcgttaactgaccttaaataatcctttactatgtacattgtttacacatgaaaattcagaaattccaacctttattctatttaaccttgacgttgcttgtgtttgccattgactttgcaaagaacgtaaaccctgccctttctcttggcgatgtagcaatgtggacagaacttcttcacggatgtcctgactttgtagtttctgatactttgaagcgtcatgttgttagctggaccaaccatctgcggacccgtataatttaggccggagcgacaaaaggatgttcttccgaacctcatgaatgtgtttatgaacttcaacattttcgaatggactctgcgataacgatgttgaagaagcgggtgatgatcctggttcgtctagttaatttttcagatgaaagaattcgcggcccactttggtgaatcttccctaggggacaatatgcagctggtgcacgactaaagtttcccaaactccagtatctgcaataaatcaccctaaccatacctaaggagttggctgtaaatcatggaaggatggaacgaaatcaatcgagttccatgcatgaggccttcttttaggatttctgatccaacccggcaaagtgtcccttctgctttactttttgacgactcccatgacctgacctggattggttcagaagatggctttgtcaagtcgctggccgaccaaatgctcacgccctatacatcatttcggtgccatagctctaaagtgctccaattgcttaataacaaaagaggaattttatctctgagtgaaaattcaatcaaattgacctcgaggactggactgtgccggatgaacctgcacgacatctctgtgaatcattcacgttcaatggcctacacgtccaatacagaaaacgaagttctcttgggaggatttcaaggaaagttggtgaaattgaatttgatgagaggtgagatctcagacacgattccttatgatgcacctgtttacacaatgagtgccaacctgagtcaaatttgtttaggtagggttgatggtaccgtggatatcttagaccctaggtccaatgatattatagcgagtttttctggccatatgaggacgctatccagcatggactgtagaggtaacactctgataacaacaggatattcagtgagaaacggtacgttctatgcagaccctatagccaatttgtacgacttgagaactaaaagtttgatgcccccggtgaccttcccggcaggtgcttcatttgtcaagttacatcctaaacttccaaatgtcgccattttagcatcttcagctggcttaattcatttcgtgaatttgtattcccctatgaatgtatccctttatcaggccgatgtgggatcttatatgaataattttgaagtatcaccctctggtgattttatgggtttcactgatagttttcaaaatgtacatctatggtccaatgcgccggatttatcatctgcccacataccgaacctcgcatcgtcattggaacaggctaccatgttaccaccacctgcaaattcggatatcattccagcagattcagacagtacagttcccctgagctctattgggatgccttactatgaccagccgttactttcgaattggccttttgatatgaagttctctctgggacacgttcctaagaagattaatcccgagctcatcaatagttcaaagagcgtcgttgaaaactacaatgcccatgctttcggccaaaacaatttaccatcaggaatgggcgtaaacatgaatatacctggtgttttcaaaaccgatacagatacaaggattgctgtgtacagcagagagaagtatggacccaggaatgtggcccaaccttattacaggctacatgatagaagcaatcagaaaaacaaatttgttcccaagttcatcagtgaaagattggatgtggacgagaaaagtagcagcacggccgagaatacaaactctgatttcaaagatacattgtatgagcagctgtttgactgcaagccccattcctctcaagaagtgccatattgctttaccaaactggacattcattacagtaagtttggggtacatgactttgattttgagtttttcaacaaaaccaacctatccggattggagtctcatgttcaaagtgcctattgcaacagtctcttacaactttaccgatttgcaccacttatgttcaactacgctgtaggatctttggcggaagagagtgttgataacaattccctcttaacagaactaggatttttgtttgacatgatggtaaaagcaagcgggcaacatattgccccttctaacttccaaaagatgctgagcaaaataccagaagctagtcggattcttgacatatataacaacggctacaatagagatgagcacagccaaagagtgctaatacaatctttcaataattttttgttggaaaggatttctttggatgaaatgaaccaagcaaaaagcaatgctcctcacatattcaataccattatgggaataccagtggagtgtgagtttattggcgttgggtgtggtttgagaaagattggaaatacaactctctattctctggacgttagacatccaaagactaataatgttgttctcaataagaaactaaatcacagtattattccctatattgagttggctctcagcagaaacttgtctgtcaacatggcatgtgataactgtaatgagacccatgcttttgacacattgtacacagtgaaagatttgcctccaattttatcgttgaacttggaactcactaaccaagaactttcggaattgaaggcttctaaaacaaattggcttgcatcagagttctatgccagcatgaataagggaaggatatgcttgaaaagtataacaactgggttccgccatttgaaatatgaattgttgggatacgttgcgcaagtgaccgataaagaaggaaactctaaccttgtaacattcgtgaaggtaggcaaagacgagtggtttttgttcaacgactttttggtgatgccaatttctgagcatgaagtgttgaatttaaattattggtggaagaagcctgtcattgttatttacaagaactctgaaagcaccaacatgtttgactatgagggctggaggcagaatttgaatcaggatattctgtacagagatcatttcagccgtggaactagagaaggaaaaattattgagtacgaactattgaccaaagaagaggccccacaaccaggaacacttgttgctatagatgcagagtttgtcgtgatagagccagaactggttgagtttaatagtgatggtaccaagaaagtgattcgaccactgaagaattctcttgcaagagtttctgtattgaggggggatactggacccaaagagggaatcccatttattgacgattatgtcattatcgaagagcctataaacgattacctgacatcatggtcgggcattgaacccgatgatttgaaccttgaaaaatcgaagagaagtttaacgacgttgcaagcagtctatagaaaattgtggttgttattgaacttggggtgcatctttgtcggacatggtctgatcaatgattttagaaccattaatttgagtgtccccaaacaacaagtaagagacactgccgagttgtactttttgaagaaggaaaaaaggaaattatcgttgaaatttttaacatatgccgtcctgagacgggaagttcaaaaaggaaaccatgattcaattgaagatgccaaggcagcattgatgctttacagaaagtatatacagttgaataatactggagagctccaacacactctcgaggaagtgtacatggagggacagatgttgagtttcaaagttccgacatgattaataaaatgtgtactataaatattcttaacatagagtaaagaaataccctatcttgacatttagtttgtcaatcaattctgggtcattcctacaccatatcttgtgaatcaacgcaacgacgaattcactatcttgtgaactataagggtccaaccccatttcgtaaatgtcattgtactcgattattaaatggtcggatttgtggtcttgtatatggcaattgattagctggatcagcacttcgaatattttacgagtttgttgttgaaagtattccacaatgtatatggatggtgaggtgacgtctgacgagttggtgacagaatctggctcatcggtgtacctgaaaatcttcaacaagtcttccttcaaaagctcaacgtcttgcaattctatatcttcacctgcgctagcccaccacttgaagatcttgtataaatactctgaccacgactgtttttcaacacatttggaatagtccttcctgttctctggttctccttgctgaagggcgatgaagttttggagaatatcaaatttgcgactatcccttcgagtgcagaaagagaattcattattattgtctgctgaagtggaaatgcttgctatgtcaagactattgtcaggtaacttaactgtggaagtgaataatgggttttcaagaagaatcacatctctagtggaggctatgaaaccagtttttctaactgcaacaaagctgggaatggacgatacgtccttgagacaaatgttgtagagtaattgatagtattgtaggttttgaaattggttgactgaatcatggtggtctgtatcagcattcgtcaatctttgcatagattttattagttcattttgcaattctaaaggaattatcgatagtattgacatgtggtatgatatcttattcattttttccactgacgagcctccgtagattaaaacaggctctctaagcagtgataatttccataatgggaagatgagggggcctaatgtagctacggtgtcttgcattgaaagaatcatatgatcgggatttggcggaacagactcttcatcttctaatgttattatggatggtttcttgtttagagacttaattgcctctttgaacttatcggatgatgatttatagtggtatttttcaaacgttgactccaagagcagagagtctatttcatcattcaaatcgtcagatggaacaatttcatcgaaaagtgattccaagacgtcatagtagttccagcagcttgaatagatgtgtgggatccaagtgtgatatctgctgcttgtaactgttgagatatatgagtcgttcaattctgatggatcaataaggattcccaacgagtacatcagcactttagaacggtcatgcgatatttgttcagaaaatagtccattttgccggaagattgatattccgtacagtagggtgttattgggttgaaacatcacgaactgtagactgtctttggagactgaatgtaagccactggggaaggacttgtattccagatcggtgatgaaagattcattttgggtgagagattgatccacggatttgatccatatgaggtcatagcctcttctgacatcaaactttgtgagaaatagggtatgtattggaaagttggccagtgattgggaaggcatgggatgggtgtagggcggtggaggttagtgtgtttggttttgattagaatttcgcttaggcgagggtagtggttagagggaggggtgaggggagaagttgaggaggtcgctaggtatgaacgggagacactgatagtagtatatggagacctggtaactggtgaaggatatgggggagcaacggtctttggcctgtgtggtttgtaattgtttgtaatggtttaaaataagtgtttcagaggttgctgcagtcactagtaagaagctttactagggagagcaatgaggagtatctggaagaagaaccctataagactttagggtcctgatgacaatcaaggagccaatagaaagcttcagggaagaaagtttatctgctaagaacattctcctggcgtaactgtcagatccctgagaaaacccagagacttagggtgatcaaattaagattgaataaattagagagatataaagcgaagataaacgcacatgtcacctacagataagcctttttccttggaattgcttctagacttagcattggcgtggttgctaatttggatggtgtccaacacatcaacagggtataaccaaattaaacaacttttccgtcaatccaggacttcgtggccaagttggttaaggcgtgcgactgttaatcgcaagatcgtgagttcaaccctcaccgaggtcgatttttttcgtccgcaacgttctccccgacctacccaagcatttttcctttcgcttagtcttgcaccacggacaatcttttccgatttgacatgaatagatggcgcgaaaactagccataggccaattttaaaattatcaatttttcctgccctactttaggggtatgagcgatgttgaaacggagcttactggttgacgtgattcgcactcaaatccgattttggcattctgtttagttttatctgtattggtccaggcttccggttaaatgagatcgcgaaaccaattattatgggcctacgccatggcatggcatgaacccagatttggaccccccacgagataacccttcgatgagcatactattgtaagtgaggcgccatcgaaccatgcgtcaatcgaggtcgaggatattcgcttcaatcaagcgtcctaggtcgataaagagtcgcactggcctctcttaagtacccacttctaactcgctgctttgacccacccctaatggctcatgatgacgcacgtcaaaacacctatcatggtcgtgatagccaaagcaatatttttcctttgcatgggagaatcttttatcaatagaattgaattgatttgatgttcagattcggaagtcagaattgctttttcaagatgattatcatgcacgtttattgtggtgtgtgagtgtatggattaatttaacttgagataggaatttggtatttatactgatactggtttcaaggcttttccagaaggtgttaacacagcagtgctaataaccaccaaccaattatgtccgcctacaactcagaactcatcgacattgagttcaacaggaagagtgacagccacaatttgactcatttcaacaccaatttctactatcagtacgagaactctggcaacttcagggatgaactctactctgagtactttgtccccgaagaaccaattgttctggacgacatggggcctccaccttcgctctcctctgcgtcagtgatgtcctctcctatgtcagacgtctctagacagttcacggtgggcggtgctccttcgctgaactccgagccaagctcgctggatttgtccgagctgttctctggaatgggcaaggaggagacagtccagtgtatctcaccaatgagcatcgaaaacggccgtaacgctgttgtcaatggcgttctggctgaggggagagaaaattcggatttgagtttgagagtgactgagagcagcgtcggtcaggggctgagtggtccgcttgaagaagacaccattggtaacgagtttatcaccaatgtgttcaacttggaccatgttgctaccaaccagaggctcaacaccgcttctgtttacgagttgagcaacagatttgagcatcccgcaagctcctcaatttctgttatctcaccatcatccgttccatcttcagtctcctccatggagtctatcaagcccccaacgagcgtgagctctttttcatccttctcttctgcctcttcatcctccagttacatttctcccgcttctaccaccaccaacaactccaccacccccaccagcgcagcttcgtcggctggcgacataatatcaaccaccaacttacagcccgcagttctccgaaatagcatcgcagaatcgaagaaaaagaaccacacaattgatatagtcacagagaccggagagaggaagaaaatctccgactctagactgtctttaccagagctgtccaagatcctcaacctcgcaaacaaccagaaggaggcctctgtcagagagaaaaacatcttaaacattctccaaaccactctcggcttcccattgggactcaagacctggatcagagacacttcctcccaagaaagggacgctttgatcgaccagctctacgtcaatgtccaagagaactacaactatggctattctaaagaaatcctggagattatcattagaagagcttcttactacatgatgcaaggacgtctacgtagagaaagaagggccatgaggaaaaagatgcaaggacgctctagttgaaagaggaaacagagtagcagggactattttttttttacttcttatcctatgtaatccaattattaatttcaaaagtaccatctcattgatgatttattgacccagtcggcccattatctgagataagtgtatgcccaattttttttcctgacaggttcagggcatggcccgaatcatcggcgacgacgagggtctatctcgttttcgctgggaatcatctatcaacccaacccagcccatgcagtaaactgtttcgcggcttgcatacggtttgaagttttatttgctcgtttacccccggaatgtgtgcagaccaatgcacgtctggttatttcctaatggggcaatacctaacaattactccacttcagagtgtgcgggtggcagatatctctttttttttcctgttttaaggttcagttttcctctccccttttgtttgagtttgtgtgtgagtctttgtgttctttgtgtgtttgtttgctttgacaggttcaatttgcttcgtataactcgctccttcagtacactccacttcaacccatgggcaactccacgtctacagactccgctcggctgaaatcccgtcttaaccatgagattgtcccgaatagaaaacagcacctaaacttcgttgattacaaggataaaccgtcaacttccaccgcaacaatcctttccacccaagagaaagcctccaggaaacaaagccccaacttgagcggtatccccaccgttaatgaccaactgataacgatccatgacacttatatcgaccagctggcgtcaacaacaaccgaagaagatgatgcggagggcaatctatccctggttaccacaatctcatcttccaattactctctcagtgatgctgatgaagagctgaacgataatgctttacataacgataacgattcacacccaaaaccaaaagctaaaactctcaatgttttcttgaaatggaaacctcttcatttcaagtactccgatgatgtgtatattattgctaattttctggataactggtccactaaatgctaccccaaagtgattaaggacgacaaaaacaaaaacattgtatacctttgcttcgagtttcaaaagctccgaataggctccatatacaagtttcagctcatcgtcaacgataaccttaccatcatcgagcatgatatcctaccaaaagcaactacttccagtgggaatattgtcaactggtttgaaatttccactgctaactttgactaccatgatgatcatgtctatatcaaacctctaactgtgacttgcgaagagaaggatcaaggaaagatccacaacattgctcgagctaagtctccccatttcagttccgtatcttccactaggaataactctgttacatctttttccaaagcagccagcaggtcttccaaatattccagtgaaattccctactatttcaattccgacgagataatctatccccaggataagcaccctgccaatactaatctcaatagaaaccattccttttatctcaaactattgagcttgcccgaaccgcctcttcttcccccatatttagattcaattttacttaacgaccgacacaagactaaatcaaagaaacaaagctcaaaacctcaagcgttgcatggaaagaatagtaatattaatgctgaccgacggtactcacttccaattaacaatctaaatattgccgataagtactctaggccacaagaatttgtggaagatgaacaatcaattgcttcaggacaaaaaaataaggaagcagaccactccatgttcaagagaggtttcaaggacaactcgatgcacaacatcacagaatcgatggttgccaaaagtcaaaccacagaaaatcaacagagagaaattgtccctacgcatgtcatgttgaaccacctgattacttccaatatttccaatgacattattcatgttagtgttattcaccggtaccagggaaagtacattaccacgattctatatactccagttgattcgtaaatagccatcgatgcttagttaacaaatctgaaatgtttgctggttgaatttttccagtaattcggcatcctctttattttgagccctttcttcattttcgtagtatcttgtggatatctttaaaaagttttccttcattatccactttctaacgttgatttcgaagctgactttacaattttcaatcagttcaatgcttgtcattgtaagaatgtcgtctttgcctcttctgattagaaatctcagatcaagcttagtcaacactttatcaatattgacgatccttctacacttttcagaaaggctcaggaacttcaaacctgtaagataactttctaccaatgaaggcgctaaaagagacttcttccctaataaccaactcaccgcgacactgcggttttggtgcaatgagtagcttacattaatcgcttggtacatctcaaatttcaactcccaacttttttgatccagttcgataaatctgatatcgagcccatcgcatatcttcttgagcctgtccatactcttgtctaattgctgctcctttatatcttttttattttctagaactttattggctttaagtacattctcattcaacaaagcaatatctttattcaaggagtccaattgagattgcaaacttttgatttcttgttgttttacttcaatttcattgtgaacttcatcaaacaactttctaaagttttctaactccgtcttgtcaactgcctcagaaagctgtttgcaccttctcaaatgagttaacttgtcctttaatacaacaaaacgatttttatattgttcatcatattccatagtgagttgttctagctgtttttttagttggagattcgcttctcttgatgtttgaaccttcttggttacagattcttcaataccctttagcaattgaagtctccagttataccaaattcccctggcttgctgccttgaatagttcttaacaagatgaaaatctcgctgcatttcctttttcagctgtgagttgtgttgcaattccatatattctctgataagaggagggttatcatctaaaatctcagcttccaagttgctgaaaattatctttccctcgtcaatgttcgaactgagctctttacagctgaattccagtaactgtaagaaattcaatctattgaaagcataaaggaagtcttgcaatgatggcttcgtatcaaacgtttttccattcttgtatggtacacaatcaacatccaggtcatcataaaatgtaacatttatgcttgataagaactctgataatgaaacatttatgtaatcatcctgagagttcagtagagcttgttcactgtcatccaaaaatgaagtttcagccaacggtacgatactagtcgcagtttgacatttgaattgcattggagatccaagcttgaagggatcttgaagatgctgaggggaatctttcgcttgaacttgcttctctagtctcgatatgtccaaagaaaacctcttcttgtgttttctgttcctaggtgtcagggaaagtatcttttcctgaaggctcagaggtgattctttctgaggggtcaatggtccactcaaagaagcacgtctttttggatagttgtcaaccgttggagagggggtacgtttacaattacttgagttaatggctaaagcagttgaggtttggggctctaccaaagttattttttcaatgattggcaacctttgatccatcaatggggagtcattgtttagttttcttcttttgtgaccttttttctctgaaacaggggagccattactggtcgttctaatctttgaggaagaggaaggggctttttttggagagtgcgacataactggagcggtacatgagtctctagaggaagagggacgaggagtttcagtactggctgcaaattcttgatcctcatcctccagttcttgaacgcaaacaggttttatcctgcttcctttcttggttttggaactgggtcttgaactacgttcttgatcggctcgcaactcaagtggttgatcagagatatgattaaagtcagcatccttctgccgcagaggtgcatttttagagtgctctgtaaaagatttttcactgatttccctaggaactgtatcaccttcaattgatgcctgtcgaatagaatcatttaatggttcattttcctcgggtagcaatccatgagcgagttccacaggagcactcaaaatactagtaaatacctgttcagtgatctccatgggttgcagattctctccagattctgtttcttcaataggctgagaaatcgaattcaaattttccatacaaatctgtccttctgctactgtttgaggagcaacttgggttggcaccattagcatctgcccatctttagattgcaatgcttggtcctgttgagccgtttctacatctgcagctaactcgcctctttgcagtttcaaatcagtactctcttggctaatatactgtgttacttccatgggtattatttcatcttctggcattgtatcattttcaaactgagttttgatttgttcattctccgttaagactggacagtcatcatcttgaacgtctttgcatatttggggcgatgcagaagaaagaattccaggtacatcctgtgcagattgtaatcctggcagcgtttgaatgtttcctgtaggcagttgctccttagagtgttgtggttcggtttcagcttgaaaattatgattgcttaactctacggctatgtttggttcagctcgaagtgtacctggatctgtttgaagctcattatctgcgagctctaaagtgatcgtttccttcgtttgcacttctccgttatcaaattcggtccctgtccgaaaactatcttgggttgtcgactgtagttcacattgtggtctttggtcaggttgagaaaaaatatgagtatgtgattggccttcaagttgcagttgcgtcatacgagactcctcttgaatttgcagttggtatgccgattgcgtttggccaagttctttggcgttttcaccatcaatttcagcatccgttttagaatgttcatcatctctagaaacaaaatcagggtttagtttcattgaactctcttccatatcttgttctttgtgtgtaagttgttgtgtttgggagactgtctgagtcaattccatagggacaccatcttcagcgtggaaatagtgctcagcttgagaagcagtctgcgttaactccatgggtacttcattttgaatgtcgaattgccgttcagtttgagaaacagtttgggttagttccattggaacttcatcttcgatgtctatgctctggtcaacctgagaaacggttgtagttaactccattggcacattgtcttcaagatttatttgacaatcagcttgagaagtattgtcacctacttctaccggcaaaatatcgtcagtctgagactcctgaatgtcaagaattgtctgaggtaattgcttgggtacttggttgtcgttagcttgagatacaacttctaccgaagatttttccaagtccccacccagaaattctgaacttgaaacttgtttaccctcaagatcattactcagacgttggtacggttttggcaactgaatctgggtcaattccatggaaaaggcttgatccggggcttcatcaaacaaactatcaaactcttcagggacaataggtgataaggattcactttctctcagctcatcttcttgtgttcctgtgataccttgatcttgcaagtcaccaaccaagttttcagattcggctgcactagcttcatcttcactactgtcattcaacatctccctaccaatggcttcatcgtcatcctcccgtaactcgtcctcatcaggaaaaggaccatcacgtaaaatctgcgcagcagaaaacccttgaaagctctctcgtcttctaggtcccttttcgggttgtatatactggggtatcaagtctattttgtgcaatgtcacttccggagcaaacgttacacgcctgctaggacgaggcttcatcttagaaaaggagcccatacgaagagtagaaagcgcgttggttgttccatctaaaaagctttgttgcatcaccgtaattgtcttgttttcatctttagtatcatcatgaataacattagaggaaacttgtttcaaaatgcttctaacggatgtggtggaagccaatgaatgtcgtctatatggaataggctttttattttcaactctagcattttcctcgtcgctaggcggtcccatgttagttgcaaaggagatacttggtatttgtttgtgtttaggaaagtttgttgatgttaggagagacgcgataaagggaagaaaatgtggactgcacgcgatcctacggagcatcccccgcccagcggatctttctaccggtttttttcatctgcccaaccaggaaacaggtttctttcgagaagtgcttgattcaagtcatataaaccactttattataatggatcctaataggatactggaagtccatatatggggaaagaacaatcaggtggctaaaatagatgcgcaatgccttgccatagcgtggtatttgagtctcacatgtagcaagttgaacaatgtcaagctagtagccagttgtaatggctcaatctctccaacgggaagattaccagtactggtagactacgatcgacagcagacacagctgaagcacaaagtggtaggatatttagacatagtgagatacctggagactcaatacgaattgacattggacgaattaagcccagagaatcatctgatcaatgagggtgccatagaatacattctgaagactatcgaaacaacgaccatgtacacgttattcgtcaacaaggaaaattatgaaggctatagcagatccatattttctcagtatttgccctttcccatgcagtattctgcgccgttattctttaggaagttgagttatgaaagatgtcaaggaattggactgctaaagggaaatactacggtggaggaggacttggatgatgacaatgaggagtattatatccaagagttgaaagaaatgaacaaaaaattatcgcaaacagggatccggatgggaggcctgtacgagcggcagcagcgggataaattgaatgagttaatggtaagagagaatacgctcacaaacatgcgctgtatctatcttttggggcagtacattgaaactgtccttagcatgcagggagagaatatagttagtgatgattcagttgggaattctgagaaagagacggatgattcaactagtagtcatatacatcttccaaatgaaacctattcgtttggtagtaaactgtccagctgtgacatactactctttgcatgcgtttccatattgacttttgatgaacttcccaataagagcgtgcatggatttgtaactaacaactttccaaaactggtctcaacagtggaggatttcgaacttgcaatcaaccatcggttactagattttgaaaaggtcgtctcgccagctccttcacaagttccaacgctaaccaacacaatcaaatcatacgttgtagatctgtaaatagagcctccataagggacaagtatctacactttggaaggtttaatcagtccctcatgggcaaagtagtaaaccacagacccatcatctgtgacaacaccgatcacaattctcttgggacgtacacctaaaagtctgtcaattctattgaatattccttcgatgtcactaagagaaagattctggctaatatgagcaggatagacaaactccaaagtgtcttgagccgtattctttgtaagcgactctttgggatatccttgaattacaaaatcatccaagatattgacatgcgtccaaaaatggaagtgttccaggtttgtttgcacgacatccaacaaagacatcgacaaacgaggaaaaattggctccttttataccagttctgtagttagtcttgagggccgctgaagtctaactagtgaagtgggaggattaagtaagaaaataatcgtagcgaaaaagtccgtacaaaatacaacataaataatccaaattcagagccaaacaaggcgaagacgcccacaagttcaagatacctgtaggccaaggtgctacaaatagggtctacaaaagttcacctttcacctttatttaaacagttttttgcctctgtccatcgatatagcaatctttattggaaacagataaacgccaaaaatgatgagaaagacagagaaggtgtttaaagctccaaagatgctcctgaagtggttctattccgcttcttttgctctattcttcatccttcttttggccttcaatgtcatcacccctattgataccattgttcaaagtaaagtggccaataatttggcatttaacgcaatagttatcataatgtcctgtgttgtgtttgctgttttttcattaattgcctattcgactagaattttcgttttaagggtacacattcaagatatcccaaagaagtatatccctacgcacgacaaagatctaccagtcgtggcactcagagagataagaaaagcattcaaagagagtgaaaccatacgaaacaatagtttacctaatcaagacatccagcacccaggaatgttctaccgaaaggaagattcttcaaacacccaaatggggctgttgaatggactgatttacgaggatataatcaatacgtttggtgctcgggtgagagaggggggattcatgctattagatagcgagacgaaaaagagatttggggataagttgacactgcgggaatatattcatcaaatgaaagtacatcatttactgccgcctacatcggaggcaagcaccaagactttcattgaccattatgaaaagttgcgctttagtggaaaaacaatctcggaacgtgactttttcatgtttttgaatttttttggagaacatacaatggattcatttgcctcttaacggaacaatcagaaaagaaaaaaaccatgtgatgcttgttcccatatgccgtttcgaaccaggtgtgaaagaataaagttagagcgcacacacattttgctaaaactagacccgaacaagttaggtttccctgctgatattaccagattaggatagttgaggtgtattggtcaacgctcctatcggggatatctctgaaaaatccaattttatcaaaataatctatgcaccctactatggttttaaccctcgaaatcaggattttatgcaacttcccgccgatttttaagaagacttttctagaccctagtagtttgctaggagatttgacaataacacttttattatcaggatgccgttgatgtgaattgcagatgctgatgcaaaatatccccagcaactgccccaattggtggtgctgcccctttatttgtgttttcattcacccttccgtgtttcgaagtttgcctatatattgatgttctcccccacttgagatgtgtcaaagtactttaatcttcaagttatttttacattcgcttcaatatgttgaccaaattcttgattccagtcgttgcttccattgccgcagtttctgctgccccaaaggcctctccatttgctttggccgaggcaggtgccattccatatgagtttgctcaagctcttgagactccagaagttttcaagagagctgaagactacaactgtcacttgaactgtggtttgatgatctacgctgcttgggactgtggtccagaggccggtccattcgacgccgactgtctgtgttccgatggatctgcctttaacactcgtaaggactactgtctggagtgtggatggtgtttgtaccaatcttacttcggatacttgtctggcccattggctacttgtggatacccaaccactccaactggtcaaacatgtattgagaccgcaactggtttgaccccaaccattggtccattcactaacggtggtggtgccacttcctccagcagctcttccagctctgctgctccaacttcatccagctctgcttccagttctgctgctccatcttcttccgaagtatccagttctgctgccccatcttcttccgaagtatccagttctgctgccccatcttcttccgaagtatccagttctgcctcatccgtagctccaacttcttccgcagtttcaagtagtggctcttccgtggctccaactgtttcctcagcttctacttcacactcttcttccgtggctccatccgttagcccaatcgctggtggtgctgctgccaatggtgttggtatctctgccatgttcggtgctgttatgggttacctctttatctaagaatcttacacttactttttatgggactgtataagtattgaatactaatgcaaatgataatataatctaactggcattagccaactcgtatttagcggacatccgtcatcttgtctggtttttttttgttttctcgcaggcagaggagtcgatataatcagtgtgcgatcgtgattttttcccgcccgtttaccgaccgaaaggaaacacatctcaatggaactgggcaaactatcgttttgcgtggccattctgtttagccaatgttgtcactgtctgccaacggaacatccaacagcagccaaggtagcaacagccttccaccctttggtcactggagaggcggtaccaccactggcgaaacgtgaaccaatgagggattatatcatcaacaaggactacgccgaagcacaggccgcaaagactagatcgtcaacatcatctgaggctccagaaccctggttgagaacgatatattccacagttccggagattgtcactcccacagttattggaggcatcactttcggtgccaaacctccaaaaacgaccgatggattggagccttgggtgtcgctcaaaaaggatggttctccgaacactatcagacccaagatgaaggatggcaaaatcaaagacggtaggccaaactattcgacttattttgaatctgtcgttacaatgacctatagcaaggaagagttgaaagcccataacatgaaagaggatgaaatatttgtacacaaggaatcaattcctgaggaccagacatatgtgtccttgaatccattgatccgttgtactccgcagttctaccataaaaagggtcttgctaaacacgaatcaagcgaaccaatttgtttcccacatgaagatcagaaaatcaagctagggaaggtacactttttgagctggtatacacattatttcaccgaaggggatgacgatcaagaacagacggtcgtagaaaaagtcaaaatacattttgcttatcttaaaccatcagcacagaaaaaggatatgcgtaagagagagattccaaacgttcccaaagtgatcccagctgaaaactacgaaactttccagggtgatattcctggtaccttcttttcgtctgagtggataccaaacaccgacggatatttccccattgaagtcaaagaggaatggttaaagggtaagcagtttagattggtgttcattggtattcagccagaaagtgtttccgacgaggattatgatcttctgaatggaagcggagttatggttcagtttgccaaaggtgccgttgtctcaaaaactacgaagcaagatatggcaatacaagagtcacccagaacaggtgacgatatgtactatattatcatgaccatgccaacggtcgtggtattggcagtgtgtttcatgtatttgttcctgtacctgaaaagaaatcaaagagacgtttccaagatcaagaaaccaaaacgtagccgatttgggctacataaaaatgtcccaccagaatatgatcgtttgcctcgttttaacggagacgttcggatgaacaacatgaaaagttcctgaggacatgacttgcgcacaatgaatcaagatacctggtatcgtcgaaaatagtttgttggggattatgataactaattaattaaaaaaaaatggagagaagttcgttgtagcttctttgctgttctgttatggtgtgtatggtttggttcattaaatatctcctgagtatcgttaaatattccattttccgagtagtaactctgatccattattgctgtgtctttgatgttgctgtcaaacaaccgttcattctctgtggaggcaggaccgacccagatacagctttgaaaatgtttaatatcatataaactcgagtccaaatctgagtccatatgtgtagtgtctgtaacttgtaactgtgaatttatctccctttcttcatctcttttctcctctagagcaagatccaggtggtcgagacttcgagttggagacgaagattccatggcgcttacggccagctgatagtcttcgaacgctgacgctagagagctcttatgcgcgtgccctatcttatctgattggttgttcttctgtccctgttcttcagtgggtgtcttcagggaaacgatgtcaaaggaatagctcatttcggagcttgaatcttcagagatatcgtgaatacgctcaagtgactccaaatggttcaaatttccttgaggaatatacatagagaaccgtttagagtcgtttgttttgcgaggacgcgttcgacgcgtggtagtggagttcaaggatggtgaatgtgggatttgagagttattagggataccaaaaccggaagggtcgccattaaaatcagactgagatggcttgctctctttgggcgtctgtttcaaggatgaccacacggtgttggcagattttttgctcatcaaatgcactgataatttaacagactgcaatcttgccccgacaaatttcaggtgggatacatgctcaaaactctagcgcaggagtcaaaccacaattgctcgtagcatctaattcgagatgcccgtactgggaaggcactgcagcctagcctagcagagcgcgtttccctgcggggtggtccgctgccacaaaaccctacctaccacaccgaggaagaaaacatcctcgccgagatccgaaagctgggaagagaatgctgctggaaggcaaagagatctcatagtattcgttttttgcagatctcaacagtttttactccgcgttaggatttcatcacctaacgcatgtcatctactcaagattattacgatctcatcgctgatgcaacagcttccatcagagatcgtgtcccggctcacctggcaagccccaaagttctcataatctgtggctcgggtctgggcggcatcgcctctcgtataaaaggtgacgcagaggtaattttacattacgaaaccattcctgggtttcaaaaatcaacagtcgcaggccatgcaggacatttgcaatttggacttatgggaatcgacccaaaccaagataatctggtccctgtcatctgtatggttgggagattgcatttctatgaaggttacagttttcaggcagctacgtttccagtgagagtggccaccgagttgggagttgaaactgtgattatcaccaatgcggctggaggggtcaatccgagatatgttcctggcgacttaatgataatgaacgaccatatcaactttccaggtctttcgggccaacatccattgaagggccccaatcttgaaaagtttggtccacgattccctgccacatctgatgcctacgacctagagcttagaaaagcactcatacaccaagctgaagccgcaaacttgtccagaaccattcatgaaggagtgtacgcattcgtatctgggccaactttcgaaagccgagctgaagtgagaatgctacgtttaatgggcgccgacgccgtgggcatgagttcagttccagaggtggttgtcgcaagacatagcggactaaaagtcttgggactaagtctgataacaaattctggagtttcggatcctccaaccagtgcatttatagatgattctcaaacacctgacagcaaaggccatgccagccatgaagaagtgctgttgcacgcccaagaggctgcacaggatgtggaaacgctcgttgaacgtttagttgggctgttatgattatatattcgttgctatgatcactaaataagcatattataatatctattcgttaaccacaaagcgtgccggaggatgtgacccatagaattgagacggttcgtatattggtcttccatcaggaccgacccccgaatagggcaccccaaccatgaatgactgttgattccgatatgaaggagactctatcttaggaataggtgggccttgatgtaacggagggagaggcatcaaatgttgcgggtgcagatgctgctgctgatgatgctgctgttcatgttgttgctgtacaatgtgcatctgctgagggtgttgctgatgttgaggaggaggaggtggtggaggaataggcggcatttgattgaaagaagtcaaacttttctggtgttcagggaatggggattgttgggaaggtgggtacattggtgaaggcgcatagtgctgatagttttgtggttgaaactgttgctgctgttgttgctgttgttgttgtaactgtggtgaagcaggacgaggggaaatttgtgggggggcaacaggaggatgggttgcaattgagaatctctgatcggcgcttggggacaagttcttgtttgccggagcatgcacacgctgttgctgtgctaatggaacgttagggagtgagtgaactggtaagttctgtcgctgtggctgtgaatcttcggatggtaggttatagttatttgcggagtgagacgggtagggaggcattggtctcgaagtgtcagttcgcttcttgctgctactcttgatttctggagcggatgcgatgtcatctaacgaagcattggccaaattttctctttcagatatactcagtgaagtaagatctcgcagtaaatataacggagattgacaacatgtgcttggtctgtaatcagaaagcggaatctctccagataccactcttcgtaaagtttccaatcgcgagttcaagaaatttgcccgagagctatcacccgcttggcttgcatagctgcttgacttcatacaggcctctatagagtcagccaactgaccatgacacttttcgtacaccgatgaaagaccctcccaagcaaatgagagcaaaatcttgctctcttgttcttgttctgtttcacgtttgatgacaaacatatacgcgctaaggtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacacagaattccgaaacgatgagattcccatctattttcaccgctgtcttgttcgctgcctcctctgcattggctgcccctgttaacactaccactgaagacgagactgctcaaattccagctgaagcagttatcggttactctgaccttgagggtgatttcgacgtcgctgttttgcctttctctaactccactaacaacggtttgttgttcattaacaccactatcgcttccattgctgctaaggaagagggtgtctctctcgagaagagagaggccgaagctgctagaactaccgagccaatcattgacttaggatacgctagatacagaggttcaatcaacgacactacctctgtcacttcatacctgggtatcagatttgctgaacctccagttgaggacttgagatggagagccccacaacctgctaagagacttcctggtgttcaaaacgccactattgttcctccattgtgtccacaaggtttcatcaacatcttgattccaggaggtattccacctccagacttgaccaacgtttctgaagactgcttgttcttgtccgtttttgcacctagaaagttgccacctaagcgtaaggaattgccagtgattgtttggattcatggtggaggatacatcgtctcctctgcagctactttcgacggaactaacttggttagagagtctaacgactctgtcattgtggtgactatccagtacagactgggaattttcggattcatggctggtaagaagttgaaggataacggagacttgaatgctggattgcttgaccaagagttggctttgaagtgggttcaacagcacattaacaagttcggtggtgaccctaagcaagtgaccatttggggtcaatcagctggaggtggttctgtgttgcaacaggtcattgctcacaacggacaaactaacccaccattgttcagagctgctatgtcttcctctacctaccttccttctcaacaccatttcgacgatcctgttccagaaggtatctactctaccgttgtctcaactgctggttgtgctgatgctactgatcctcttacttgcttgagagcttctaacacctccatcttacaagctgctaacgacaaggcatgtagatccgcattctacggtacttccgttgttgttcctgttgttgatggtgagttcatcacccaaagaccatctgaagctcttagacaaagacgtgtcaacggtaacgctttgttggctatctctaataccaacgaaggtgacatcttcgttgaccaatctaaggctgacactgttactgctgctcagttcgttagagacttgtaccctagattgaacggtgctcaagttgctgaggttgttcgtctgtactctggtttaggtgctccaatccaacaggctgactctatcatgggagatactctgttccaatgtccaaccatttggttctctcaagccttcagacaatctttcaagggtgaatacgctgttcttcctgcattccacggttctgacatttcccagtacttcccatcttttgctcctagattcttcgacgatcctgctttcacttcctctttcactcagtccttcttggacttcgctttgtctcgtaactctgatcctaacgcaaagtttgacgacggtaacttgactcctagatggaacagatacacctcttgctcaaagttcgagatggtgttcaaccgtactgatggtgaagagttggacattagaccagcttctactggtgctggtttgttggagagatgtgcattctgggaatctgtctccgaattgactgctcaataagcggccgctcaagaggatgtcagaatgccatttgcctgagagatgcaggcttcatttttgatacttttttatttgtaacctatatagtataggattttttttgtcattttgtttcttctcgtacgagcttgctcctgatcagcctatctcgcagcagatgaatatcttgtggtaggggtttgggaaaatcattcgagtttgatgtttttcttggtatttcccactcctcttcagagtacagaagattaagtgagaccttcgtttgtgcggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttctagagtgttgttactttatacttccggctcgtataatacgacaaggtgtaaggaggactaaaccatggctaaactcacctctgctgttccagtcctgactgctcgtgatgttgctggtgctgttgagttctggactgatagactcggtttctcccgtgacttcgtagaggacgactttgccggtgttgtacgtgacgacgttaccctgttcatctccgcagttcaggaccaggttgtgccagacaacactctggcatgggtatgggttcgtggtctggacgaactgtacgctgagtggtctgaggtcgtgtctaccaacttccgtgatgcatctggtccagctatgaccgagatcggtgaacagccctggggtcgtgagtttgcactgcgtgatccagctggtaactgcgtgcatttcgtcgcagaagagcaggactaacaattgacaccttacgattatttagagagtatttattagttttattgtatgtatacggatgttttattatctatttatgcccttatattctgtaactatccaaaagtcctatcttatcaagccagcaatctatgtccgcgaacgtcaactaaaaataagctttttatgctcttctctctttttttcccttcggtataattataccttgcatccacagattctcctgccaaattttgcataatcctttacaacatggctatatgggagcacttagcgccctccaaaacccatattgcctacgcatgtataggtgttttttccacaatattttctctgtgctctctttttattaaagagaagctctatatcggagaagcttctgtggccgttatattcggccttatcgtgggaccacattgcctgaattggtttgccccggaagattggggaaacttggatctgattaccttagctgcaggtaccactcatcagccagctggcccagttcggcataaaggtttcccactgcaagccatacaattgtgtggtttggagcccttttcaaggccaactggaatgcttcgtaggcctcgcttggttggcgcagcatttgataagcctcaccaagtaaaaaccatggtagaaagtcgttgctttccgaattaacaacttgccgaagcaggacacaagcagactgtgggttaaatacgtgactgttcggtagtagcaacaagtatgcgtggcatatatatatgcatggctcgaatcctaacagtccagatgcctcctcacagacgcgcactgccttggccatatctccaaggcgctcattagcactaatgagggcgcaccaaagagaggaatactctgtgaagcgggaagaagagggaggcggaagagccaaagtggcctccaactcatccctggcagcttcgatgttgccctccgcagcaagaacggaggcaaattctgagtgggtggaacgggccacgtcaatctcttcttttgtatagtctgcaacgtcattggggagtttcaccaaggctgtgttcagtgcatcgacggcctcatgtttggaacctgcggccatcaatgtttgtcctttaagtaaccataatgcagagttgttgggagttaattgaatacatctttgtagggcctccatggcattcgttgtgttgtttaagagtagatagcattcggcagcttctctccagatagatggatctttgtaaagctctgatgagcgtgataaaaggtcgttgataacatccagggccgctgcggtaccgtctgtttggtccttgaccagatccatagccctcaatgcagctgcgagtccacaaagagccttctcgttgaatggatcattttggagggcaaaatcgaacgaatcaattgccagctggtacaagtggacttcgtgagccatggatccgagcgctagccaagtggagacagctatcttgcgaaactcgagttgtttatcatataccactttccgttgctgggagtcagcttgagacgttggtacgggatcatgcctcacttccagtgtcactggcggaggctgtgaaggttcgttcataagtagtggtaaatatcgtggggtgccagttgatacgagaatggatgaaatggaatgtttccttgtttctctttccttgtggcaacaatctaacactggatctcttgacaacaagagagttgaaattgaatagaggagggggagagtggaactctatagtctggaggggagtgttctgagtattgaaagttttcacaaaagaaatctgaagtggcaaggaatttttgggagtgtagggaggaaagaagaagaagaacacaacttagccttggaaatgatgctccgactgagcgtttcaaaaatttacaacctctgcatacgtttgcttattagacctacgattacttacgggcgtacatatatacatgataggtgcatacataatgtaatgcaaccaagatgctgtgtataaaataatgcatcttcgagaagagacacatcacgttaaaattagtgcctggaacactgttcatgcgcatccagcttgcattgccatccacttttgtaacaatcagatatgcaaagttactaacccgtacaaaaggtgaactagaaaaaaaggaaacaaagtaacgttttgaaatcaaggggcaaaataattaactcgacactccagagcaagatggcggccaaatatcaccctactaggactactgcgtcgtgttttctgtgctgatgcaaagttgttgcacacattttcaaacgcagcattttttaatgaagcgcgtatcctcaatttcagcctttctgagctgcttgttgttaatgcattctgcgcatgcaagtgcaatatgttaccatggtaattcttagtaatatgcagacttgtgctttttttttgttcaaaagcaacccaaaaatgggtttactaaaacaagatccacgaaagtcggattgtgtcaatagggtaatttccttttagtccactcccatcagccgaaaatggtaaacacgccttgaaagggcacaacagaaatgagaggctgcacccttccattcccagttggaccaagaaagaaactgacgaaacttttactggcagattgttaccagtggggagggactgtcagaagtcaaaatgaaatggaatggaatgaaataacaattctaggcgacaagagaaaaaaaaaaaacgacccacatgcaaaaagaaaagatacaaggatgatctcccgtgcacctgtcctatcgcgaaaagaacagcacaatcaacgtcaactatgtgtggtaccttattaaaaatatcgccaaattttatatatgaaattacacctctttaaacggaattagccagtcctgcagaaaatgcgtatgcccatgtacgactttggccattatctagatagttattgttccatacatcatcatttgaaaaaaatgaaaatgcagacacaggatcagaaagtgcctggtttaatctcagaattcccgtccatcctgagttcacatctggcagtatgtttgaaatcacagaggaccactcctgagagacaaattggggcgtcctgatcaacgaggaggctggtgtgataggcagcatgtggataccgtggatgtattccttattagtaccaaaataagtggtgtaatccattttgttttcaaacagaattcccgcaaccctgttggggatgatctccgatgggaccacagcgttgctgtcctcaaagaggaagtacgttcctatagctcgactcattatagaaagcatcaggtttcctctctgctccatggaggtatcgccaattactgctccccataacttcattccataggcaaagttgtaatcttccgaactagactcttggtttcgtccatcgtatgcggagaacagcccgctggcccacgaatggccctggtaccaatcgaaagacctggaaacagggaagtaagaatccccatctgaagggttggcaacatctctgaccaaagagttgacccagtctttattggcttgagcccaggtcccattgcctatcttgttgtcgacatgtccgattacagctgctgcgtggatgaagtaaccgtaatggaaatggtgatcgttgtaatatgcagatccaaagtcaacaccggtgtctccactttgagacccagtggatgtcactcctccataccttgtgtcgtacattagtggatagtactgctggtttgaggtgaacactccaatagtctctttcaaggtctctaaaagactcagagcaacctcatcgtcctggatgatgtctgaaatgaccagcaaaatgtaagcatacttgtccaggacttttcctgaaaagtagttggagtccagccccgtcactgcatttttgatgtcctgcgagatttcgtcattggcaatttgggcaagctcttgtagttgttgtgctgtgtatgagagagttttactcatgaaagaggcccaaggcagaaattggatttgagaggttacggtctcttggagtcctaggacattggtcaggtaagcccttagtttgcccttggtggttgattccaattgaactcccgtgtcacgagcattggttgattcgtcgatggagtcgacttggtggggtagggcaaacactagggtgcttcctgaagatgacttccccttagtgtcatatacgatactatatgaggcaacattggtggaaatatctgtcgaaccggtaaccactgcagactcagggtacataccagccgcatagtcgtagtaaatttcagactcttctttctcagctgccttggcaacttgcacaattaacccgtcaaccgactcggttccttgcagggtgtaattgtctgtgatttctaacttgtagtctgacgaagtgccctctgggagtgtcacataaaccaaccattcaatatcactgaaaagagttactctgaactttagaactccggaaggaagagttttagaagtctcctgagttagagtcttaaaaccaacttgagagctcagtctgagtgtcagagatccctcgtaaaccccagagacaaatcccattccttccaccaatggagcgtgaacagatccgctggaggattgcaaagttgccaatactgacaattctttcaactctgaaacttgcaaactcaatcctgaagatgtgaactctttggccgataaaactaagtgaccaaccagggtaggattaaggaagtaactggaggctccgtttgaattggtgggcccaaacaccttatcactctctgtgtagtgagagattcccagcccgagatggttttcagaagtgtagaatacactgtatggataggtgattaccgcccccttttgatcaccaataacaatgttttggtaaaacttgttggtctggtagggtttgccgttgttagacactgagctcaacaatggaagaggtaaatcctgtctagagaagacacttggaggtggtgcagtgtcgatagtttcgaacaaatctacgacaccaacatctggacttggcacggtagtctgagttggagagacctttgaagtttctgttgcagtttcagtcccaatggcgctggaggaattgaagctactatagagcgttgacaaagttgtgaaagtcgagccaagtgaggtttgcgtagcagtcgcagttccaattattgtagacgaattgaagctactgtagactgtcttcaaagtttcataagttgaagttgaccgagttccgttcactagaccggtgctaatctgcacactttcagtcaaggttgcagtttctatagttcttgaggccgacgaagttgccacaggctctgtgaccagagggttgctagaaattgaagtctctaatcctgtgctgattcgtcccaaagaacttgttgggattgatgttgtagccgaaaaaaccgtgctggtagtcgtcggagccgtggaggcctcaattggattcactgagatgattttttcagtttcacttaccgattgagtctcctttgcaggtgcggctgaagaacgaatggtaccataagttgctgtgctagtgtagtagagagtggtagcataagtactatagcttgtggagaggtatagttcgtaccgtccactggggccgtagatagtggaaaatgcgggaagttcatttgggtttgatccttcgttcgaattgccatttgaaatttctccagtggctgctttcgttgagtccccatcggccgacttggatggtacaactccgtcaccatcagcataaacagtgacagttcttggagcggcagtaaaagtcttcgtaacctttgaggtggaccatactgaaatgactgctccactgactatattggtcaacagaaccaacaacaagaaaagttgtggcacgttggaagagaatgacatttgggaagctaacgagagaaaggtttgatatgattacggaacaacctgaatgctatgctactcatatatataaccgttggatggtggatgacaccagccattgatcattaggtcctgttttttacctcaaatacccgtgaatcaggcacattaacaaagaaggttggtttcatttctactttagaaatctactgatgcacagcgacacggatgcagcaaaaactaataataaaaagctcgaaaaaaaaccgttgaaatgcaaggttattgccaaatcgagcaatcacgtaccagccatgcccttccaaaccatttttaggtcgattcagtccactctgagaagggtgttaatttcattactattgattcaatctgatctgatcgcaatcaatacgatcgtaaactatgatatgcactgttatttcgcctatttatttcccctttttgtacattactcccttatactcgttaaaatcaaaactgcccttccttgaggtcaacggatcttcttcttcatctgaattgggtgcgttgacagatgcggaagactcatcgcaactcttcaatccaaattcaaatcggttttcccatttgtcgtgaattttattgtacatgtgttctcccttttccttaacctgatccaacagagaattattctttgtatgacctgtaaactcaaccccattgcgctctgcaattgtggttgagcttgggtccatatttgggagcgcactgttcagctcggtggagcaccttcttttgagattttgaggcgacatgtggtcaaatattgctttctcctcttccttggatcctgcgcttccttgcctgcgaagctttgccttggacatctcgttcttgtaatttgatgttgacctccgcactagccccggtggtgggataaaaaaatcctccacggggacttttactggttgtgggatagggtccattgagtttgctctgctcaccggcttcaaaggcggcgtaaagtgtagggtcgaatcctcgttcattgtttcttctagctcacttttgaccggtcaattggtagtgaggttatgtcaactgattatgcttataatttgatggattgctagtttccaccttgtgtagatgtgtgcttgctgggacaaaaagcttaaacaaatccggctgtaaaatcaggttataaagccaaaagatgcgcgaagaatggcaaattgtgtgaaaggccgtgagtgatgcactaccacgtcattgtctatgcgacgaattatctggggtgaatatgatcagaaagcactttttgcagatgtttatacaaaaggacaagtatttggttgtagaccttcctcaaggacaaacaaagttgtaagtagcttaattggggaaattcgatactaatcagcgtttttgcggtactaacagcgtcatttttcagtcattatatttggcttagagaccattgtagatgtaaacagtgctatgatcacttgacaattcaaagactggtgaattctccagaggtaagtcacaagacacttatttaaaaaaattttgtgatcagctaatttactaacaatagatcccgttggaaatctctccacaccacgtctcggcttcggaggatggactgagtgtgaatgtggtatggcctgacgaacatcaaagcaagtatgacctgaaatttcttgcaaacaactcatattggccaccgttgaacccggagtctggtgctaaaatccattctggtaacggtaagttggacaaagttccgtggaatgtcgaatttctgaaagagaatttgccccaggttgagtactccaaagtgatggacaccagcacagacgatgggattgcagaatggtgtctgaaaatctggaaatatgggttttgttttgttaacaacacccctgttgacccagaatcgactaagaagttgatagaaagaattgcatttattagacctacccactatggtggattctgggattttacgtctgatttgtcaactcatgacaatgcctacagtgatgtcgctatcccattgcacatcgacaacacttacttcactgaccccgctggcttgcaactgtttcatcttttgaagcacactggagaaggtggaatcaccaccctctgcgattcgcttcatgctgccaatatcttgaagcagcagaaccctgagtattatgaaattctatcaaaaattccagttccagctcattccgccggagaggaaaatgtgttcattcaaccatctcatgctaaacccattatcaatcatgataacgagggaaatgtcatccaggtccgctggaacacgagcgatcgttcagtcatgaacgggttgtcctttaaaaaccctgaaactgaagtccccctgttctacgctgcaatcaagaaatggaacgatatcattgaatccaaggacaacgagttctttcaccaattgaaaccgggacaatgtctcatctttgataactggagggtttttcattccagaaggacctctttcactggggaacgtagaatgtgtggtgcttacatcaaccacgacgattatgttagcagggtaaagctactcaacttgtctagggacgatctccttgaaacactatagagtcttggatatcaagacacttttccagatctgtccaattatctactgcgacaaatcgtatatcttttatattatcagaatccaattgttttatctctagaacttcctggcctagctttcttaaagcttcacttgccgatcctcctcttataactacccccttgtcagccttcaacatggcaagacaatcaacactactgtctccaacgtatagaactttccctccattcaatctagatttaatttcgaccaccttaaccattttatcgtatcctgttgttattccatcatctcgcaaagtacctagacaatatccgtcctcgtcaaactcgaaatcgtttcctatcatcattatctcgttgggaacgggatcaaaccctatggacctcaaatatgcctctataattttttgagtccaattaacactaatcaccccaaaaccaatatttctgtctcttaacttttgcaagacttctgggaacccttcatggataacaagattctcgacctgtttattaaagctattcacatgaacaccgtgaaagcagttcaacttgataacatcaatttttgtcttcatctcaacaaattctccaaaatatttctggaattcaatctccttctccatagtatccctatgcttaaactcatgattgggcaaatggacctcaaaaagctttttgaaccgatccatatagagcttttggaaatacttgaaatcccaaggataaccttctggcttatctaatctaagagcttcaaagaccaacggaatcgtatcctccttagtaatggttccgtcccaatcgctcaacaccagagataggctatccggttctagaaactgtcgaaatagctcactctgctgttccatgatctctggcgtgtggaatctttgtgtcttgccagcaagtactttgcttctactcctccgggctccgagactgaactttgacgaaaaatatatcagattatgtaatcggtcaactaaatctacttagatctttatcttgactattcgtaaacctctgcatagtaggaagggaaattggtcttcatctcctttatatagttttgccaatcagagagctgaaccgtattaaggccagtttcgttgtggaaactcctattgctaacaatatcccgatcaatcttcttcgaacttcgaataactgccttaatagcttcttgctggttctccacttgttgtttagtcgccgtctcttttagctgtttggatagtattttgttgaaagaagcaatgagcgaggacaaaatatctcccgtcgacaacaacccaggtttgatggtaacaagctttgataagatgatgctgctgagtagaacaatagcattatcatccctgaatcctttgttgatcaaactcatcatgatgtcctcataattaattatgtactcaacagaaacaaatcggttgctatgttcaacagacagtaacaggttgtagatcatttcgtacacagactttcgtagttccagtccattgtcaattttatgcttgaatggtccaatttgaattaccttgatgtattccctcttgggtaataattccttgtcgattatgttccccaaaacctttgcaacaatttgtaatgctatgaatggggcactatgtaatgcagaaaccagaagattcacggatatctgtttcaaatgcaagttgttattgaacaccattaacgaacagcggccaagcaagtctcggaataaccccgaatggatcttgatcaataattcatcactgtaaaattgctttatcaaagttgctgtagtgtacttggtatgaataagttcactcattgccagtttgtcggccagagtcatcaatctttcatgatatgtgtgaccaatgttgaacagtacctttgaggctatggtgcaggtattctcttcaaactcggagtcatcctcaatattggcaagtaactggaatacagtatcccaaatgtcattagcatgctttttgtcaacagattctgaaacaattaccaaagattcaagatagagaggcctgagttttgaatctaccttcagcagttgctccaacacgactggcaaatattcatttatgtggtacttcaccaaaactcccaaagcttcagttgcactttgtctgattgccacatcttcattgtcaagttgttgcaagaaaacctcaaggggaaccttgaacttttgacctctgttgcgaataatttgggtaaggaactgaacagaatatagtaaatctaactgtgagttcaaattttccaagttttggttaatcaatgagtcatcatcagaaatatagcaagacactgtggcaattattctagctccatgtttactctccttcccaaccttcgaattgagatgctggaaaaactcccgggtattgaatattttctcggttgtatcttttgttaatctcacaattaacactgggtcaatgaggtcggaatcagaatattgaataatgatttccgaaagggtttgtgcgatatcggaatcaatatcagtgttttcaagcaaatgcgtgatgatatctaccaagttggcgtgctgcttcttggagaagttgctgtattcagttttgctgactcttctcagactgttgattatattcagctttgtatcctgagagagctcaattgttttactttttgaaaactgcagcagtgtggtcaaaactgcagacctaaattcacttcgtgtgattaagttcaaaactggttctgctagttgttgacccaagatgggagaaaaggagtcgttggcatatgattgttcaactgccttcccaatattaaagatacagcacatcgacaaggattcaaaatgtaagcattccgagtagactttcacaatttttaaaaaatgatcctcagatactttaactatgacaatgtaattggtcaagaccatcaaagaacgttggcggatttcactagacagattcttagtcaatgccttggagcaaataagttcttctaactcctccaaagatacattactaggagtcacttggacatatgcctgtaaaaatgcatcgaaggcgttcaggccctccaaagtggaatcatgactcgaaattgcaaactggatattagtcaaaatctttggtaagtaatcttcaaaatcagtcaacctgttattctttaaaagagatgcgtaaaagttcagcaagtcaaggttaattgtattattcaaatcggttagcacttcaagtttgccaagaattggacctacctgagcccccaatccatcagtgacatcaaacaaagagctgaaaaatttcaagaacaagttggtttccgacctatgcttcggagttagaatggcactaattctatcactcaattttggaagtgctttcgttaacagcaggagtggggattcagcttcctgagagtcagaatcagttggccggtagttgtcaatgttgtaatattgactgtccaacgaagtgaactcaataattgttgttaaagtaatcaaacattcatcaacaacggaatcaatagagtcatccagctgatttataagggaatcaaatacaacttggtaaatcgtcaaaagagttgaaggttgatgttttaagatggttcttattagtctagccgaatcccttctcaatttccaagaaatatcatcggtatcatcgtcagattgatttaattcttcatcatcatctgaaaagtcagcataatcatcagcatcaacgtcattgtccatttggtaatcatcatcatcctcaatagccaatgggttgtatgataaaaataaacggcaataattgataatttcagagatgtgaagactgatttgttcatatgtagtattggaaacaacgactgaaagagcaactaatgcctctgatcgaacttgatccgtagaaatctgcttgtcataatcgtcatcaactttgctcaacttatctatttgtagctccgagatgataacctctacgattcgattgatgaatgggtgcaatttcaaggaatcaactttgaaaaaaccagataatagcgcaagtctagtggattgagagggcaaatctgcatatgaagttgatttcgaattctgagattggaatgcctcctcaattccctctaatacctgttcgacttgactagtgttcagcaccttaattaaggaacacagagctaccactgccttcctggcaattaatgtgtcattttggaaacaaacgtcaatcaacaatcgccaagtcttatctttctctgaatcgtccatggcaattcctaaatatctgattaaatcagagatgatttcaatatagtcaatctttgagataacttctttgtaattcaggtacccaggaagcaatttggaaacaattgtatgcgcagtcttctgatcaacaaccaagttttctaaaacgttgtgcattgccatggtgtaaacggtggacgtgatagtggtctttttcggtttaacatccaaactcaaaaccaattgaatggcattctcgctactcaaggttggcattagtggtttaaaacatttgacagcctggttcttgatctctgactgaacatctttcagagccttaattaacaccgtgatcaactggctagataaacgtggagaattcgtgaaaaccgacggagtttctgagataatcttgtatagatcgcttagagccataaaccgtagatcttgatccagttcattcgttttttgaaagagattgtttatctgagaatcagagacactagcagacatgatctttgaggggtgttcaaaggagagaatagtagatgcagataaacttcgagggtggtaggtcagatgatcaagggtgaacagatcaaaggttcagtgatgaaacatggggcctttaaagatttgtaggttaaggagagacagaccaaatgataattagttgcaaggttatactgtgtgtagtacagatggaattttggagaatatttcagcctacaagtggttacaggtaacatggtgctagtctattagtgagtgttgaatgtgttataaaggtgaagtcgttcaggtagattttcgttctttcttttctttcttcttctccttcttctccttcttctccttcttctccttctctctctctctctctctctctctctctctctctctctctcttcttcttcttctctctcttcttttctttcttctccttcttctccttcttttcggtttcctcatcctgcttatcttcattagtagcctcggattcctctgcgtccttttcatctttgtccaaatagtcagtatcgtcaataaactcggttacttcgaccttctccacaattaaattgctcaaaccttcatccctaacatcctctgcatcttccctgtcttttgatttatgtttatgatctatttcctctactttttcatcattttcctgtttttcttcctctactaaatcttttcttccccctccttctcttcctccttctcttcctccatttcgacgtttttcacgtatatcttctctccagtaagaacattaaacaatctgctggctctgatcacataatcatactcaggagccttgatctcttcctttgtctccttctcttcatcttctccttccttttcctctgcctcttccttggtctgtccgttctttacgttttcctcaagttgctttatcagcttctgctctgcttgctcacagaacgcattccatcgttctacaaccgttttgaactctccaaccaaacggtctcgagattgcccctgcattccctccaggtaactacttagagctgcctcatactcggaaggaataacagaaaggtgtctcaacacccagttctgtttctgcttggaaaatttccaattatctctatcctcatgaaactgtctaagataagcaagctgatctttttctggtgggggtggcctttctgatttgggtaacttctttctctttggagccttcttactcccctcaggctcacttttgacaggctctcgtgtgcgtttctttgtggtttttatagctccttctaaatgttccacactaaaggggtcattcaaaatctcattttggaccttgaggccaattttcttccacgctggggtctttgggggcatgagtttatgagctgtgaaatcttttgccctctaccaaaattatttattttattttgttttactttattttccatccgcgaaatctttcttgatgaaaaaaaattccatccaagagcttacctgtgatatttactgtcttcttcccaagccgaagccattaggaaaagtcagacagacgtcgagctcttctcagtggaggacaataccagtttgctaatgtggtagtggagcctcttttggtaaccattgccatttttgtttggggtagaacatcctattgtctacctgtctaagacattagccagattaaagtacactaagtttgagtccgtcttgtggattactcctcaaccctagatggatatggaaagatgtacacattctattataacctgaactttttattatcctacctaaagtgagacggagactaatcgcttgtatccgtcaacactatcctgcaggtctgaaaccttgaccatttcatcaggcccatgagccaccatgatgcttcctggtccgtacaaatatctggtcaaattggagcccgtcactaggaatggtacatcggtactgtaggctgcaatgtagttctcgaacccttcaaccttgtaatccaagaaagtagcatcttctttggagtgaaaggtaatgtctgtatactcctcgaagggggcaatggcctcgtagatcagcttctctacagcgtcaatgtctttagccacgcggattaaaaccttggcatgtgcttccgaagaaataacattagcagctactcctccgttgatctgtcccgcgttgactgtggagtttcccagcaaatcactgacaggccaagaagtctcaaaaagcaacttgtgcaaaatctggaccaacatagcgtcggcatcaattcccagctcagggtatccagaatgacaggattttcctgtaatcttcaggtcaaacagtgcaattcccttgtgtccaatggcaagcttgttctcggtaggttctccaaaaatggcagtgtcccatttagcacccaaggtcttgctagctgtgcgcattccatcacctccaatctcttcaccaacgacgtacaaaagactgacatcaccttctttgatggagccctcttccaagagatttaggaaggcaatcacttgtgccgcaactgatcccttagcatcacagcttcctctgccaaagatatagccaccttcctcaactttgtagggaagataagggggaactgtgtctaagtgagaagttagcacaaccttagtgttgcgggtggttcccaaataagcatacaaattgtaacgttcagtttcgtcctcgaccttgttcaactccacagtaagacccctactggctagataatcggccaaccacgatactacttcttgttcatagcccgaaagagatttgatgctgaccaaatgcttatgtagcccaacgagatctacatcaggacctttactgattgaagggtcggcaaaaagatgctggaccatgtggtcagacacccatggtatcgacaacgccagtgaactcaaaacgagtgaaaatgtgaagacaatcgagtgaaatttcattttgggcaagtggtttgagaaggtccagtgttccgaattcgaacctgataactagctgatagcgaatttctttatcagacaaatggaatgccagctgaaaatatcaattaacagagtcacaggtgagaaagaaaaagagatacgggtggtatttaaataaacacagactaagcagataagttaacaatgggtcaattaatgcgggccgaaaagcttatcaaaaaaatgcttaatcgtacggaattacaaggtgttatactagattgggatgaaaccattacagatagagattcgttggatctgatattccgaatagcgttcagagttaaacccgaattcccgtacaaattgaaccatttcgttgggatctacaaggataggtttagggactatgtcgaccatgaggtgaaagggtctgaatgtgaggcgagagacaccgtcaagaaggagatccagtaccaacggggaatgaaacctgtggaactctccagtgtttatgaggcaaggaggttagggttgttcaaagggataagcagggagaaatttgtaaattatgaacagacattgggtcagaattcagatcagcttttacctttgaagccaggggtggttgaatttctgaaaatgctatacaggaaggtcccaattacgatactaagcgtcaattggacttcactcatgatgaagcaacggttgaaagagtttggttttgaagaagacaaagagtggttgcattttctagttaacgagttggttttcgacgaacatggtatgtccaccgggaataacactggagaagaggaggatattcgaacgggatacgataaaatgatgaaaactcgtcaaattgtcaaagattgcccaaatgggaaacatttcgtatactttggagatagttccactgatgttttagccatgatagagactggcaaagctgtagcgcttggcactggggcaagagatcaattgaaaaggatgggtttcaaggttgaaggtccagaggaagaaaaaaacatgcacgatctgtccgaagaagcagcgtacatttttgccaaagatttcactatagtggcgtcataagatgcatgcaacttgtgtgattcatgtaatcagaacattagagcggactcagctttttactaaatctgcaaccgcatctagcctatttcactcactcggaggtccttaattttaggcccttttgcatactttatattttcgtcaaaaagcatcttgaacattataacgaggggccagttgtccatgaaaagatccaaaaatgcgttgtttgaatcaccgcaggttggttgtgcttgaaaaagaaacggaaattgaccagcaatttttgttactatgaaaagcacaacctccagcggtaattgtgtggtttctaagacatcacattcctcacacagatgcagcacaattgcatttaagcgggtcttgactcgtgagcaattatggacttgtagggtctaaaaagaaagaaaaaaaattggtcttttacttacttgcagccgatggaacacaaaatcgtgtttttcgtctgatggtgttagacctaatagaagtttgaagttgtagtactcatttcttctcagccaatcagagaattgattgtctacaatatccccaccaagaatgagtcttaccaaatttctttcactgtcgatgccaaagaactcctccaagtcaacaccacacattgttgaaagtgggagcataatctgcgaagaatgctatttgtgatatgtagtctatgcgtgacgggctgcaacagaaaagccaagatctaccacatgtgcaattttcagtgctgcagaacgcacatgaaataatctggaatagtaattgccggaagtgtgtaccggatgcaatttcactcatgttccacccatcctcttgctttgcagcaggtcgcctacaagatgtcggatggaactttgccagtatataaaactgtgttaatagaataaataaagcctcaataaataagatgctagagtgctcaatacactcggtaaaagtacatatgtgccgtgcaaaaagtgaacgtgcaagactaaaacagactatttgcttggatcgttcttttggtaacccaaaaatccctggattctgtggtcagggagcatgttcaagtatttctccgcaatttctctgcaatcttcgtagtggttgggtcctgaagttttgtaacatgattccaaggcctttctgcacacctttaaagctgacactcttatccattgctccctaaggagagattcttgcgcgttatgcagatcctgagagttgttgtagtcaatgtcatcaaacgagacgtttggggatcttacgtggtctagaagatatgttaatcggtctgaacttttcattctcgtctccttccacgcaattttacttaccaaccatcctgaattttctattttcctggggagcttgtgacaatcttttcagagtcttctcactggctgaaaagacttttgctggagagacccaggccaaaattcgcggttattgggtggattttggtgatctatcgaattacccggattactggcattccctttctgcactttactatgaacagtgtgaggaacacagaatatattgatcttttgtggttggtacacgtatatccgaagttgattgagccgagcagaacaatcaagccgaaatgttaagcctgaaattctccttgcaagtgaacgcagactttaagtttttagtaaagcttatctttagtttgttgcgagtaaggtacatatcatgaatctggactccaagcaccaaaatcagcagcaacatgttttgaaattgaatggagtttgggtcgcctatgcccacactttctgtgccttagctgcattcttatcagctttgattgttggtgtgacgcttcattaccacaagatcgtccagaatggatactatggatatcctgatgagtggtttcccagtgtatctgctacaattggtgacagatatcccgaacgatccatttttcaaatcatgatagccttaacagcaggccccagatttttacttttgttcctttcgtatctgaggctgaacaagactggctcttatttgccactaataggtcttgtttcaggaatcttgagaacttttacttgcggcggatgggtttacattacttctaccgatgaccatgatgcacatgacatttttatgatcagttatatcgtgctgaccattccatggactgtttgtgttaccaaattgaccgataaatcaaacaagtttttgaagaacgggaggaggttcacagctgtggcttttttcggcctgttggttcctctggtctatctctttatccagcataaggttcacagagttgctggagcatactcctactatgcttacgtggaatggtccttgatcttcctggacgttggatttgatacttggtcagtcgttgactttgaagatttggaattcgaactttcagcagctgagaatgccccaccaactgtgcttaatctgagttatttttcccaagatgagacaagttccacagatgagaaggaagcggtcaaagaaaaattagtcccgggacagtatcccgtcgattctctggtagggctcacatttattcattcaattgtccagattataaattcctttattttttggtcagttttcaccgctttattcttatgcatttggcactttcctttgtggaatatgggaatatcaggctacgaggctgctgctttatccttgatggctcccatcctacttgtggtgccacctttacggaatctttttgcaagattcccacaaatacccagactattaaccgctttattcggggttggctcttataagtttgaagctcctgcggacagattactaattctttcggtcggaacatgcttcggatttatttctctctccaatgagatatggaccttgggccaaattagagattctttggcgttaagttggtactcgacgacgttcacgcttggtttgattacttcctccattgccaagttcgccttttacacgaataatcctatatggcctatcatgcatactgataacggtggattgaacatttatggagtgattataggtgttgtatctgccttgttgactccttcatatctgactcaattgaaccccactgaaatctcttctggagtctctaaaggttatctgtttcctgcagcggtcggagttggaggtctaattttttctctagacgccatgctaactgatacatctactctcatcttatggtgctgggagggctatccggtcaggggtcctttgccagttcctcatggtgtcttcacctttgtcgcaatggcaattggtacttaccttggttttaccaaaccctcgctggtaagttcatcttcctttttcatcgcaggatctgctggggctgcagtgctctatgcttccagcggatggataggatatatcggaggattggtctattcaattttcctaactggaattgtccctgttatatttgcgtcagccagtcagttcaacgtgggacttgtatttggactaggttttttccttgccattttgatcagtttggcacatgtatgggtagttgcctatgcttttgttccagctggatggatattgcgtgaacgtacagacattgtgttaggaatatctgttgctatggtaggattgggtattgttgctggaaaaaaagccaatcttatcgtaagggcaaagaatcacggtgtgggtacaagtcttcgtaagagattgactaagattgcaggtgtattgttggttttatcggctgttatttcatttagaaggttgaatttcgaaaagccacaaccttaccaccctgaggacaaactgcttactgcgggtatatggactatccattttggactagacaatgacatgtgggctagcgaaggtcgcatgagagacttgattggagaattggagctagacgtggttggattgttggaaagcgatacccagagaataatcatgggaaacagagatttgacccagaagttagctgaagagcttggaatgtatgccgattttggtcccggtcctaataaacatacatggggttgtgctcttctttcaaagttccctatcctgaattctacacatcatctcctcccatcacccgtgggagaacttgcaccagcaatccatgcaacgttgaatgtttatggagaactggtagatgtggtggtatttcatagtggacaagaagaagacgtggaggatcgaagattgcagagtctgggagttgcagatataatgggctcgacagatagacccatggtgttactgagttacttggtgaccaagccgctgaaaggtaattaccacacgtatgtgagcgaaactagtggaatgcacgatatcgattcttctgattcggatagatggtgcgagtacatcttgtacaaaaacttgagacggacagggtacgccagggtgagtcgatcgacgataacggacacagagttgcaagttggaaaattccaactcctagatgaaggagagaaggtaaactactcggaaaaacgaatcagggaaagcaaggtccccaaagggctgcaattccctcgtcagtttagaaaaaatggtgtacgaggccaccgataccatgtatttgacgaacctcggtactatgatagttagaagagaataattaatacattcatgtgagtttttctttctcagcaatagaacaatgataaatcattaatttttcggaccaaacggctgcacaacaatctgcaccgttccaaattagtagcaacgttctagctcctggggggacttttgggggattttgagtctttttcgtcggaaatgtgtcgtgaagtaggagcagttggtgggaagaaagggtcaaattttatcgttgcggtggaagccaaaggattagggcctaatgtgggattacgaggaagttgaggggaaccataggggaatgctggcagaacttgatggggagcatatgacggataagaagaaggaaaggaggaaggagcaattgacactggggggatttgtgcatactgaatttgtggttgttgatgttgactgggttgctgaatcaggtgctgctgttgctgatgatgataatgtggtggttggcgattttgatgcggagcttgagcttggggttgggtgggtgactggtgcacttgactttgagtctgattaggaggccgctggtgctggaactcggattggtgatgaacgtaatgctgagggtgggaatgctgtgcgtgagtgtggtgttcctggtgaggtaagcttgctgctgccaactgttgcgaaattttggcgttctcctgtttcaaggtagtcagttcgtactctaacatttctatgtattcagcactttttttcaagatcaacgctttggagtcgtgatcaggcttcaccgatggaacacatcttttcagccgttgaaaaccatctgtaatcttctcacgtcgacgctgctctgaacggatgtgtagttttctccgtaggggggagcttgatcgagtactttctgtagaggcctctggtatctgtgacgactggctaccatcacctactgggaatttttcctgcacagaagagtttttagacatacctggaacgtggtaatgttgttttttcttcagtttgtatgcactcctgttcctatgtagtctcctgttggtcaaacggaggtggttgatgggcttctctgagtctgttgcttggatctgtgttgatttttcaacaactcgtcatcgaatagttgcgggaacagaacgacgaaacgttctctgtcccagaacttattacaattttgaaaaatgaaaaggaaaaagaatgacaaaactgtgtccatggttaccatggctggcgaaatgacccaacatagtgcctacatcaagacgcaactatcacaacaataatcactaaccacgaaacttaatcagccaaagagaaaagcataccactctgggcccacaaaaagaaacaacattacaattcaccgcaggtacgtcgaactcacaataacgaaaacaccgaggaaaaaattaatcatgttaaatttgttccatgcagatctgtcaggtaggtatggataccagcctattgcgagctctacagacccgctaaatcttgtcagtgatcaagactcaacctcggccgctgtaaaacttctagattttagcgcaaaagagggaaaaaaaaaaaggagagcaaattaatgcggcaaatgcaccgatgaccagatttgatgcaccaaatgtacaccgcgacgcaattaaatctgcaactattcctagcaaaaacaataacttattcaattgcagggctgtaaggattgtcctcgaggcgctactaaaactgtgactgcctgcatgctagtcaccagccctacccacgagccgagtaataaccgtgggcaacatgaagtaaataaccgaaactcaacagaaacggctgtcaaagcttataaccagcgggtttagacctccttcgcaggagggtccaatagggaagggttgattcaagatcaaaagtagtgtatttgtcatcaattttgaagataagcacattagagagacgcatatgtagcagtaattcgatgaaacaaagctattgaggcggtgctcaaagcccgcttcaatagaacgttctcgacgtactgcctttctagagttgaagaacaacgtcaaagaatgaaaaaaaaaaggttattctcaatttttttccttaacgttttcaagggcacgttctcaaaaatactggttagcttcggcaacctgtcttgggcagtgacgggttggagcaagcatgcaaaagagcgcgttagaagccagaaaaaagttctttcggcgaaaaaaattcagcgcagccagatcggaacggcacttccaggagctgggtctcattaattcgatcccaatgaacgcactttcatccagagattctccgtccaactttgacagaggtattgaatagtcattttctattcccgattaccctattggtgttcgcgcttctctctaaggtgacgcaataagaatgtggatcgacgatagcatcaggaaagatcgacatccacgattcttgaaaaatatactgagggagaaaataaagttcacacgtacaatcctagcgcaccccttaaggtccctctagcccgtgtcctctcgaaacgttactccggagtccttacaataccaagtaattgggggtgtgacctaaacgtctcctagaatccggggcaacaccctagaggctcatttcaaaatgagatccactaacgcggtatcttagcccgtaatccacaatagccctggtacctgactcggtgtgcgtctgctattttaccacccaagttactaccgccaaccacagtctttcaagttcaaatcggacccgtttttttgtgaggcactttgacgggggtgtcgagattgttttcaatcgcgaaaccgtgaccttccaccctcgcgaaaggagctcgcttccgagaagttcatgacgatttcaccatcaaaaggcacacattaaacaatagtccaaaaacaccgcttatcgatctcggaatggtttcggatcttcagcatcgtttaaaaaactgccaacctacccaattgcgagctcaatggaccttttccgtgtattccggtggttatttaccaacattccaatatcgatgatactcgccaaattggaatctttgtgtgtggcgcacgtctttcaccccagcttttccatacaaggcagttcgaatatccctccggcggtgcaacgggcagtcgttgcatcctcgttctcaaatatctccatatcctaattcatgccctataattcatatatatagggctctttcgtcatcttttgtcgaattctctttttttcctctcccccttcttttaattatcagtaatcctcctcgggttttttttaaaagtattgtcaaacatgtccgctattagatcaattgcccagcgtacgttgcgtacccaggcccaaatttccagagtttccttcctgggagccagagcttactctacaaaagagcccactttgaaggagcgttttgctgagcttctgcctgagaagattgagcagatcaagcagctcaaggccgagcacggcaagactgtcatcggcgaggttctgcttgagcaggcctacggtggtatgagaggtattaagggcctcgtgtgggagggatccgttttggacccaattgagggaatccgtttcagaggaagaactattccagacattcaaaaggagctgccaaaggctccaggtggaaacgagccattgccagaggctcttttctggctgttgttgaccggtgaggtcccaactgagtcccaaaccaaggctttctctgaggagttggctgctcgttccgctcttccaaagcacgttgaggagttgatcgaccgttccccagctactttgcacccaatggctcaattttctatcgccgttactgctttagaatctgagtcacaattcgccaaggcttacgccaagggtgttaacaagaaggagtactgggtgtacacctacgaagactccattgacttgatcgccaagttgccaaacatcgctgccagaatctacaagaacgtcttcaaagacggaaaggttggatctgttgacccatccaaggactactctgccaacttggcctctttgctaggtttcggtgagaacgccgagttcgttgagctgatgagattatacctgtctatccactccgatcacgaaggtggtaacgtctctgcccacaccactcacttggttggatctgctctttcttccccattcttatccttcgccgctggtttgaacggtttagctggtcctctgcacggcagagccaaccaggaggtcttggaatggttattccaaatcaagaaggagttgggcggtgacttctccaaggaaaagattgaaaagtacttgtgggacactcttaaggctggccgtgtcgttccaggttacggacatgctgttctgagaaagactgacccacgttacactgctcaacgtgagtttgctctcaagcacttgccagactttgacttgttcaagttggtttctgctgtttatgaggttgctccagttgtcttgaccgagcacggtaagaccaagaacccatggccaaatgtggactctcattccggtgttttgttgcaatactacggtctgactgaggagtcattctacaccgttttgttcggtgtttccagagctttaggtgttctgcctcagttgatcattgaccgtggtgtcggtgctccaattgagcgccccaagtccttctctactgagaagtacattgagctggttaagggtcttggtaaataaatgtgacgactgggtgatccgggttagtgagttgttctcccatctgtatatttttcatttacgatgaatacgaaatgagtattaagaaatcaggcgtagcaatatgggcagtgttcagtcctgtcatagatggcaagcactggcacatccttaataggttagagaaaatcattgaatcatttgggtggtgaaaaaaaattgatgtaaacaagccacccacgctgggagtcgaacccagaatcttttgattagaagtcaaacgcgttaaccattacgctacgcaggcatgtttcacgtccatttttgattgctttctatcataatctaaagatgtgaactcaattagttgcaatttgaccaattcttccattacaagtcgtgcttcctccgttgatgcaacactgaacacatcttcacctattacgcgaccggtttatagcggtgttcacgctcaaaacagtaatcgttcattctgcatgttctatgggattttgaggccgggtaacgcttcatgaaattcccctgcagttcatggaacaatcgaaatgatctccgttaatatttcaaagagcaatagtctaagagcaaataacttaccattatctaattgcttccgtctcgttttccccttcaacactaattgaccggctttgatgagttcagtaagtaaatcacgtcgtctgcacagtgtatatgagcagattaagaatctggtttcactcgatagggaagcaagctactaactatctccaggatttgaaaaagaagaaaactccctcgacgccctctgatgagctcaaccagaggcttggattgagccatttagatagtgaggctaagatgaaagcagccaggcaagatgctcgcaggcaaatggttaaggattttccttgggaaagaataggttgcttcagggaccctagctcagaagactctagtaccttttctgcccgtgatcttcagaaggagaacagattcattgaacattttgtaatcgacaggtactactctgactggtattggaatacatcgttaatgataggcacatgtctttgggcttacttcgttgccagaattggattgggtctatggtctcttatcctagttgtattttatgctatccaagtttatcgtctggaggtgtccagattcaacaggaatattcatgacgatatgaatagagttcagtctgtgcagcttctagagaacggaactgaaaccatgcaatggcttaactccttcttagccaagttctggatcatttatatgcctgtcctatcggagcaagtgaaaaaggcggccaacgacgtcttgaaagatgccgcccctggatttggtatcaacgctctgagtttggatcaatttaccttgggttcaaaatctcctacaatcaactctgtcaaatcttatccaaagctaggtaaagacgtttaccaaatggactgggatttctcgtttgctcccaatgatacggatgacatgaccaaaaatgaaatcaaaaagaagatcgatcctaaggtcgctttgggtgtgagagttggaaaggcttttgtctccaagaatttgccaatccttgtggagaacatgcagttcgtaggaaagatgagagtcacaatcaaaatcggtgatcattttcctaatatcaagctggtctcagtgagtttcttggaaccacctgaaattgcgtactcccttaaacctgttggaggcgataccttcggattggacatcatgtctttaattccaggcttatcttcatttgttaacactttgattcattctaacttaagaccaatgctatatgcgccaaactctctcgatattgatgttgagcaactgttagaagagcaagtgcaggacactatcggtgttcttgccgtgactataaacagagcagatgaccttaaatccacaaaagactgtgatccattcgtatcgctatttacggagaaacaagagtatgaaaagttcaccacagacatcaagaccaacaccacttctccttattggaaagaaacgaagtatattttagtcacatctttgatgcaaaaactatatttcgaggtttaccaccacgactctaacaaagggcccaaacttatcggatctacgagttattccttggacaacgttgttcaacaggaagtcattctcggtcaaacatcaaaactgaaaatgggaggcaaaacaagaggctctctaagttatgatatccgttggttccctgttttagaaggtgaagagttagccgatggttccaaagaagaacctcctgatacagaatctggtgtccttaaattactgttgcaaggtgccaccgatttgagtctcgtgtcatccgtgactggtaaattatctgcgtattctgagctgtatttgaatggggagcttgttaccaagactcgtatcatacaaaatacaattgagccaaattgggaagaatctttggagaagtttatatttgccaagtcaaagtccagagtcgagttaattgtgaggaccaaatctggtcttgttgaagaccctgtagtgggaagtttcaagggaaatcttgatgagctaattgctactagtctggatgactctgccactatcaagctgaaacctcagggtgagtataaactaactgcccagtggaaaggtttagcactcagtggtgctgatgccagtactaacttcgttcctccatttggagttgcgagactgcacataagaaatgctgatgatgttttaaataccaagactgttggaaaggtagatccttacgttagggttatggtcaatggtagattgaaatatagaaccactgtccgtgaaactacaactactccggtttgggaggaatgcatgtacttcccagtgacctcaatgaaccaggtgttctctcttgatgttatggatgctgaaaagagaagtaaagacaagctgcttgggtctgccaaagtgcaattgagttcttttgtaaaaaagtccgacgatggaaaattcatggcttatgatggtgctaaaaaggttttgtctcaacctttagaaatcaaaaagtcaaagaagaagaaaggaaccatatactactcaatgtctttcatcccaatgctaccagtttatacaaatactgaactggaggaacttgagaggacaaaggaggaaagaaaagaaaaggaattacaggagcaaaaaaaactagagcaaatggaagagctattcaagaagaatcctaagaagtatgaatgggtggaagttgatgacgatctcgacgaaattccaaagcaaaagctatcgctggaacaattactagagtacaattctggttccatgggtgtacagatcaaaaagggaaaattcaccaaaccggatgtgtatgttcaacttttgtttgatgagctagctttcccctcttacatttctgctcgttcacaaggacgatccattacgtctccggatgtggctcaagttttcgtacgtgaccttgagaattcacaaactatcattcgtatctctaaacgtgctattgcaaaggagcaagatgacataattggagagcaatcttttgcaactcgggatcttcttcagagaggttatggtaaagatattgacttaacttttgctggccagaaattgcaggtcgaattggactttcttccattgtcagtggaactaccacagtcagaacttatggcagactctggtttccttacccttgaaatacttgatgcagctaatttattgtctgcagatagtaacggcaaatctgatccaatggccaaggttctattagacggacaagagatatactgcactgacaagatcaagagaactttggaccctacatgggatgaatcaacaagattctacgttccatctagatcgagatccaaggttacaatcgcagtttatgactgggattttgccggtgataatgatttcttgggtgaaaagaatctcccgttagaaaacctcgctgtggatgagactcaagaatttaaagtcgaattggatactcaaggttctgttcggttaagaggaacattccaccccgaatatgtcagaccaccaattgagattatgggacagagtggaattgagaaggtcgctacagctccagtcaaggttattggtggcgcagctaacattattggtggcactgttggagttgtaggtggtggcgttttcaagggtgttaagaacgtcttagtgccctccaagaaaaagcaagagaagcacgacgaaacagcggacttgacctctttgagatctgtcaaatccggagcaagttcaacattctccagaaatagtcaccaccctaaggacactttcattccacttggcgctcctcccctaccaagagccagtagagctcagaacactgatagttctgccacctctaatttgggatctgatgtccaaagcttaagaaatgggggtaggactccagttcagaatggatcacctgttaaagtgatacaatccagaccgagatcgatcgtctcttctgaacaagcaagcgtctctggagcttctaaacagaatgtatccaagggatctgttgagattgtctcattatctggcatggatgcgaaaaactctttattagtcagagtcttggtcacatcaccttccagaagaaaggaggtactgcgcactgcctcccacaaaacaaaagatggaaacatcatctggaatgaaggcaccacgtttaatgcagctgctgactcatcgttgacttttgaaatcaaagctagtcacacttttagtaagaatattacacttgctacaggttcactagaacttagtgatgttatcgagaagactaatgaggatgagattaaagttagtttaacttctggcggagaattggtcgtaaaggttgattactccgatcaatatcccaaggaagatagttagtgtatgtaaacttattggatagtatgattgtttggtgtcttgattgtcttctgacttgtggtattgatgatgaacacactgaaaaagtagagcgaagcagaaaaaaaaaactgaattgagcccacgctgggactcgaacccagaatcttttgattcgaagtcaaacgcgttaaccattacgctacgcgggctccagatagtttgagtagtttattgttccacatgtccaaggagaatcagtaactctactgacacagagatccgctactaataagctatctcaactcaatatggaatcatacaataccttgatttcataatcatgactacgttactacatcatgtgttctttgaagaaaattaatattagtggatggattatctcatgccaaatctatttattctgtaaagacttcattctagcttcggcagccctcgccctctgctctctcattaaccttagtttttgatcgtctgataaggaacttaagtttgtttgttgagtaaccgtattgaactgctgtaacttagtccccgaaccatacctttcttggtactggttctcaaacttttgcctggtttctgccaatttctcttcaattatcatcctttttctttcatcttcagccttggaaacctcggcatcttcttgatcaaattcgtctttagattttggaggtccaacatttgccttctcccaatcccaagcagattcaccaagagtctttcttgcaacttggaaggctcttctgatttgtgtactagctgaaatctcacagggtgttcgccctgtcgaattggtaatcgttggatcagccttgaggttaactagaagcacttggcaaatatggggtgatccatgtgctgctgcataatgaagtggagttgaaacactagagaatttttgttctggcttcagtgtaaaatccgtagccaatttgttcttcctgaagtatgctatcagagctggagctctggacttttctataagagacacaatttcagccgtatgtatttcttctgggtctagctttgagtctttttgagagtctttcctaccaccggatctggacttggtgatattttcttgctgtttaagaagtttctgctttaacttttcatcactctttggcgtatccaagattgttaaatgagtcagctgaacccaagcttttttaagcgcggaggaagtagctctttttgtagtgaaggggaaggatttgactctaggatcattgttctgtaacggcgcagattcatatcccaccaggatgtttctattagaggatccattggctctaatgaatacagactgacaatctttcaaataatgggcccagttacccaacagttctctaacgtctttctgcaactcagcttcattatagcgtctcaaagaggctccagcagagttggcctttcccttaccattgtcactggcactttgagaaccaccttgtttacgtcttgtcgtatacctatggaatgttttatgctcaacaagctccaccgattgctccaaaagttgatcttcagagcctttgttccccttgacattcctacgtttgtgggagataatggcaccggcaaaatgacctccaccgatcatgaacagcgctgaaatgtgactatctttatccttctgagagttcaaatcctgtaacaatttccgtggatctttggaattatctagatcagtaaatatcgttttgtagataccaaaacatttttcagctggaagtaagtctgaggagaagcatatatatggtgactttgtattcaaaaaactcacgtcgttcaaagaaagatcaccatagtcttcagttattgtctccaaacgtgacttctcggaggcaaattcgtctttacccaaatcatcctctgagtcgtagtctgatccagatatcgatacattatcgtcatcttgaactaaacgttcaaattcctcctcattcacaatgggaaggtttgccgcctgtctcttcagattgagtctatgcaaatcactttgaacatgggatctaaactgttctgagtcgttcttattcagttctttttgacaaactcgacaaatattggagtctaccttcggttcatttgattgcagttctttggcctctggagctttcgaaatcgttgaaaaagagtcgaagtacaatactttgattgaatcgaggatcttcactggtaaatcatacacgtagagctcatgtttcttgaacattgatagaatggtggatctagatagagttgcgcagcgcaccaaataaattatgtcttacttaccctcgaatgtgttaagtctactctctacttggctttggccctaaagaacccatccagtgctcccttgccaacggctactttctttactttgggtttaggagctgcaagcgtcttttgattcttgcgtttaccaaaataggagctggaattgccaatgctttcgttcaatttcgcaaggttctcttcggctatctgcctttcttgaaaagctttctccacaagtagttgatgattagataatgtctcccaatccttttcaaattgtcccaaaaggcaatttcctaggctttgaggtaagtatgtcgatatgagttgaactgctgctcttttggttgcaaggtcgaggatctctaggggaacttcctcctctttggtagagccttgatcgattggtttgctcaacttcgaagagaggaactgtttaactgtgttttcggtttctagtagattcttctgcagtgcttccacctttcggttcaagaactgaaaaatagctgctggcgacactctataataattctcgtcgccttctcttatgaccttgcaaatctcacttagacttggttcaagactgccgaaaaattcctctggcagaccttggaagaccgaattctcctgcagttgttctattaagtcgtcaaaatttaagaatctcccgctttgattgctctcgtccagttcattaatgttcataccccgcagctctgtcattatgaagtatttcaacagcagatagataacattgaactttgtagccactaatatttcactgttttccacgacatacccgtcaatggactctttttcggcaaatattaacgatcttatcatgaatcccctatggtcgtatacagctctgtgtttcttcgaatgaggattatcgtgttccccattgaacctttttagttcgtatagttgattattttgctcatcgtaaaggtaatcacaccgttcgttcaatctaggatgatctagctgtacaaacttcaatttctccgaggagtcttggttgacgaacagaactttgaacgttttaacaggttggttctcaatagttgggtaggtcattacgtgttaaggcagacgcgatcgtaaatttcagatgttggaagggatcgctcagaagttgaagtgggtcatatttttaaactagattcgatgaactaagtaaagaatagaagattcaaatctgtggagctttatctttgttactactaagatcaaaggcatctgttctgcatactggtaaactgcggtgtaataatttagccttgacaatttgaaaaccgatgagacagaattcgactacttcactgggtcctgtggataattagtagatactcaaacccctgccttatcaaacttggggccgatggacagttttcagtcaccctttcatgatcctactagaacttttcatgctcattccagcctccatatttttgggcgtgtggcgtagttggtagcgcgctcccttagcatgggagaggtcttgggttcgattcccaactcgtccatcagtttttgttaattcatttcattttttattgctacttgctaaatggtaatattatcgactacttacgaatccagttgcttacagaagaaaggccatcttgagccttgtcattagcaacatctagtccctcttttgtcttctggactacgaaatcactgttgtctttggcgctcttggcgacagagcttgtaaactggtcaagttgtttggaggcatcatcaaaggatttctgggcctcagccaactttctggaagccagattgtgggcttcttcgttttgatccttaccccatgagaaccaggctttcttagtacggttgaactcatcttgagcttctttcagcttttgctgagataaatcgtaccctctctgcagggtgcttctagtctcagcagcatttctcttagattctaggtactcctctctagcaaaagcctcggccgattcaccccagcctctcagcgattcaaatgcttttccgtctagctcttcctcagacaagtgggcatacttcttacgaagctcctccttcttggagttgaactcctgtctgaacttgtctaacttggagcgagcctcagaggaaaagctcttagtctgctcctttgcttgggagaccaaatcatcagtcttttctttagcatcgttcaatttggattgccattgagacttccaggtctgatattgcgaatcagctgtgtccagggcatcttgtccttgttcacgcaacgattgagtggcatcctccagcttggccttagcaatttcatattgcttctcggactcacgagatacttcatccgacttttgctgaccccattgccaccaagaggccttcgtgtcctcaaatttctgctgagcttgctcaaactgatatcttgcatcattgtaagcgtcctgcttagcaggaggtcctcccaaggactttgtgctaataaactttgactccggagactgcgaccatctggtgtgattgtcaactgctggagcaatgccactacccacagttacagggttatttccggaccgaccagacgagatgggggtctgaagtttttcctgcttcttctgttggtagagaattaaaccagtaccaacgacggcggcaccggcaagaatttgagctgttttagaaaccattgattcaatgtatagtagagattgaaaaaagagcaaaaaagaggacttaggggtggagtactctggatatttatacttgagcacatgcataaaagtgggagtaatgacgtgcaaatgggagatgctgaatgcagattcggtcatttctcctataaaaatacctatgggaacgggagagcaagtgaaggtacaattaggtaatgcaaagttgaattccgagtttaattagaattgagaggattgtattggtcagaaattacctaaagagagcaaggatggcagtttctagcaggaagccagtgaatgttgctccctgggtcgagtttgacgcttgtaaggtgttgacgatgggggtgagatgagtgtggagatttagagagctgagggagaagatggtattcgaacggggaacttgctgccccctacggagtatgcattgctccttctaggtttttccttccagagaccgccgcacgaagatggagtaagttgtggccagtttttttttttgagatctagccggatagcaattatgggcgctccgcccagggtcgcctccccgaggatcccctgcagcttctcacgtttcggtgcttttatcttttcatctaatcactcccacgacatagcctccttttaattctcacttataatcgtccaaacccacatgctcttttatccatgccttcgaagtttgacatagaaccgtccacactatcaagtctgcacgatcccaagtccttgcgggttcttcagagggagtgtggtggtatcgatgccctagtcgatagtctagcctccaacgagtcgctagggttagaccctcttctcccagatgaagatgaaagaatcgagagatacggagagaacatactgccactcaaaaagacagcctccttgttgaggctgctcttcgaagcattcaaagacaaaattctgattctcttatctgtggctgctgtgatctcactggcattaggtctatatgaaactttcgggcaagaccctgaacatgatgctgaagggagagagatccccaaagtggaatggattgaaggagtagcaatcatcgttgctattgctgtggttgtggttgtttctgctctcaacgattggcaaaaagagcgccagttttccaaattgaatgcgatgaaagacgaaagggaagtcgttgtgttccgaggtggtgccaagacagtcatttcaatttacgatgtacttgtgggtgacatcttatcggtggaaactggtgacgtcgttcctgtcgactgtgttttaattcatggatcctgcgagaccgatgaatctgcgttaacaggtgaaactcatactatcagaaaggttgctgcagaccaggccttgaaatggtataacgaaaacatccctgaagattctgaaattgatattggtgatcagaaacatataccagaccccttcttgctatctggttctaaactgttatcagggatgggtagagctctagttacctcggttggtccgaactccatacatggtaaaattttggcctctttgcaagtcgataccgaagaaactccgttgcaaatgcgtctatccaacctagctgacggtatttcaaagtttggtttcctcgctgctctgattttgtttatcattttgttgatcaagtttttggctaatctggctccaggaagacgattccatgatatctctgctgctctgaagggatcgcacgtcgtggatattttgatcaccgctataactgtgattgttgtggcagttcctgaaggtttaccacttgctgtgactctggccttggcctttgctactactagaatggccaaagattacaacttagtaagggttttgcgctcttgtgaaacaatgggtactgctacagctatttgttccgataaaactggaaccttgactgaaaatagaatgcgtgtggttagaggattgatgggtaatatctcttttgattccttagaaggatgtcacaaggaagtttctcaactttctgacaagctgtcaaaaaatataaaaaccaacattctgattaattctactgctttcgaaaacgtgcacgaggacggtgatgttgcaactcttaccagccattcaacccttcgccatcaatccttttggtccaaacttcctttcttcaaaaagaagcctaactttggaatgtttggatcttctgagcacttcattggttccaagactgaatgtgctatgttgttatttgctaaagatgatcttcgtgcattggatgattgttctttagaagttattcgtcaaatgcaagaaccatcaattgttcaagtcataccttttgacagtgcccgcaaatggagtggagttgttgtgaaacaaaaagaaggattatacactttctacatcaaaggtgcctctgaaattgtactttctcgatgtgtatctagatgtactgttgatggaacagttacgaggatttccaccagcattaagtcatctttggaatcattaatcacagactatgcttctgacgctttgagaacgatctctttggctcacagagattttgaggttaccaattggccacctcaaaagtatgtcaccgttgacgaaacagttgccgatcctgatttactctttggtgacgtcgttgatgactcttcgagaaattttgcttctaatggaaaaacagatactgtccctgccattgtcatacaaaatgacgagtcttcatcttctgactcagggcttacacttgacggtattgttggtattcaagatcctttaagacctggtgtacctgaggctgtccttcaatgtaaaaaggcaggagttacggtgagaatggtcactggtgacaatttgattacggcgaaggcgatttcatccaactgtaacattcttcctaaaaataggttagatgaccccactgcagttatggaaggtccagcgttccgaaagctttctgtagcagagcgtcacgcaatcgttccatctctctgcgtgctagctcgatcctcacctgatgataaaaggttattagtggagactttgaaggaccaacgtgaagttgttgcggttactggtgatggtactaatgacgctccagccttgaaattggcagatgttggtttttctatgggacgctctggaacagaagttgctcgtgaagcatctgacatcattttgatgaccgatgattttactgccattgtgaatgccattaagtggggaagaactgtgtctacgtctattcgaaagtttatccagttccagctgactgttaacgttactgctgtggtgctaacttttgtttctgccgttgtttctgaagaaggtaagtccgttcttactgcggttcagttgctgtgggtcaacctgattatggatactttggcagctttagcgttggccactgacaagcctgatgatagcttcctggatcaaaagccagctggaagacatgctccattgatctcagtttctatgtggaagatgattattggccaatcgacattgcaactgattatcactttcacaatatattttgcaggggagagaatattcttcgattcggaaccaactgatcaccaagtttcgcaaattcatgccttaactttcaacacttttgtctggctacaatttttcaaactttgggtaacacggaagttagatgaagctgacgatttgactactgtgaggagtaggattactgcgagaaatcttaatttctttcaacatttcttcaggaattggtactttttgtccattgctgctataataggtggtttacagattttaattatgttcgttggtggtgcagcattttcggttactcgtcaaacgggtgctcaatgggctacagctttgatatgcggagcactggctttgccgtggggtattctcattagaattattcccgacgtctgggttgtaaaattattccccacaagagcattccactttttagtccggattatatcactagggatgtttaacctaggtaagaataaacgacaagaaccactttctttcggaggccaaaacacggaactacagtacctttctccattcgaaagagccaaggatggactatctaaattatctctgggatcgcatgagtctttaccattgaatcctttcaaatggagatcaagatccagttcatcagctaactctacattgatcaatttgtcttcaagaggaagcagcgccagtgatattgaacatactacagccacaggattggccacaatggtgcccactgtggtaggtggagctgttgccggctggcatcccgatgtgtggaaggcaagccccaaagaaagctttagagaggatgaaaacgaaattagtgattcatccaggtagttagctgattatttatatttcatatctttactgtataagtatctctctttttgagcctcgaggaatttcacaaactcattgtaaggagtatagaacttgtaaagacctttgaagactggaagcagttgaatcatggagtcacatttgctaactagcttgtggttaatttctttcttcggtttgtccctttgcatttcttctagaatggcctcttggagcatactcaaagatgacgaaaaaacggatactgtcactgtttgtggaacacgatcatgagtattagccgaagtaggagccgtttgataatccaaagcatcatctacaaccaatgaggttgttgcaaccgtttgggcagtctggaaaacttttacaactgcattcatacgctgttttatcaccatatactgtttcaactcgtccattatcttcctatccaggggatctgtgtttagatggaggttcgtgatcttctcgttgatttccacaagatcctcttgcagtgtatctattgagttgaacaatgagtccaggtagtattccaatcttgtaacgcttgaggtgtcgtcgccaatggaggtataggacagcacggtagcggtagatcttaatttgtccaattgttgttctaagtctttcgtcagttcgttagaataaaagtcgacgtgagaaagcaaagaggaaatattactttgaagggattggagttgctttactggtagaaaagatgggcctttcaattgggtgttaggctggaggcttcccctgggtataactttctgagatgtggtgttcgttggaagacttttgacaagaacagcgtccacatatgcatgaggcacaaactcttcatcgaagaacatggataggacttcgttcccattggtctctgccatttcgaatgtatggaaggtaatattcatcaaaaatgagagatcagtattgagagttgtcgcggtgagggtggagatgcatggatgtgaaatgtttcgccatgcacatcctctacaacaggaactcttgaaatagaccatattttccaactgcgtagatagacttattctgaatgcaaatatctgctactggtacgtcattctcaaggccagtgaaataaattggggattctgtgtccttgatattataaccaaccagatttccgaaaccaaaggaaatcacaatatatgaaccaatgaccttaacattgtcaattctttctgcaacgtctactagctccttgatcttgaaatctgtcaatccaatttccaataatttgccattggaatatcctacatacgcggcatccccagcgatagccagatcggtaactgcagtcttattacttgtatctagatgttttatgagagcttggtcagcaatcctccagaacttcacatcaccattctctaaaccgcagatggcaatttttccttcaacctcaaagaggttttcgatacgagtattcaccactgaattggcctgactcctgtcttcatgtattttgacagcggtaattccacacaaacaatccatcgaggcaacgctcatcccactagagcattcccacagtttcaattgtgcgtctaaggatgatgtcacaaagtttggcccctcccaaccagactgaagtccgtaatcgatgcctgatgtcctgaaaaagttcttgcattgtctccagtctcacaatcccaaatttttagcatcatgtccaagccagcggaaagcaggaccttatcagatggaaaataaaggacctttacgatcccaccatcatgagccattacttctttcaactcatccctctttgatcccagctttccatacaacagtcggccattgcggtctccgacaacaaaattgcattttgccgtaacattgacagacgtgagcttatgcgaaataaagtcatacttttctacggggaagacacatttcaatgttgactcttcatctgagagctgatatttccagtgatctagcttacgtaacgtcaaacctggactgagtggttctagcttgtccttgtagactctaaacttgctaggtttggttttgccatcaattatttcagcccaaacatcttcatgattcacacggccagactccacgtcactaataacgtccaaaaagctgtcctgaattctcacaagcttcatcgttgggagttgacacaggaaagtcaagggcatctaacgaaggcgcgataaaacgaaatcacctagttctggcacccgtcatcggggtgttccctgtgctgatcgcgcatcgcgtaaattgccatcagaacgtatgtaacgcgtctcacgctttctctactcactctacgactaagacaatgacagagttcagtaaaggtagtttggttgaaatcttccagaagggctataaaggtggactaaaacctttgacggttcaagttttgaatttgaaggcaattcccaacaatacgggcaaaaggcttcgactcgccctttgtgatggtttgtataatgccaacgctgttattaggcctgaatcggtcgaaaaggccgaagctcaaggaatcaagaagggaagcattgtccaattgctcgagtacaaagcttcaatgataagtcctgtcaaacacgtcttgatcatcgataatcttcaagttttgggatttcaagaggagaaaatcaacccatccccaactagtgtagaccaatatttcagcaaccactctggagaaagcaacgaagacttgttgggcacctcaatgaattctccagcgcctcaagagcctgcgcagaaagcgcaatcacatcaccaagaagatgcaaagccaaaactgtcagcacaggttacgtccaaaccccaacagaccaattcaagtaccgctaaatttccaaatatccatgcaattgatcaactaaacccctatcagaataattggaccattaaggctcgggtttcttataaatctgatatgagaaaatggtccaaccagaggggtgaaggtcagctcttcaatgtgaatcttttagatgaaactaatgaaatcagagcaactgctttcaacgatgttgcagataaatattacgacctcctacaagagggcaaggtttactacatcagcaaagcacgtattcagccagcaaaacctcaattttccaaccttacccatacttacgaattagctttggatcgggacactcagatcatcgaagcagaggatgcatctgatgtcccttctcttcattttaattttgttaaactcaacaaggtacaggatcttgacgcaaatgccattattgacgttattggtgtcatcaaagtggtgaatcctgctttccaaatcgtggccaagtcaaccggaagaccatttgacaggagagatattgaagttgtagataatactggatttgctataactgtagggttgtggaataacactgctcttgagtttgacattcctgttggatcagtagttgcgtttaaaggtgctaaagttcaagattttggtggcagaagtctttcattgactcaatcagctaccataatcactaatccagactctccagaggcttatcagttgaaagcatggtatgatcaacaaggtggctccaatcaggagtttaagtccctgaaaaacgaagtatcttccaacagtggtttgaatacgaaacaagacattcagtcccgcaaaaccattttgcaagctcagtctgaagaactcggtaagaatgacaagccggactatttctccattaaagcttacatcagttatattaggacagaaaacttttcgtatccagcttgtgcatccgagggttgcaatagaaaagtcatccaacagagtgacgatacttggaggtgtgaaaagtgtgatgtcaaccaccccaaaccgaaccatcgttatatattgacattgtctgtggtagaccacacaggacaactatgggtcacattatttgacgaccaagcacaacagctcttgggacaatcagctggtgaattgatcgacttgaaagagaatgacatgtctgaaaataaccatgcattccagcaagtattcaacaggatacaaatgaaggagttttcgttcagagtaaaggcatctccggattcttacaagggtcaaacccgtattcggtataatgccgtgtctctggccaaactggatttcgctttggaagcagatgcattggcagattattttgagggtgtcaaggttaattaagtttgagttctacgtacggtgtattttttcttttaatttcattaaaggcacttgttcctttaagaatattctattagttcgtttacctgtagccagaactttttcagtaagtcattcacctttcttgaaccgcgagttaacatcagttgctgacctagcctaacggtatcattggtaggaatctgttttttcaagagctggttattgttgatagtttcaaatgctagattaaaccatttcttgaagttcaaaggatatttgacaagtatcaccttgaatagttccatgaagttttccaaatcagatctagatgccatcaagaacgaagcaaccaacttgaatatcaatgacggccctagttcggtatgctcaatcatgtctctgataataactgaatcttctttgtctccctttctgagagtgacaagtttgatccaaaacttacagcctgatctaagcacaaatttttctttagaacccaaagattccaaaacgaatggtaatatgttatgcaaaagatagccttttattagtatgcctggtttcttctcaagtatcactaccaaaatgttgaggaaacataatgctagatcaggatcctgttggatgatagccaaatactccacacatgattgctgaagcgtggtcgtcaacaaatttgaacctattgacgagctctttattaaggattctagtaaagaatactgtaatggaacaacgttcaatgaatttttggaaaaacattgcaaaatcttcgcattcaacagatcgatgatagagtaggtgtcaaaaacaaaaggacctggaatagcttctgtcaaacctgctttcaaaattccagtacaaacttcgttcatcatataattatcagaagtaagaggattcaaaatcataaactgtttcactacttcagtgatttgctttttaatgtggagggggtcttcaatccagtaagcgtacacggcatctctttcttcaggtgtgtaccagtcgttcacatcagagggaagcctcattgcctttccaatttcctcaatagatgataataatgattggagataatcaacgaattccggttgggattgtacttcaattgccttagaaatgatcccattcaacaaagagtgaatgagattagcttggtcagatggagatcgaataccttgtacgatggaagaatatgaataaataatcctctctcttatgataggtttaacttctgggtcgacaacaatttgatcgataagtattttgaatgtgggtagtactggagccaaggatatccgacaatcattgcagatggacgagatggcctttgatgcaattatttgatgttcatttggagtcgataagaggaatctaagagttgactccaagtatggttctcctaattgagaggaataaaagaaatctaacgatgtcagaaattgaatgctggtcttgactaataatttgttattgctttgaatgactgtttcaaacaaaccagaatctaaaatagatttgagaagggaataaatctcgcttgtggcattatcttcgttaaaattgcaagccagcgtctgaataaggaatagcgacgactctatgtccgcaatagtctgcaaagagttattatttgcatttgacaaatttgatacaatattgctcactaagtgctccaataatggcatcttgagaattgggtaaattgtttcataaaaatctccaatgtctcttctgtaagaaacgaaatcttggatttcatcatcatcatcaaaatccaagtcttcagatatgtgactgtccctccaatatacttcggctaatttggatagtatggtttgcactttagattgagtttccgaccatgctggcttctgctttaaaatgtcttcttcgtcgaggtagatatcggcgaattgattccaaaaaaagatgaactctttacacaatacagttgatagttctaccaaagaatcaagtttgcgggacgcatcgtttgtgttggatcccaactggtgtaaaagttttagcaattgaggttcaatgaaagaattaatcatcatggcatacttgttgattgcatcctcattcagatctttatcctgtaaaatgtgatctaagtattttccaccccaaccagcaaatatgagttgttccaactcagcgttaatctctgccggaaagatgctcggatttgtatctagaatcaaagtgataacttctatggttttgttggatatttctatacttctaccagtggcaaagttaaatagaggagagaaaagttcaccgagacttccgtatcttatggttgactggatttcagcttgagttacgtactgaaccaaagctgccaataatgatagccactgaataattatcgtctcgtttgtagtgttttgaaagctttgtatcaacaaactaatgcgagggtacagatgtgaatggatagatttgtgaaactccgttgaatcagtgaggtcaatggtcagttttctatgaatctcttccaacaatagggtggtaaatagtagagtcaaatagtcgtaaaattcgttaccaattggtgcttctgaattgttgtacagtgtcattctaaaagtgctaacaggatcttcccattgctgataagtattgatatagatgatggccagattgctcattagtttcttcaagaccaccagttgcttacttgaatagtttgggttcttacaaattgaattaaagtggaaaagcagtttctgggtcactgtttcgtatgaaatgttatcctgatttttcgccaaactctccctatgcagatataagtttactgtgtaagttagagcaccaaagaattgacaattgatggactcttgttcaagtagggaatcagcaatcaaccatccattctctgaccgttggacgtcttgaagctgcttctggatcagtacaatcgatgaagggtcatttggagcatacagagcctcgactaaatcaattactgatctcaagtccatgaaactaatggcaatatgcgaaagagattatgtgagataaggctgagatggttggtttatacgagatgcgatgaaaaaggatgttggatgtacggtagcgcaatactgttggaacagcaggtgccacagaagctacctaagacctgttcacacctctgccaaaccacgctgataccactcttttcttgttctaaagtttaccccaatccctggcagttcatcaggcctctcatcaatagcatgtatctatcgggcgacactcttctctccaccacctatcgcctgccattatctgctcgaattttttgacagaccacccgggactataaagaactttgcccatccagtatcttttctttcctttcgttatctgctctctattactttgctgtaaacctaccaaggtctcaagatcaaggaacatagaaaagtgacgtattatacgtttggttaaagaaaaaagtttttgccgtctcagatgtctactcacggagttcaggcaaaattgtcgacttactctttgagacaggttcacaccactccggcgacagctccagttgctggacgtgccccaagaagttgtaacaactgtacgtgctctcctggtttgcttaccagacagggaagaatgggctcgtattacgccaagagattagccaacagatctaaatctgttgctttggggtctgcctcaggtgttagtagaaagacttcgtcggtcctaactgtggattcctcgtgttcagaaggacttaaggagataaatacaagcagaaggcttctagagctgagaaagaagatgacagagtacgatcttggtgtatacattgtaccatcagaggactcacaccaatcagaatacacaggactggcagaccaaagaagagaatttatctccggatttactggatccgctggcgtagctattatcacaagaaatgtacagtgtatgaatgatgaccccgaaggtacctcttacttggctactgacggcaggtattttacccaagctgccaatgaactggattttaattggaacttgtttaaactcaatatccccggagaaatatcgtgggaagaatttactgtacagctggccgtcaagatggctgatgagtctgggttcaatgttaagataggagtagatcctcagttgataacttactctgaggcccatcttctgcagggtttggttgacgacgttgcttctggcgaaaaaaaagggttggggattcaatttgtccccgttacagaaaatttaatagatgctatctggactaagtttgaaccacgtccagttagggcactaatgcctattacgctactggacgaaaagtactcgggtttggatactaaagaaaagctggcccaagttaaagaagctcttcttgtcttaaacggacaaacgctggtgatcagcgcccttgatgatattgcttggttactcaacttgcgaggttctgagtttcgatatagtccactgttttatgctcatctgataattcatgacgatcaagtatctctctacacggatgatcatgaaaggtttgaaaacatttcggattatttgaaggaacgttctgtcactttgagaccttacgacaagttttatgatggcataaaaagtctaccagctaatacagtgctagtcaccaaggattgttcctgggaggtggcccgccaggtaatatcgccccatcgcgtaagagtaatagactctcctgtggctattatcaaggccaaaaaaaacgaagttgaactagccaatgctcgtgaagctcacatcaaggatgccattgctttagttaaatattatgaatggctatggcaagaagtgggcatcaaaggtgagttagtggatgaattagaggctgcgcaaaaactggagtttttccaaagtgaacaagataattttattggccagtcgttccaaacagttagtgcttctgggtccaactcagcagtagttcattacactccaaagaaagaggcatgcgcggtcattgatccttccaaagtttatctttgcgacagtggggcccaatatctagagggtaccacagatgttactaggacttaccatttttcaaatccaacgaacgagcaaaagcgcaactacaccttggtcctgaaaggccacatagcgttggcaaagctcaagtttcctccaggcactgcaggccttgccattgatgctatcgctcgtcaacatctttggaccaatggactggattacacccacgggacaggccatggtgttggctcgtacctcaatgtccacgaggggcctgtggctattggagtccgaggaacggttcccctggaagctggtcatttagttaccaacgaacccggagtttacttcccaggtgattacggagtgcggctcgaaaatgtcatggaagtcaaggagacttcggacaagttcttagagctagttccattgaccctagtgccattctgtcgccaactgatagatcgtaaacttctaaccaaggaagaagtggattgggtcaaccactatcatgccaaagtgtaccagacattagtgccgcgtcttgtgaggcactcgccgcacgcaacttggctcaagcgcgcaacttcgagtctctagtagtttagtaggtattttcttcgcgtccaataagattccagtaatagtcagcttgctcacatttaatgcgcgtttttggcctctctccagaattcgcgacgtcatccattttgcctgtcccttccgtcctccttgttaaaactacctttttcctcccatattttttcttttgcttagctatatttattaactcaattgtcctcatttttttgctgtacaataagaaatcatgtacaggttacttccaagatcatataacagcgctttgtctaggactttgtgttctagctccattgctcgctctacttataagacgttaagacccaccgttgctggcgacaggcaggatgactttttcaattcattgcagtttggagaagcctctaagtggtcgaaacattcactaccacgcagtaggaggttgaaggacaagaattccaacgaggagaaagacgtttctgctgcttctgaagatagttccaaaccagcttcagtcacctccaattctacatcgtctcccaaactatccacatccacagctacatccacattgacaacttcgaacaacactgttccacctacacagaaaacacagaagaaacgccgtgcgttgcgcccccgcaaggctttgatcactctatcgccaagcgcagtatcacatctacgagcattatcagatctacccgaaccaaagttgactagaatcggtgtacgtaacagagggtgctcaggactcacctaccacttggaatacgtatccgaaccgggtaagtttgatgagctggtggaacaagacggtgtaaaagttctgatagactctaaggctttgtttagtattgttgggtcagagatggactgggttgatgacaagctcagctccaagtttgtgtttaagaaccccaattccaaaggaacttgcggatgtggggaatcgttcatggtttagatgataaaccgaactgactcacattcctctccgagatcggatttgagacaacaaaagaaaagggttcttttttccttcttcgcgaaaggtggaatgccttgctatgcgacatcaaacatctcacaaccaacatcatttctgcatcaaactcaaactctgcggcaccacctttgtgccttatagacacaaattcagcatatttaaactagcaagactgttatacacttcagaattgtactcactcaatcgactttttacacattctatcacatttataatgaaacttcagttatttaccctaactctctccttgatggcatcaagcactcttgctgcaaaagcgcctaagaataaggattccccttcaggtgccgtagctcgtgccgactttgatgacgacaaactacatgggatcattgaattctctactgcaaagaacaaatctgtagaagttcatgttgatattaccggtttgcctgaaactggtgggccgttctattaccacattcataagaaaccactcaagtctggagcttcttgtgagtccaccagtactcatttcaacccgtataatgcaccagctgattgtctcaagaccaaagatgacagctactgtcaagtcggggacttatcaggcaagcacggctacatcaacaccacctgctttgaagattcctattacgacccttatatctccttgaatcctaagaataaggcctatccagtagggttggcgatcaaccttcactatgcaaaccaggaaaggtttgcctgcgctaacattgagttagttgacaagaaagtcaagcgtgaatttgatgatgttgatgctgagtttgttggtcagatcccagaatcagacaatgtagtttcagctgagtctgtgaaggaagacacgaaggtgaaatcttcaaagaaggatggatcgtcaacctcaaaacctcatgtgagtaagctttcttccaaaaagaatgttactaatggtacgtcaccattattatctaagggcaaatattacacgaactctacatcgaaatatggaaactttaccaatggtaccagttatccaaccgatgatgactatgacgacgacgaaaccatagaagtgtcatcctcgtatgccaatgccgcaggatatttattgaacggaaacaccgtttatggagctactcttgcagccattatttcctacctggtctagactttcattaactgagctaaatacgcactaaatatatgactaaagaaaagattaagagtagatgaactaatagtgagccgcatacaagtcgaatgcacgacaaagagtttgtcgcgacgcatcatctacagacagaagctcctcactaacagagaattcggtgccatgtgaaactgattgctgactaggctatcacatggcactaaactgtatataagccagccagtggccaattttattctctcttctagtcaagaaaatgtcattcaaatcagagccattgttgcagggaatagctgacaccctcagcaaaaatgaggcgctaaaagaaagaacccttcaaaagaccagagcaatttttgtctttaatgtaaaaaataaggagggtaaagccaaggcatgggccttagatctgaaaaaggcaggaactttaacagaactgaagagtactgaggaattggaggaattgaagcctgacgctactatcacgatcaaagatggcgatcttcgtagtttgatccggggaaagtccaaccctcaaaaactttttatgagtgggaagctgaaaatcaagggaaatgtggctaaagccgcttcaatcgaaacagtgttgaagagcactaggccagccaagtccaaactatgagattcttatttacaaaaaaatgaataaattaactaactattttcagtaagtgtctcccttcgaactcaagaattgatactacccttatacctgatcttaaaatttttaacctttttctcctcacgtggattctttccccaaaggaggatccccacggagattctgttcactagcgtcttttgctgaaccccggtgtgtactgcgaaatggcctcaccgaattctgtggtgcccaagcttctccgataagtgggtgttctagcgactgctgcatcataggccctacttgagaataaaaagaaccgagaaaaagaaacgcgcaaacacagtgtggttgcgccaaatccgaagagactcacggaagtttccacgatcctctaaaatagatatcccttacgttgcactatccttgttatcgactcccctggatagttatcaatttcatcaataccccagattgcatcttcttaacggacaagcatatatcggctcttgaaaaatggaccgtcaacggaccggtatcggctctcgtaaaaatccggcccaatcaggtggatgcggctctcctatcaccatgtaatggcgtgcggctgaacatgggtggaaaagaaaccaattgccattggccaatcacaagcggaaacacctcctatcggctgcatacctgtgcggtgcccctattgtcttctcactcacttcctctctatggccagtgataaagttctgaaaaatatgtttaaggaggtcaaaaagtatttaaagagttctggccccagtagctaaagtcttcagtacacatacaaacctacactatggtccaaccacaagaaccagaatttgagcaagcctacaacgaacttttgtccactatccaggactcaactttgttcgagaagaagcctgagtacaagaaggttatcgacgtcgtctccattccagagagagttgtacaattccgtgtcgtttgggagaatgacaagggtgaacttgaggttaacagaggttacagagtccaattcaattccgctctgggtccatacaagggtggtctgagattccatccaaccgttaacctgtccatcctcaagttcttgggttacgagcagattttcaagaatgccttgactggtctgaacatcggtggtggtaagggtggtgccgacttcaatcctaagggaagatccgacaatgaaatccgtcgtttttgttacgctttcatgtctgagttgtccagacacattggccaattcactgatgtcccagctggagacattggtgttggtggtcgtgaagttggtttcctctttggtgcctacaagaagatcaagaactcttgggagggtgttttgactggaaaaggtttgacttggggtggttctttgatcagaccagaggccaccggttacggtctggtctactacgtcgagaagatgattgagcacgctactcaaggtaaggaatctttcaagggtaagaaggtcgccatttccggatctggtaacgttgctcaatacgctgctttgaaggttattgagttgggcggtatcgttgtatccctctccgactccaagggttctatcattgctccaaatggtattaccacccagcaaatcagtgctattgctgaggccaagcttaagttcaagtctttggaggagattaccggatcttactctgctttctccgactctccagtcaagtacatcccaggtgcccgcccatgggtccacgttggagacattgacgttgccctgccatccgctacccagaacgagatttctggtgaggaggctaaggctctggttgcagctggctgtaagtacgttgccgaaggttccaacatgggttctactttggaggctattgatgttttcgagggcgaacgtgcttcttcctccggtactgctgtctggtacgctccaggtaaggctgctaactgtggtggtgttgctgtttccggtttagagatgggtcaaaactctcaaagagtccaatggaccgaggaggaggtcgaccaaaagttgaaggacattatgatcaactgtttcgacaactgtttgaacactgccattgcctactcttctgagactaacaaagactctctaccatctttggtcaagggtgccaacattgctggtttcgtcaaggttgccgatgctatgtacgcccaaggtgatgtgttttagttttgtaatataatgatgcatatagataaaaaattctatgatttgggttttaaatgattgcttattgtagttccgagggagctgaggcgtttctttgatttgaagagcacttagtaattcttaaaaatcagccttacctatctttctgatggagcccccttgagggatgaacgaagcctttgggcgcatccccatattttccggatgcttggctggaaacctctagttactcgcgcgccatacaccctacctaattaattcttcacattcatccatacatttaccatctcacttccatgactaaaatatcatggagtaagaatggattcattgcatacaccgatgtcaaatctccctttatgctctgtatgagctacctggagtgccttgacggacgaaggtggcaaatggctcctcccatcatgattgacgttggtgcctccattaatcagttccacactaacgctttgtccaataacaaagttaatggccgttccgtgagcggtttgcagattcaaaaggtcacctggaatggtactggcacagacctagctattgctgacagtcttggtaatattagtatttttattgctggggtcgagttaacgaattcgcctaattcatctactccaagttttgctatgacactgttgaccaacatggagataatttactacgacgaacagggagtgtcgcaagtgaattctttgaagtggttgaaccttaataaaccgatcattgccaatgtccccgctgtgaaagtagaaactaccaaagataccaccgtctcctcaggttgtgcagctagacaaggagcctttgttgaagatgccaattggaacgcttactcttatggggtgcatcaatacaaaccatacgggacttctcatcctattggcgccaagcatgccttgttcgtggtaagagatcatggagatataactctatactatcaaggtgaacatggattagcatattaccgatgttcggcagttttgccagaatgctcctatgtaaattgttctagcattggatttactagagatggagatattattgttgcagtttattcgaaactagaaaaaacgattcaagtttatcgatgtactattgattggggctacttaatcgatgctgcagagcagcaaaaaaggaatccatcctacactacgcccggcgaagtcaaacaaagtaagcttccctccttgagtgtagaacttcttcaagtcgaaccagtattggaaattgatgagagtggacgactgcaaacactaaagcacatgtccattgtctctcctaattacaattccaacactgaactagatttcttaatcggatacgaatctaccactaatgatgatgaagaggtgtctaccaaaatatacaggtaccaaatggcaaatgaccaaaaaattcacattctttccgctttcttgaaaattggagagagtgataaacaatttcaggattcactgcccagggattattcaataaggttgaaacaagttgccacttacaaagggtctattcttaatatcgagttttataattcggacctcttcgtggtgctcacattcactaacggagaaatcaaagttgtcaaccgtattaatttcaaagaacttctttctccggaacagctggtagtagatggagcaattaagtttccctctactgcattgatgttgaatgacgctgggttccaatttcctaaactcgatatggagaaagacgatattatagagacatcgttttcccctaatttgacttcgctcgtttcactgaacaggaatacaaatcagcttcatttttacaacatgaaaaggaaattggattgttcattaaaggggttcatgtttattacatgtgttgctatggctttcagatattcgtattcatgttttacaaacacgtcatgtgaagatctattttgctgcattcacgaggaagttgcaagaatagccccacactgtgacgttgacaagcttaacctgggtattattcaagaaacccatcgatccataaatttcaatattgactttggaagggaacatgtagacaaactattgggatcgccacctttacagcgattattgagtctacaattctcattaagcctttatcatggatggaaatcctccaaatcggccgccatagccaacgtcatcttaaatattcgaaccgtcggctttgctctcatgtatgcgacgagatcgatggtgatgtacgccaataaagtctccaaaagaggaactatgtttgcaacagaagattcaaagtttcaggctgaaagtgttgtttcctgccttggtccgatcaaatggttcatggatttttgtgtagcattaacacaacaatttattgaacttgactctcaattgaagctcaaaaaatcaacatcaggtgacgagtttgtggctgtaccaatcgtattgggaaaaattccaaggtattttatgatgtactgtgtcagttacataaggagactttatgattttaccaaacaatctattgagaaaattgaacccaatgccacactatacaaaatcgaaaacaacactcttgaactgagccaggtgaaaccttttaccaagccactactagaagttttttacagtttaaaaagtatcctagaagagagtccggttagtttggaagccattgataagtttctgaatcacgttgacgaagagctcaagactgagtactatactcgatttgggacaggcgaaaccagatcattggggaccgagcaatccttggtcttttcaggtgaaattccttcaattttcctcaactccccttcaatattggagatgttgaacaacaaatactcaaagtttctctgtgacaatttgagtgatacctatttctatgataccgaatggttacgtttggagtttgtcaagaaacagctgcagaatcctagtggacctacagtccattgcaggacagaccttacccgcacagagcaaacacaggaaaataatcattccattcctaatgataatagcagggtcgacgacctgcgcaaattagtattcccttacgaagttaacgtcaaaaagtgcactagatgttgctcagtctcccaacttcatgaacccatatcctttggagtatcgcccgttagtatttggcttatggcattccagaggagctgcatctgtgggggatactgggttcataggaacggcccgagtgcaagcgagtaattccgagcacaaccatccctcctcacgaaaaaagagatatcaatgcatgaacgctaaagtgaacagaaatctcatctgataattatatagtgcgccaaccaaaataaatcagacctcttttatcattctggtgtgtgacagtcaatagccacttatttgatatcagacagttcagtactgatcacctcttttgagtatcacagcattcacccaccacaagttttttacattcctgcatcatcgaagaattcacaaggctgataactgtttcttctttttactttctctcagagcccaacctttcttctagcactccttttgaacatcctttcagagtcctatcattatgacggattcagtgagttcaagttttaataacttgaacctattagatgattttgacgaagaaacagcggagctggaaaaactacaggaagaacagaagccatccatttcccgaaactcgtccaccaacagaaggcagcaacagaacggtggtgtgaacgatgcattgagagctcgtgtcagggccttccaagaaaagagacgcacgcagcaagataagaatgagactagtgacgacacaagctcaccaaactcattagcagagtctcccttttcttctcctggtgtggcgcctgcccatgcagactctcccaagacgacgtggaatgtcaaaccttcgccacagagtccagtagagtttgaacccgacagatatactctgccgaagataaaaccgaaagtagtacttccacagcaacctaaaaagtctttgtcggaaccaaacacgcttcatagaactaaaccgaagccaaatttgtcactgtcacaattaaagtcttacaatgaagtggatgaatccaagaaaagccaactagcacagcagagcctcagaggtactcctatacagcctgcaagagcacttcctaaccaacagaatgctcgtgtccccaagactaaactttctttatctgaaagaaagggactcaatttgaactgtaatcttggaacaaattctttgaaggacaacagtcgatcgatgactgtgggagaagtacttagtaagcgaggtcaacttccaagacagaataagcaacctccgaaggcccaggtaaagccaccaccacctcaacagcaacaacagcctgctggaggaatgtttgcaaactacactaaatacattgatgttgaatctggttcccttaacttttctggaaaagcttctgttcattcaaagggaattgatttttcatctggctcttcgttccgaatatcattggacgatttggaatacattgaagaactaggtcgtggtaactacggtacagtcagcaaagtactacacaagccaacaaatgtgatcatggctatgaaagaagttcggttagagttggatgagtccaagtttcgacagattctaatggaactagaaattctgcacaactgtgttagtaactgcattgttgatttttacggagctttccttgttgaaggcgctgtatacatgtgcattgaatatatgaacggaggatctctggacaaaatctacgcagatgttggtattccggaacctcaattagcatatatcactaagtgtgttgtaagtggccttaagactttgaaagataaacacaatattattcacagagatgtcaagcctacaaacatattagtgaatgatcaaggaaaggtcaaattatgtgactttggagttagcggaaacttggttgcttccatggctcgtacaaacatcggatgccaatcctacatggctccagaacgcatcaaatctgtcaacccagatgatatttcctacacagtacagtccgatatttggtcattagggctatccatattagaaatggccaaaggttgttatccttaccctccagaaacatacgataatattttttctcaattgagtgctattgtcgatggtgaagcacctacacttccagagggcaaattctccttagaggctcaggactttgttgcacaatgtcttcaaaaagacgcaaaattgcgtcccacgtatgccttattggagaaacatccttggctgcaacgttatgatgatgacgaaaagaacgtggaggacatgaaaatctttgtcacccaacgtctacaagatattgaaagtgccaaacttgttgcggtagataccgagaagcaacctaactcagcacccgcaacatctgctgcttcagtcttcgaatacaagaaagttcctgctctacatagagggggactacctaaatagtgcaacgcaagggcatattgatagtgaaaaatagtatcattcaacttttgtattataatataagtttagccaggtgtatcacgcatttgccatccgacatcttcggacggctcttgtatataagcttgacgatgcatctctaatcttaaattcatacacttttaaatgactcaacacgagaaaacaatttgtgtgttttgtggctcctcctatggtaatagtgaactatatgccaagttggcatacgaattaggtgtcaagctggctgagaagcgctacggaatcgtctacggtggaggcaccactgggttgatgggagcagtggcaaacggttgtgcttctaacggcggctacgtacatggagtaatccccgaggcactcattactagagaaagaattgattcaaagcaatttaacgagtcaataaagagcacagtggacaatcacactggcgtaactcctattccagaagaaaaagaatacgggaaaacaaccattgtcaaggatatgcacacacgtaagcgcttgatgtcaacagaggccaacgcgtttatcgctctccctggaggttatggaactctggaggagcttatggagattgttacctggtcgcaattaggtattcacgatcaaccaattgtgttattcaacattgatggattctacgatgggttcattgaattcatcaagacagctatacaatcaggatttatttctgagcgcaatggagacatcattgttgtggcaaatacaatagacgaagtgttggtgggcattgatgattataaggttccggaaggacgtttcaagctaaaatggaacgacgaatgcggtgaagctcactaaaaagttcgaatgtaatcaatgcctccgacacactctgccacggtaagctgatcaggaccgataatcttactgatttcaatgccagcatcgactgttttgggcataccgtcgtgttcgagaatcaaacccgctggactccatgttttgtgtctccatctttgaacgtcactatagatttcgctttcagttcgctgaggagggactgactccaatttccaatcgaaggagtcataatcccaaagcacagcttgcattccgaattgacgtgcaatcgacctaactcgattgtcaattccaccatatggtggtctgtaccacttgggcaggtggtgaccagttgcattcattgcccaaattgaccactgaaattgagcaatgatttcctcgttcgataacgagggaagaaacttatgactccaggtgtgcaatcctaagagatgacccttctgctgtatctgctgatacacttctgggtacttaactacattcagcccaacggtgaagaatgtggtgttgtgcgttaatgctgccagcaatttaggggtagaaggagatgggccatcgtcgaatgtctgcgaaagtttggggcaagtataggcatcatcaaaactgatgcatttgtaacagtcgaaggaacaggtacttctatctgggggacaggttccaaattctcttctagggtcactgacaatgttttcaaaatcgataaactccaggggaatatatggtgggttttcatcaggccaagcattaagcccagtgaaggcatggagccagtcagggaatggttgggttttgaatatttcggtagaatcagaagggagagccccgtcagcattttgacccgagctttcggagaaagctgaaactatcagagtcaacaaaatgattatatactgtgtcttttgagtcatttacgtttgaaatctctttagaaccaggttgcttttgtggacttttttatatcctgtcaacgaggagaatgcgacggacactaaatccgcgactgggcatgtaagggtccagttatgcgaactttcatctgagctttcctaaagcggattaaggtcaacactctgaatatatgctgtgcatttccagcgtttacgtttgaaacgtctctaagaataggcattttgtggacctttttttatcctgtcaaggggaagaatgcctacagacaccaaggtcgcgactggggtattgtgactagagtatgtatcgagtctttaagatagaagttgtcccaactatgatacatgaagatttcgtttagattacacatagtatagaatgatcactaatagataaaagtatattaggctatattagcggcgataaaaatatgcgccctaaatatttcttagttgatttggttaatagggtgaaaggggatggaggaaagagattcttcagaagagtggatgatgtgagcaatcttcagtttttctgaaactcttggaggcggagggtggtttttgggctcttctttgaggatcaaagtttcggaggcacttttttttgatgtggatgaacttttcgaagacgatcttagcttgcgagcagagtttcgtttattcacacgtttctttggaaacggttccttgatatctagtcccgtgtatttcaaaggaattcctgtttttatacaggcttctactactttcctttgacgagaagaccttgttctgccttcagttggtaataggactgcaagtagctgtcttgagatgtcatccgctttgccaggaggtgccatatcaattgatagttgttttcttacatgtaggggtaacctctgtagcgtgttgcctacgtcaggcgctaggcctttgtgccgaatactccgccttagtcgccttgcgtcagtgtccttctccgttttaagaagttgattgtccttgattttatgttgccccctctttctacttggctgggaaccctcctgaggggtccttttcgaagacttggttggttgagagactggagatggtgagtgtttcttacctatcacacccctgcaattggcagattggcagtaacacagttgaggttcggcattctctagccagatgaaattgtaatcgtaagtaatctcatctcctggtattatacctttcgaacctgcaaataatccaattctgggttcgtcctgtacgtaccacttctgaacttctgcattgggcgcacaagaatgattgacgaatctggctactgaaccctttacagtagaatctatcgaaagtccctgctctagagaaagatgatagtagtgaaagactttcttctttgaaagcctttccttaacgacttcttgattaatgacttcaccagtgtattcacagattaactcatatggcgcaaattctcgtatggctactaagccataaccttttttgtcatcaatgcgacaaacacgtgtgccttctctgaacaatgaagatatacctagttccaacgtcgtaaattgggtgttcccgcaactacgtgtctctgatagtttgcagatggtagaatcacattcgatttgaagaattcgattgagacagagatcaccacaattaactctacagttgcaactattgtaatctcttaatgatctgctgtttttgataactttatcatgttcttttgagcttctccaaatgttcttcgctaggttagcccattctgcggttgtagctctgaagttgctgttgggcagggaaacaattttgcgtttctgctttcttgtcggggaaacaaactgcaaagcttctggtttgggaataagcaaaaacgataccacttctaatcctctttgactaaaaatccaaagcttcaaaggagatccagtagctgcgctcaagattaactgcatctgcagttgtactttggtgcgacaacctcgtttaccgacggaccagtgaccggggaaattgctatggtctatacatgcaacccattttttgcattgttcaatggacctagtcagtttcctactgggacgcgttgttggagcttcaccgtgttctaatagttcactcagaggtaaatacgttgaatcctttaaactatttctggaaggcctggacggcatatcacaccacatgtagaaggaaaagggctcctcttcgctctgtgaggctagcatgttcaccttgcgtacgacaccggaggtccaagtttatcttttaggtgttaattttcgaagctaaaatagcgagagtgcgtaaaaacatttacactgcttctggatgttgaatcttaccataaagtacagtgaactcgtaagaaaggataaaacaagctcattggtatacaaagaatatagacgaaggagttcaagggctgaaggcatgttttgggtcttcattgcgttaatcctgctgagcaattagcaactagacatgaagaggatcaaacgagagcatcgaagatctaaagatctggtgagccgaaactattagctcgtatatttggatatcgagtccccccaatggggtgctctgtgtagtaacaaaggaatgtttaatgattagtaattgacttagtagaggctgtctatgctgttgttcatattggacgccaaattttcccgaaggaagcgtgcatcaaaaacaatatggatcacggcgagcgaaaatttctaaagctctaattctcggagttaagcacatcaagtgcaagtcacttcgatcgtgaaaaaacgattttttcgtcttggaataaaagctgctgaagttcgcaaggagaaggtctcctcaagccagtgaagagtaaacactggcaaacgaacatgctctagctatcatgggacaaccatcatggaatagatgtatagaaacagagatttatgcacccatcacatgaaaaatgcacccactgtattacgtgtgattggattgtccgtgtgtttcagtggttgcatcggtgagcgcactttgataggacggtaattgctcgggctcctggggactatagacaggcgctggcgcactagttttagcttcttttgaaggtgttggtggtatttccaccggtattccatcttgaggaggaggaggtggaggccccattctccgatcgattcctgagagaagtgtgataggaaaaattgcgaatgttttctttggcctatggtcactgtcaccaaatcgtgctgttatatgtaatgaatattttgtgtaaatgttacacgaataaaaggtgggaggaagatgtctaggcaccacaaccgactctaaaaagtctgtgggaatgcgcagtttggcttcggtttctgaaactggttgtgcatcagccatatctaaccacatattgagttccttggactcaaatactttaactttattagcatgatttatatgcttgtgacccacagaatagaaagtatctctttctaactcaatctcaaagtgcgtgaaacaaactctacccaagaggttagactcaccattatccataaagaactggctcggattagatgtacccagaattatctgcagatcaaggggatgtcctggagttaacgttgctccattgagcaacacaatatcaaagtcaatctctaatggactagatggaaagtcagcgtcatcagaaccctttccaaaaccaaatattgacctttttctgcgagtggttccagtcgtacattcctttctagtttgcacaccacctgatttttgaaatatttggccaacccttttatttggaaagtcaatgaccttctttgcataaaccggtgttcctactggtacatctcgagagatcaaggaatcatcaggtaggaaaacaaaagggacaatctctctcaagttggctttcaataatgcacttcttcgagccgtcactttgatgaaatacttgatgttagcatctcgatacgagaaactgggaggcagataacaatttttatgggctacaaagccatagtaatgcttattacatgctctaccatagctatcagccaattcaaccaacggtttcctgtaacaattggatgtgtcggggaggacaaattcgaagggataggagtactctcctgctatcagatcaaactccgtagcatgggtcacagcttgaatatttttgggaggaaatactttgtcatcatgaaataagaatcgatgagtttcagtaatccagatatacttgttgttctcatgggtatgccttttacggaattttgcagtagctttagagatcccttccaactttacatcaatacctttcaaagatatgtctttcgggacattcaattgaatggtaccttttataatgtcaccagaggcataaacttgctttctgtagagtgggtcaatgtgaattgagacagaagagattgaaaacatacagaggtagcaatggggtaagggttgagatttataggactagataacgttctagtagttgttgatggatgacgtacctgtcgcgcctgcgcctgtttaagccactctcagccgaagcttagcattcatatagagggatgaaagctaggccgtttggttggcccaatcccgctttgaattatatattggcgtctgttgatactgagtaccattctttgtcctagatcaactggttagaggatgtaaaggagcgagaaaattccagagttgggactttttgtgtatgaggttgctatttggagttcctggatgcatacatacactgcagagttagtccctgtgggtatattgcatcgtggcttattccgcatttattttctaaggttcccttacttgaagatctgaatgacctatcggttattgtcacaggagtttctgtggcgatagccaaaaactgataatatttgctagatgtaggtggaatagaaacagatttaaggtcttgaagtcatgtcatctcgacagaagaaggttggctttttaccttcaaactctccccgcaagaataaacagactcatttgaggctcctgcctacaaaaaagaaagcttttgccagcggtgctgctagttcagtcaaacttgttatccttgcatttattatgattattatttacagcacacacgaatattcaccacacacctttcatcacccccggaagttcgcccgctaatgcctgctctctgaactgagttctacaaagtctaaaatccctgaaaacacctttgcctcttccagaatccacgcatctgttgctaacttggttcatataagtataataaggcatggatgtcaattgtagttgggcctccactcttgttctttttggcagtagagtgttcctagcaataaactttaatgcttgcacggtaacttcatttgcagcagcctgctgtcttttaaaatggtccctcaatactcgcccatttatgtatgtgctgggaatctttgtaggaataggaaaccgtttcatagtcatctcgtacgtcggtttgatccttggtgatagttgaaattcttccaatgtgatacaactattcgcgtgagagttatcgcgagtattctagagttgttcccttggatgtctgatgatccactgaagtgattgaagaagatttaaaccagaacatttgaaaaacgctcagtaaattagtttttgacaccctaaacatgtgtgatagactttacgaataattctatggccacctatcaaccttgatttcgttaaacaagattgagaaagttacacctctaaatcttgccaaacaccccaacaccacagatactcttacaattcgctccttatgattggctctctggcaaattcaaagaaaaccaaccagatctttttcctgttcctttatagttaacaaccatgctttccaagagatttctgtccaccgccgctggtaaggctagattcacccagctgaccaatggtttagtgattgcctccaaaaaagttccatccacatacactaccattggtgtttacacaggcgctggttccagagctgagaacccatacaactcaggtgtatcgtctcttttggttcagtctctagccaatgcttccaaagatgccgctgccaaggaaggtgttatcgtagattcagagaactacagagaggtttcttccatttccaccaccattgccaagggtaacgaggcagctgctttcaagactctggagtccatcttgaccaactccctcaagtctcttgaagacgcttcattcatcagagagcaagctaacattgccggtgaaaagtctgatgccgtcgagcttaacccggaacagaccgtcattgagcacttgtactccaccgcttatcaaggaacctcattggccttgccagtttacggtaaaggtgaggtcgtttcaactttggagcctgctgacttaatttccttcttcaagaagagctttgttgcatccaacactgctttggtggccacgggtgatgtcgatcatgagaaattggtagaatttgcttccaagttgaatattactgaaggtctcaagcctcacgttcaacccgcccaattcttgggttccgaggttagattcagagatgacaacttgccatcagcttacgttgccattgctgctgaaggtgagtctctcttatctagagactactttgttgctaaggttgctgcccaggtgaacggaagctaccttaacagtgaccctacttctgctctacaaggttccaaattatccaccatcgtcaaggagaaccacttggcagactcctactaccacttttccacttccttaaccgattccggtttgtggggtttctacacacaatcttccaacatcattaaccttgacgacttgatccatttcaccctaaaagactggaacagattttccaccaccatttccgaagttgaggttgagagagccaaggctcaactaaaggttttgttattgagtaaagatgacaccgttgaaaagttgaatgcttctctgggtatcaacgccattgtttctggatatgaacagtcctccgaggagattatttctagaattgacaaggttagcgttgctgacgttactaggtgggcaggttccaaattgtgggatcaagacattgccatctctgccacaggacaaatcgaggctttgttcgattacaacagattgagaaacgacatgtcccaaatgagatggtaagcaaataaactatctaggagtatgttaaatagaagacatgtttattgtaggattatggtcaagtcatttgtaagacgtattcttcctttcaccaactaaatgtttcattttcgagcataaactaatctactctcttcgctcgaccaacaaataattttctttcaaccttccaccagaaaccccatgttgagagtgtctaatctttctagaaggcttggtgtaggctccttgggaaggtttgttactagccctttgttgcaaaaaacaccagtgcaaatttttagatttaactcttcccaaaacaaagatgtgtatgacctttggatccaatctatacaggaactacgaaaagagttgaatgacaagccgtggatcccagaagtctccttggcacccccaggacaagcaagagcggacatgagagacactagccacctacagtggcagccaactcaagagcagctggaacagattgctgagttaaagtccaaacctattcctctgaaaaatgatcccctcattgaacattgcacaaacctcataatgaaggacggattgaagtataaagcgaaccaatatttgagcaaggctttgtatttggtgtttttacaaaaagaaaagatcctgtggagttacttagaggatgtctggacagcttgggaccattatgtagtaccaagaccatgaagaccggatttgcgaagaatgttaccgttccggtacccttatctacgagacaacgtaacaggttagcattcaaatggatcctagaaggcagcgacaagagggcatcaaaggatttcagtgtcagattggcggaggagataattagtgtgattgatggcaaatcgtctggatttgagaaacggtctcttatgcataaacaggctgctttgcacagagcctatctgaagctcaaataaaaaaagatacacttagtattttatatgtatatagtatcttatttctatgatagatgaactctttttgtagtttgaactggtagagacctatcgtggactcgacgcttcagagaaataggttccatagtggagtcactttcatcatctgaacatgaaagggaaggaggaatgttaggacgagccatagctgaggccaaggaaatcatcctggacttaggagctccataggcaagggcctggagtgactccttccatttggagaatgtctcaaggtcgatgaagagtttgtattccaaatcaactagaatcgcaatttcattctgcatcaactcctggacagatagtccagagacccgtgaccaagtattggcagtgtagttcttatcttgagtgaatttgtaggagagcataagacatgatagaaagattctttttgcacacctaaccttcgtacttctgagacttagtttatgaatataataaagggcaacttctaatacgccgatctttgcctttgttcgtttcaaaacttcagtgatgaaaaattgaaggccccgaagtttagagtcataagattgataaacttgccacggccagtttagttgtagcataatagcagcagcatgaaccagagacaccgaatcgacactctgaatttgttccgatttttgcaccttgtcagcaataggtgcctttaacgccttaacgtgaacgccaaggttgtcattgccagtctttactgtgacaacagtggtggatgacgttgcctgataatcgttaaatatcatagttttgatttacctgttgtagggtatcccacgcaaaggcaggattaaaacatggttgatattattaccgatatttagagctaatagaggataaaaatgacgaaaagggtaggctgactgttagaaataagaattccttcctgggcttctacttgtgcttatatactgaaagcctaatgctaggcattttatttccttcgcgggtgagtcacctcgttagtgtcatagtatgacaccaaatgacacacaaaatagatgtgcgagactggagccgtaggcaacatttgccgggtcggaaatgcgagaaaaaaaaaaaaaaatgcaggccgagcttaccaaaaacacaacatccaacatcctttattatatcaacccactcttcttcaaatggttctgtaataaaatgtccgttgtggcgttgagaacaaactccatactttgagtgtcagtagcacaagttctatgtacgtataccggcttgcttgtcctgttgacacttaaaaatgtcctttccaagtatgtcaccacactatcaacattatgcacatcccctggataatcagggaaatactctttgaagttggtttgctgtaacttctcctctaacagatcaatcttgttcagaaatagtataaaaggtgtatcgacaaaccatcgggaattgcataggctttcgaatagtagtatggcttcatggaccctattcactctttcatcttcaaaaagtgtttggttgaattctgatacagccagcacgaataccactgccgttatatcttcaaagcaatgtatccactttctcctttctgatctttgtcctccagcatctagcactttaagccttgtggatccaatattgaaatctgtctctgttatcccggtagttttgatacgacctttaagaatatctgtatcactacagatataatcaggatccgcaaatttttgaatattttcaaaataataccttgtgctggcttctaattgaaactcgtgtgctctattataacattgttgaatccccggatcatgtgcccacagtaattggattgcgttggccaattgctgtctttgttgcttcctcgcagcaaaatctcccgtaggccttgactctttcaactcttccaattcctggttctctagctctgtctctgcggagtcgcccagcaacctctcagattgttccaaatttctatcccagagggcatctgcttgaccggtacccatcctcttcctccttgattcaccgccatctgaatacttcattacataatccttcaagaagctctcatcaccaatggtacccacatcaagacatctgtacctcagtatcagttttttggcctgcgaaaaaggactatctggttcatcgcactttaagggaatatgcagccttctagcgtgaatcattaggagcttcatgctctgaactgcatcgacccagattatttgagcatactgaagacgctcctggtactggaatccatctttatgtaagagacgtaactgctttaagacggtagacttaccgctttctcctgcacccaggaggatcatcttcaactgagacctctccaccttttggtgagactttaaagatttctcaatcgcatcatttattctcttctgctcatagtacctttcatccatttccatagtgctagctccacaacccattatgacggtgtagaacaatgtagttttcgtgccatgctactgcttatataaaagttttgcggcttaaaagatactgtttcagatcatttgaaacgctctcgaattaattatctattagtacggccgttaatttctatttacagtggtcatcattattatactctaaactgttcgtttcttttcatacgtggaaggttcaaacggttcaccttggatacgtccaatgaacccaagctcttataccaaacagccaggcttggatcttgctcgatgtcgctagcgatccatcgatctaaagccttggtgctctttaaatatggtccgtaaactttgaacaattggaaaaacagcttcaccctctcatctctgccaccaggtagttcatcaagaataggcgatctgatagtggcagatttcaaggacgttaagtccgcaggtgctaagaaagcttcacgattggcatcgtgcaacaacagcaaattctcaaaagtctgctgaattctttgaggaggtacgtcaacagatcctaaggctttcaacagacatctatgagcaactagtgtcggctcaatgttgtaagttttataggcttcctggatcgagtcaattacctccaaactccgccattgctggcatttagaagtcaaaacattaaggaatggctcatctagtggtctgatctgggagtagctgacgataagctgttttaattcctttatagattcagctgaatattgtgggtatttctgaaagaatatattgaagaaaacgttgttgaaagaagatgaaatcattcgaggtaaatacttcttggaagcgtagttattccaagtcttaatccaaatggttttgacccgttcaaagtctcttgtgacttcccaagtattgttcatataactgttgataaaattcaattgtaatggtgtgtggtaaggtaatttgttatccatagcgtcattgaagaagacatctgcagtgtctatattcttacaatagccgataaaactcaaatgagccatggtaacattcgacttttggtgaggcaatggagtttttccgtcattattctggtacaagttgttcactagagacttgaatatttgcagagactcatcgactttattattagaaagacaaactctgatcatacccaacaagaacttaggatgaagaaccttgtgttcggcagcgacattcttttgtagttcaaggtactttgggtagagttcatcaaagttagcctcatgggcatctgcaagaatgggcaacacagcacccagtaccatctgtccttcaaaaatttcagtcaagtttggaatttgttttccgttagaccaaaaggaaatagcctcttcaggaagttgcatatctctgaaacaatcaatcagcaatgaggtcaaagagacattgggactaaacttttcgtctaacaaatcattggaaacttctcttacagatgagagtaagaactcgtacatttggttgttcttagaagaagaatcaaagtctggcttgttctttaatttttttaactccaatctgttcatacggaggccatttctcaaaaatgagaccaagttctggacacgagaacttgtcagctctccactctccaaaagttgtctatatatcggcatgataccgataatagcatcccaaaaggtaggagagacgtatgtgacactttcgctacttagatcatacgtggtgttctgtgatgagtagttatcaaatgctaataattcatttttaaatgcagaatcttcgggtgtttgcacttggaaatatggcctgaagtttttcttattttttttctgattgaaatctctcaacggtcttggaggttcctcatcatggaggatagtagaagcacttgaattagcattctttgaggctgaagctggactttgggtattgaataaccttccagagggagagttatgttgtactagcttgctagaaactctctgtccctgtttagtagagctgtttgcgagtattctaaacatagatgagggattgtttaggagaaaggaaagttttctctcgcttcctaagaaggcactgtacgagggattcgcggaaggcgttccgttggagaagttgttggagatttttgggtttggaatatggggaaccgaacagcggactacattggggcgaaattagtgtcacggagcctctgtgagaagttgctaccccaatatttctactttgatgaaaatcaatgacccaatcacagaaaataggcaacattaccccctactctccgagatcatccgatcatatgtagttttcaagaagtgtcatcagacatcttcaaatcaattggtacactacagaaagtccatctaggtcctcgagaatacaactgttaactcgtttactttgtttgatcagaacaccatctcatttcctccacctggcacgcaaatgtcaaagaattctcagaggtcttcgattcctacatcgcatacgctatggtctccttcggacacggtcaaggatgctgcggagtctttagggatctttaatttgaatgaggaggcagcgaagaacctggcaatggacattgaatatagaatacacgagatattggaccaggcatcaaagtttatgcgtcacggtaagagaagaactttacacactagcgacattgatagagcgttgaaagttttgaatctagaacctctttatggttacgatgtctccagaccactggttttcaaggaagctttggtcggagcaggacagaacctgtattatgttgacgacgacgaagtagactttgaaaagttgatcaacgaacctcttccaaaagtgcctagattcagcacctttacagcgcattggctagctattgagggtgttcaacctgctattcctcaaaatccttcccccaatgacattaagaatatcttacccatcaacagagggtcaatggaaaacatgttttctctcatcaatgatgaggtcaaggaggacaccaatgaagaattcacatctacaggtccctctgtctcatctaatatttctaatcaaaagcaaggactggaagttaagcctttggtgaaacatgtgctttccagggaattacaactctatttcgacaaaatcgtggaagttttgctcaatcaagaagaaacaaaggaagcagaacttttgcgaaatagcgcattgcaatctgtgcgtgctgaccctggtcttcaccaactagttccatatttcatccagtttatttctgaaacaatcacaaagaacttgaaaaatatttcattactgtccacgatgttggagttgatatactcactgcttatgaatgagtcactctttttggaaccttatgtccacgctattattccatgtattctcactcttttactagccaagaaaataggaaatgttgacgacgaattacagaagcaacaacaacttgctcttcgtgaactcagtgcttcccttttggaaagggttattgaagattttggatctagttactcaacattgaaacctagaatcacaaggactcttcttcgtgcctttgtttctgtcaacaacacaaccccaggaacccaatatggggcactattagggctacgaggcttgggaagtgaagttattcgaatagtagtcttgggaaatgtgataaactggagcagcacgtttttggaaaaacttcaacaggaagaccaagtatttttgatcgacacactgattgagacgttaagagtgctgactaaggagggtaaactagtcaaagatatgaaaactgaaaatggaatagataatgagaggttgaaacagagagtgggtgatttaatagctgacaggatacaagcttgcgacgatgctcaggatatatattggggaatattttttggtgaggtatgaggaatttagagaaagcaagcaaattatttattcgtttgcatctgaaaatactggtgaacttactaatcggtcttcttcgtattcgccggctgttgtttggaagaagggtgaactttctatggctatctgttctcctggtctggtcttttttggcgatggcgttggagtgactgtttggagctttctgaaaggttttgtgggtgataatgatgtaatatattcctcctccggtgatgttttaagttgttttatgggagtctcctttacttgaattcttgatttttttggagtttcttgtatttcaatttgagatgcaagtgacaatgacttcttagatttgctaaatataaaggagtcaacttgctgaggtaaagctggaggagcagtggatttttctttttctttatgatgggttgacatgtcgaacattttcctctgcatgtcagataatgctgatccagttctcttgagtgatactggtatgggttggtcaccgcttggctgtgactgagatctttgcacttgagccggccgaggtggtttctttcttttcagagatatcttttctggagatacaccttttatcttggtgtataaatgctttagtagagtaggtaactgcttaatgtagtaagggtaaatcaacttatagaacgtgtatgttactttctgtgaatttatggcgtcgtaaactaacaatttgtcaatatatgcaaggtactttgagatcaacgtttcgtttgacgaagctgaagaggtcgaaatgttgacaaagctactgggcggagctgaagtgttctctttttcaataacagtgcctatcaacgttggaactaattgacgtttactccgtatgcggctcttgaaagggatatgagcaggtttctgagcagggatatgatcgaattcttgtagatttaggatttccagcaataagagtacttggagttgaatctctcttagctttagtgctgttaaatcgtccaaggaatgagaattctctttgaatgcgtgcgttctataggacggttcatccctatgaatgattaacttttcaggggatgtaatattttcatctagatgccgctgatcaaaagtggaagggtcaattaccaaactagacaattgcgccaactttgcgagtttgtcgacagaagaaatgttgcgatatttgataagagaacttttgatgaaaatctgcaaagatgaagtatcaaggtataaacttttgaaatatcttgaagttaagagttcagacacttgcaactcgtcgtaacttggtaaagcctctggctctatatgcaaaaggtcaacgagactttcattttcaggaacgacatcgaaagtcaatgaagactcatcttctaaggtcggttcaatagtacagtcatttttggaaaactgatgatcattatgctgaaggtccaattcttcaatgaatattatacaccatagcttcttgtagacgcgcgtcaacaaaccatattgaaatgactttgatagagtgatattccccaggtataatttgatgtaaaagttctgcatagagtctagttgtatctctgaagaatctaaatgaatagtaatgaaagatttgtggctaccagtggtgttgaaactaaccaaatctttcatgagtatatgtgatgagttgagaaaagagtgtagtgaaggtgcctgcctcaccagttcgaccgtcatcggaactctacgagaacctggaactggcgatatctggaacctcaacatagttaggattatcgtgcgaagaccagttttcagtcccgagttgttgtaaaatggaaagtaacttgaaggataacttatgcaatgtattaggtatggacgagataaaaatacttcaagatgctgttagatgttattatcttaagtaatattaatgatactagtcatactaaatacaggtgctattgactaagtctgataatgaacgtatcacactcagagaaactgtcaatatttcaattatatactcgttcaatccatttccatagttcatcccatagaccatgggggcataaacttagggtattattgttaggcataattgccaacattcttgcagccctttcactgttatttcaccttacttgttcatatcctacgcccggatggctcagattactgtcgtcaaacatgacttcagtacgaggactcaaactgtcccgagtccgctggttggaaagaggatctttttgcaccaaatcatcattcattgaattcgaagaacgtgaaaaattctcagtcgaatgcctccttcttccagcgcttcttcttttccttcctggtttctctttttgtctttcttctaaaatcagttcaatcaagtcagctctgttgataacctttttcttatcaggattacgttcgaaagtccgtttgcctaggatgggtaatgggaagtccaacaggccacagctcaaacgatgtacgaatccggacatcatagaggaataaccggtaagtgtttaaggggccaaatatttctggagaagtttgtctatttgagggttcaaatctttttcggaattcggatgtactggaaagagtggaacctcggctgatgagtaatgtctgatgagtaatgtagtccagcacaacactaattgcttaaattatgggcaacagatttgctacttaaccaaattcaagtgatagagattgccaatgggtgggctggtgtttgcctccctttgtgctgccttcgtcgttaaacctcaccggcatctttaagggtcgctgaggataaaggggacgcgcggctggtatcgtctcaagtaatcccgaaagccgcaaaaaaaaaactagagtacgttcacgcgagtagtggacccaccaaaagactctcaccaacggaccgataccatactgtttgacttatccaggtccagaaaccaccgatatggtaaaattcaaagtggtttgtggaacttaaattagttcggttcaattctcagggtgaccccctttagaaggagtaccatgctgtttgggcaaatggaagaagaggaggatgattcttgaacgatatggctgaacagtctttaacttctcagtccatcgccagtaacatgtctactttcttatcgtttactatttccacattgtctatggtgtgaaccaaaattctatcgttgtctctattcaactcgaaaacgaatatacctgtaatgaacttgtctttattgtcagacttgaatcttatgacgatcttggaagtggatccgtaaaggccataagcatcaatggagtcatttttggaatccgaacttgaatctgaggacttatcgccgtcaggatttttctcgttgacacaaatgtttgtaattaccagttttgtattcttcttctcaatgatgaaccttgtgaggaatgaggttactgtttcccataaggatatatattttactggcccttgaatggttgggaaaaaatgaaaggagtttggtagaatccttagtttgatcttctcgtcaagcaattctcgatcaattgtttcatgcaataagttgggaacttttgtctctagatactgtatcattgtcccaatgttagtttttcgcttttgcctttccaagtcaatctcattgtttagagaggagtagcaacgcgtcgctacggttgctttcagataggaatggggtgaaagcattgaggagagtgtggctattcgactgtacttaggaagtctgcactttgctatattaatcattgcgtcgatcgtatagaaataggagagaaataaggaagattcgattcgagatatacgtaaagtgaggtaacggctagtcaagcaaagaggtctgaacattcctggtttgccgagccgtcttcggtattttttggggtttacagagagctacaatttgtataacaccttcgcccttcgttttaagctaaagggcccagtagtttgacagtttctaatctagagcaatttgatcaccgagtagcaatagtagttccaacaaatttaaaagacttcacatgtacaaaccgcagtaattaacagattcaggatgcccgatataatcaaagcatctctattcctccaaagaatcacacgtctgactgatactggagctcaaacctgcaagtcggcatcatcccagtgagccgctcgaatttttctgttatctaagagttcttttcctccccaaggtaatgaaatgatctccgtttttgactccggagatgctactgtacctgacttgcccgatttctctagcaacttttcagatgacttggttcatgaatacaaaataaatgctagaaaggaagatgatttcaacacttcagacttctcgcacacagacgaggacgatgatagttcagattctacccagcctactactaccgtagggaagaagaagaagaagttctatcaaatataccaggaacctccagctcataagccaagaagacccaaagcaaaaaattttcgaaactatgggaactcaaacacttcttcttcggaagcaagaaaacgtgcaaattgggaacctgggattgatgtccttactacggacgtcgttttgaataccatcggatcgtctatcactgttacggactactctcaatctcgttatcgtattcagcatttggaagttcctcctgattctgatagcacatctaatctgcctctgattcaggcattgtccagtaaacacgaatggggtaaagttcgttggatcaatgtaaatggcctttcttggaacgccatatctaccatctctgctcattttaagattcatagattggctattgaggatatggtagatattcctcaaagaacaaaaattgatcaatatcctgaacacacattctgttgtcttcctcttgtgaagctagttaagatcaaacagtctcaagatacaaaacgccgttggttcaagcttccaaaaagaaagaaatctaacaataaagcgactgtaccgacgcgagctgaactgaacagctcagatgactctgattctgagactatcacagaacggttagcaaaaacagaaatgaggaaaatatctgtaaaactaccttccaatactcaaatatatcgtcgacttcaacaactacagccactaagttatcgaaagttggccattgggatagagcaggtgtctctattcctgtttccagacaatgtcattgtaactttttttgagcattcagcccatgatatagagaatgccatattcacgaggttgactccggatgggtctaccattctccaaaagtcttgcaatccttatattctgatgcaatcaattattgatgccatagttgatttatcctatcctatcatgaccgcctatcgacggaagctatctgagatggaattacaaatccttgacgcacctaaaatcgtccatactagacagctccacttaatgatcagtgaactgtcactgctcaaacaagctatttccccgacgacttccctgctcggatcgttgagagattattccaacaaacactcgattgtgatttctagtaagcagcagcccaaggagttttttgaagactgttccttgtatttagatgatgtcaaggatcatactctaacttacacgaacgatattgacatgatgaccagtcaaattgaaaatcttgtggatttgattttcaataccatctctgttgatacaaactcatctatgcaacagttgtcactagttactgtcatctttttaccattaagtttttggactgggtactatggaatgaacttcgagtcatttggtgatttggagcacaatgtgtcctattactggaagattgcggttcctttctgcattgtgcttttggttttaataatgtggatgccactaaagtctttattgaatatatggactaacaaagttaggctctcgaagagtcacctatatatcccgacgaagatacaatctacgtcaagaccccgtgagcaaactaataagacgtcagagatgagtactggacacccaacaaccaacaacattgtatgatcaggttcctatcttgaagccggtcatccttatactactttttagtcgagagtgactgtgccaacaatttcatttcttgctttgttgccagaagctctctgtaggttaatatctgtaatactatcaacaataataccaacaaatgccaaacgtcaaacttcgaagattctgtggtctccgtgacggatttttctgaatgctgaaccttttcagtcgctttctctggttcttcaacttgttcctgcgaaaaggtgactggcacctcttcatcaccagccactaccaatgtgttctctgcaatgaccaatttcaattgtttaaataaaagctcactaaagcttttttgtccctgtgcagtagacttctcaatcattgatttgatccaactggagcctgtccaatttatgaaatatgataaggtcaactttgttttgttacccttggcccatgtaaaaatgtaacgggtattcacagagaatgatcctccgctaggtacatcaggagatttggtttccgttaataccataatataggaatcgtaatcaaaatgttcaatggactccttcacaacacatttggtagatttgggtccaatagagtatcctaagcttttttgatactcaaaacctctcttattatttacaaactcgccgtatgaagtaaaatcgaacccatcagatttatccattaagaactggtggaacttgatattctctccaaaaagaatgttgaaagtcaatcctataggggcattcaaaatgtcttcgcagagaaccgtttcattgctcaaatctatgtcagcagaagtaggcacatgcgtctctggaccatcagatttgtattcggatttttcttttgctctaaccacccggaccttctgtaattgctgattctcagcttcttcatctgtgtcaatggagagaataatattgttaatcctctcctgatcttcgcttgccatatccctagaatagtgagttagagcatgagggataacgtctgaattttcgttttccaactgtatcttagaaactgatttgctccaaattgtttcaaaaaagttgaaaatggaatctcttgaaataaagctaagaaatgagtgtttcgtatctttcaagttgattactattccgttgggaaatattccagctgtagttcttttttcgaagctgacgatatcctgatgggggatctcaaggtttgtcacccaacctaagatgttggcgttgaagcatatatgtctctcagagacgtaaatacgtccctgtaccaatatttctctgcttagggcgcaactgaaatcatccaaaaacctatcatcaagaggaatgtttttaaaaagatcgtggaatgctgtgtttcgttcaggtgttgcatagcgatatcgggtatcaagatataactcatcagcataaagagatctgtcaaagctatctctggtagaggttcgagtatcatttggacttggtggtgccacatcatcaactgaggaaatgcttgtcacggttttttttctggatgatttacgatagctcagcatatctggtgaagtagcagtgattccattattttcaacagtcgactcttctggtatcggctgatcaatatttaacgattttagttgctcttttgcaacacttttttcaggttctccatttgaatttcttgacttgggagtagttggtgaagttaatgtagtacctgtcctgatagacgggctattgatgctgtgctcgtcgtcttctatgattgatctttcttcgaagtcaatgtcgtcgtacctttgaagttggattggaggcttcgataaaaatggatccgcagcaggagaaggttttaccagaaatgaaggcgccaagcttgaagtagacgacgagtagcttccattcttttcattgagtcttgcaagacgtctgtgcccattggatccgtttctcttcgtcactttaacagaattcttagcaaaactgtcatctgttacctccagcaagattgatgactccttgatgtctactggaggaacttctgcatgatttttttctttatcttcctcggtgtcactagggatacttatctcatctggtgctttgctatcgatcaacgtatcttgaagattatccaacgaagaagggaatgagtaggaccaaccgtcttcattctcgtcatagataatctctttagacatctttgattgatgctttcaagtagaggtgtgggataggtagatgatatccttagaatgctgaaagatatcggaaatctgcttgcgcgcctaaaggagaaagactatggggaaactttgaacgaacaacgaggggaggggttaaaagatgtcttaattatattagtagttttattattatcattatcactattattatggaattggtattactatctgataccattgaatgcaccagcagccgcagctctggcaaaagattcagcagaaacgctctgagtaaatttttcacgctgctccaaacgctcagcaacaaatcccatctctcccttggtgagaagtattctcaaaagcatatcttcgaaagcagcagcgttagcattggaatcagtttcttgggcaatctttacatcctcggctgccttatgcatttgctttttagacccttgtgctcctatggtcttttgtcgagctatcgtcgcagctctagtaagtttcttttccttagagtcaacggttatataaaaataatttctctctcggatgtgctcaatagtcattggttcgcattctcttactttggaaagaatctcaccaacaggtttctcataatgttcagataccttgagtaacagtttgtattgatagttctgtaatttctctagtgatgcaccctctccctcgttgtagaactgttcataacaaaggacatgtaaccattcaaaaaccgtcttcacttcgaggggagttagaggacgcccgaatcctgctatgttcattccagagttgaagttaatgttagaccacaatttgtttgaatttttagccattttcactgttgataataatggaagtatcagatgttcagcagatgccaacacaacattccacatttgaagaataactttctgcaacaaagattcgggtaagatacgagccagaatgtccaaattagagttcaaatagtcaaaaagaggcaagataacatcgattcgttgctcttctgatatcagcaatagtccattcgatccacaagcattctttaatacatctcttgaaaatgcaaactgaatgaacggagaaaactttcctaccattagcttaatgaccctgtctctagcgtgtattagtgacctcctagtctttcccatgcaaaataaagcatcttccctctcactttccaaggatacctgaagaactaaagttccttcagtatcaagattcaaaataagatctcttggaattccattgttattaaactctttggggctaagatgaaacaatgtcctgcctataacagcatcagaactaaatctcttgaatgatttatcccataacgttgctagaatactgacagaggctccaggaaatagcactacctcaaactcttcatcccattctggtctatcactgctaggaattgttctggtacgggcaaacacttttttagtattattattgctgagccacacatttgcatctggggcatccttcccaacaggactcttaattccttcagcttgcacaaccttgatagtgaaaaaatgattagtgtattctttgaaaattgaagggttctctctattcataacattagagacatattccgggtccaatatgtcttcaagttcatctagattttgcaaacattgcactatattattgagagcaacacatgtccgattcttaaaggcatacggttctggaggagttaatttttgtgatcttgtaactgctgctttcatgtcagcaatccaagcagaggtacctgataacagagagtcataagagttagtttcaccaggtaaagttgtagctacatttttctgatcctcttcatccaaatcagcaacaatggtgtcgtacattttgtcacagtatgtgataagagccattgagatgtactggaataacagagtagaaactttagccagatgatattcattcttccaattcagatctttcaaaaaactaacattttggtttatcatcatgaatatatccttcacagacgtactgtataatatgtcattttcaggagatgcacatcccaagtcatcctgagcaacagcagtgtttgtcactgcaacgatttgctctgaagcattgatggcccaatttttgagatacttgtaaaaacctttctctagatcaaatttgaatggcgtatcagtaacttgggtgaatatgtctcggatctcgctaagagtcttataaatatctaaagcgtcagcaaacgaaatgtctgccgaattttgtttaatacttttcagcatgtatttagcatcaactgcaaaatcagtaattatacgtttggcataggttggtgcaataggtatttttccgagaagagggtgtttatatcttttttgcaacatctttgtatcttcaacaatctttcttgatagatcagcaatatgaatcaaatcgatggtgttatctgttgggatttctgtaagcagatccttgtatctcaaaagaatagtatcattaagtttatgaattagctgcttctcaagtttatctgggacatgtttggcaacaatatttctgaagagagaatcctgttcaatctccgctaagacattgagatattgagaaaacggtggttttgaagtcagcacctgtgagatgcaggtctgaatccccttcatggtctttaaatagcatatttctaaacaatctatccattctaatcgagttttacttggccatgttgatttatcgatggagagttttaggtctgtcaaatactttttcataagattcaataccagaaaaaatagatcggagtttatggagccatcactggtactcaaaacagtagagcatgatgttttgaaaaaatagatcattgctgtaaatgcatcaatcctccagattttaacgcattcttcgatcaattctctggatgaggtagacaataatggtgtgtttgaacttgcattcatccgtgagtcgtatcgcatacacttttctaggagagtttggtaatacagagcacttgatctgggaacaaggttgaaaaaagccgaaggttcacacagattgactggtttggaatcaatctggctaatataattttctgtgtttaacgattccaccttgagccaattagtaaaagaactggagtctaagaaatcccgtttctgatagacgagatgttgttgtttcagacagttgaccaaataagtcttttgatcgtgaattatcttgtccggggtaatattgtttttcaaagaaagaatatcattttgcaattccttatcatcgatttggaatatagcaccaacgtgctgcgctaagctcatctcggagagcttgaacgatggcataatatactcaaaatcattaacgttgtttgaagaggaagataaagtaaatctagcctcttgaagttttttcataatagaatcaccttctttatcgttcttcactacttcttgcattattgataagaatattgtagtttgggtatccaaggaatccataaacatttgacccttcaaagttttcagctctctagtagcaattaacataaactgcctcaagaagttctctggtttctctatagtctccaattgtttggatttgtccagcttagttagataagtcaaaagcgcgttgaaaacctgggttgataaagatgtggagataagtttaactggtttgccctttttcaacgggttcagatattttcgaagatctgatatagtcctagaggagactttgatgaccttgggcttcttgaaatgggaatcactattctcatcgttagatacatgtcttggtaatactctttttctaaaccgaggctcgaccctgtacgaagctatagcaactttcagaatctgatgatactgatccattgctatctcatcaaatccagtccccgaaatggaaagggaactgatatcgacagacatttggcttagatgtgtaaatggggagtaacggttatacatctttaaaacgcgataatgatgtagggaggaatgcagaatgtacatgttgatctaagacaacggagatgggatacatgtattattggacccattccatatattatcaatctcaggaatatgtatgactatgtatgaatatgtctgacgttgtaatgtcaataaaccgaagtattagagtatgtttatgctctaaattgcgataggagtacagtctcattattctgaatccagttcagaatcggatgtagagctcccggaggaatcgccagtgttggagctttcgccgtcagaattactgctatctgactcgttggtggaagagatatgttctgtggttgtattttcctcatttggtgtggctaatcgtccattttcatcgatccatctcacgacatttcttctgaaggatgggtaacttattttgctctgtccaacaacctgtgatagcagtccgtcaggcaaaacataattgccatctagtagcccttttttcacgacatagcttcttattctttgatgaatatctaatagcagcagaggtcccttcccaagaacatcaactagcaaaggaggtatctgtttgtaacgaggaatcaattgatctgtagatctctgtgtttgaacatctaggatttcatttttactcaagggtcgagtatatttgaatattatctcacctatcttatctaccggcacaatatcggactccaataacttctttaacggttcgtcacaatgaatttcgtttttctgatagtcaagaatttcatgaaattttgcatagttttgtattctttctatagcagcctctgcagatagaaactctgtgttgcaaaaccgtgccaactttccaatcaacctcaaaccaacaggtttcttcttcttacttattctagttggctgaaactcagggtcatccgttattggctgaaaattgatcttaagcgcaagtgacagattctccttttctatttgcgcatctcctggggttctgagatggtctctttggaggaaataaaggaaccttgattcaattaacgactcgagcttctttctttcctgctttccaaacctgtgaccaaagagttcctgagttctactagcaatatcattgacgcttacactgtctaagtcgcagcattgtatcatagagtcaatgacaactttatactgaagcatggattgtacttagttggtagatagtaccgttgttcgcgtcaggcacactaggatagtattacataagcaagattttcttcaaaaatttcagatagtctatttttcctatagtttagtaacattagtccctatgtatcttcctatttgccctttccttgagctttgaggttcttcttctgttgcaattcatacttcttcacaagcttctttctttctgctcttgccagagttcttgggtctatcagagtatccttatccttctcttcagttttctcgttcatctctaccaaccattggttgtccagttgcttattattacccttgtatccccattttggaacccattcaccactttcttcatcgtaaatcatctttccagtcttgcccttggcttgaattcccttcttagcagcaaacttctcccatctggtcatttctctaggttttggtactgacttttctcttggcaagggtgttgatggatcaggcaacgtaattagcgctatagaagcctcctgtccttcagatacagaatccgtagtatttcggactggttgtgataaaatttggttaattaaaagctgtgtgttatctctcgtaacctgttccaggtactcattcacttgcgaagcatctgacaatttgttggactccaaaggattggaatcaaagactgcaaggtttcccaaatcgtaagcaaccggaataggcttatccacagtcgcactctttccactcattgttaatctaaggcgagtgatgctataaaaattttttgaattttttttttcttgtggttagtattttactagcaggccgccttgggcgcgaagctcctactcattttctctccgtccctctcaagtcaaatcacacccttacaccttttaacgcgtaatccgaacagtttccactccaaatgagctctcattgaccacgagagtttttcctgagaattgctgtgctcttttgattgattggtttatccacacgaagagttgtagtttgagtaaaacctcaacaatccggcatttggaccatggcatcaaatgactcaacagaagtcccccaccgtaataagagctctatatccatgcttcttaatgagtccagtgatactcctccaccctcgtatttggaagcctttgagaatagggtggcaagccttgtggccttagacggactggcaacacaggattcaaacatgctcaaatatctttacaatgagttggcactggtcagagaacaagatctcaagtcagaggccacattgatttccaagattaaggataacttgttagaatttgatcctaatatcgccgaaaagcttataaaaagggcaaccggcgcaaaccacgaccaagttgatgaagaaatagaacccatcgatgacggaactactacggaaataacgaatgccaaatcaaagagaggagctgcacattcgaaggctgatactgaagctcctgccaaacccaaatcaaggaggcgtaagaatatctctgcatcagcggatagtgaggacaagccgaaaggaaaaggtgcacagaaacaggataactcaagaaatggcaaatctcataatggagacgaagagttaacaaatcaaggctgggatgaagatgaaatacctgacgaaaactctcatcccccaagaaagcgaagaactgctgcttccacaaatgccgaggagggaagacccaaaagaagacgtaaggctgcaattatggcctcttcaaaagcccgagaactgcaagaagaccctgctgctttcgaagaggaagactcaccaaagcgctctaatgtttcagtgaaagaacagaaatctattgacaaacaatatgacaacacatacatgtctatttggagagacctttccagaaaagatggacctagaaactaccgtttgtttcaaacttatactcagactaaagcaattaatctgaaaaagacggctttgctggctgcaagggaggctagaagatggcaaattcgtaccaacaagtctcaaaaggatttgcaaacgaaagctagaagatcgatgcgtgaaatgcttaacttttggaaaaagaatgaacgtgaagagcgtgaacttagaaagaaagcagagaaagaagctctggattcggctagaaaagaggaagaggacagagaagcgaagcgacaatcaaggaagcttaactttcttcttacacagacagaattatattcccatttcattggtaacaaaatcaaaacagatgagcttgaaggaaatatgggtgacaaagcattaacgccctccaacggtacggatagatcacatttggaaggcattgatctctcacatgcaaaggcagactttaacaacattgactttgaccaattgaatgatgaaaacttggaacagactgctgctgccaatgcacaatctgccttgcaggaaactcagagaaaggctcaagcattcaataacgttgatcctgatgaagaaatgaatttccaaaatccaacttctctgggggaaataactatcacacaaccaaagctcttaaattgtaccctaaaagaatatcaagtgaaaggtttgaactggttggccaatttgtatgaccaaggtatcaacggtattttggcggatgagatgggtttaggaaagactgttcaaagtatatccgttcttgcctatcttgcagagactcataatatttggggtccgtttttagtggtcacaccctcatctacgttacacaactggcaacaagaaatatccaagttccttccagacttcaaagtattaccatactggggtagtgccaaagataggaaagttttgagaaagttttgggataggaagaatattatatacaacaagaactctccttttcatgtattggtgacttcgtatcaattagtggttcaggatgctcaatattttcagaaagtgaaatggcagtacatgatcttggatgaagcacaggccatcaaatcatctcaatcttcaagatggaaagttttattaagttttcaatgccgtaacagattgctgttgacgggtacccctattcaaaattctatgcaagagttgtgggctcttttgcatttcatcatgccttcactgtttgactcccacgatgagttcagtgaatggttctccaaagacatcgagtcgcatgctcaatcgaatactcagctaaacgagcagcagctgaagagactacatatgattttgaaacctttcatgttgcgtcgtataaaaaagaatgttcaaagtgaattaggtgataaaattgaaattgatgtttattgcaaattaacaaacaggcaaaagaagttgtaccgcacacttaagtctcagatctcgttgattgatttgatggataacaagttctttgctaataacaatagcacagaatcagattctttaatgaacttagttatgcaatttaggaaagtttgcaaccaccctgacctgtttgaaagagctgatacgaagtctgcatttcattttggaacgttttccgacaccgcttctttcagtagggagaatttactgcctgttttggatgttttctactcatctgcaaatgtgataaactatagacttccaactttgttgtatgacgagattttgtccccaaattttgaagataatgcccagttcttgaaacagcatttactctacaatggcaagcttaatatttggaatgcgaagcatttgcatagagatgaattcaaggaccacggatggctatcattactagaactgacgccagatcaagtagtaaggaaggccaagcaaacattgtggcaaaatttgttggatgagtctgataggtttgaagctgaacaagaattaagacctctttacagcattcaaagagctgttcaccaagatatgtatatcaatacgttagacccagctgcgtttccgcttgcatctgccccgcctatagaagttagctgctctagacaatccttcaatttcaagcgaactgacagcctattcaacgccaagtttatgaaaagtttattcccattgtcgttgaacgaagaatatgatctgctcgtaaagaaagttgaacctaagaactatccaccaagcaatttgtatccaaaaccagttaacaatttgattggctattcttctattagactcccatcaatggaaagatttgtcatcgaaagtggtaaattagctaaattggataagatgctagtcagactgaaaaaggagggccataaagtattggtttatttccaaatgacaaaaatgatggaccttatggaagagtttttgacctatcgtcaatacaaatatattcgtcttgatggttcatctaagctgagtgacagaagagatttggtccatgattggcaaactaagccagaattgtttgtattccttttatctaccagagctggtgggttaggaatcaacttgacagcagccgacacagtcatcttttatgattctgattggaatcctacaattgattctcaagctatggatagagcacatagacttggtcagacacgacaagttacagtttatagattattagttcggggaaccattgaagaaaaaatgagaaaccgtgcgaaacagaaggagcatgtgcaacaggttgtgatggaaggaaagtctggcaacaatcctgcctttgatgataagaaagataagcgagaagtggccatgatgctgatgggaagcgatgatgaattgaataccagtgccgatgaagtagttgtcagttctacagttgcataagaaaaaaaagaaaacagatgcagttatattatataaataggtaccgtgcccccagtcatgtattcattgtaaattatagtaatcccatttcgtggagtcgatcacagtgaggcaaaggaaatttttcagcttgttccaattgttcgtaatttgtgaagaaaaagcctctgctctcatcaataagtctgttcttgtgattctgctcccgctcacaagagtctctaagagagctgatatggtagttttccacaaacttgtcaaacttgctgagtttgtgaccctcctttaaagatttataagagtctttggtgatataaaaagggatgtggaagtttggagtagctctttgtactgtatatgggtctttcctttgcattttgaaatttggatacgaggtggaatcacgttgggtgagcagattggatagcatggggagcacaaacaccagcagaatggggagtaactgtttgatttgttcaaagaacggctgttgttgtctttgctgttgctgctgttgttgagctcttggtcgccttcttggaacttcttcaaaggggaaaaacccgtttccaccaaacgtgaaaactctaggttgcggcccaccagctctacccatcccatttccaaagaacatcctgaatatgtcatcttcgaaaccttgaggcatttgggctcctctaaattggccggaaccaaaaccggcgggaaatccattggctgtgggagccgcacctccaccaccacctcctcttgagtcgggatcttgaccggtctggtcatatatccttctcttaccctcgtcactcagtacttcaaaagcttttgcaatcttcttgaaagcttcggcagagtttggatgtttattcttatcggggtgaagtttgatggcaagttttctatacgattttttgatctcaacatccgtggcatttttttccacgaacaatattttatagtaatctgtacgatctatacgaagaagcttgacgactagttcctcttggtccttggtatattctttttcactcatgttgtcgccactttgatgtcaactggggacagtgaaaggagtctgatacaggtgtacgaaataaaaaggcgcgaaactggaaaattgcgatggaaatatctaggaggaatcgctaagcagaagagggtacagtacgtactgccttcctgggggcccgtaccgtaaactgagagggaaatcttagcaaagggagtagacgcactgataattctggttatcagtgcgtacgtacggagagcagctagtctgctggattgacgttctggattgacgttttccaaagcgagtaaagggggcagatagttccacaactcatcagtcgtgacgagcaatctcggaaatctttatcctatgccaaaacgttaagtgacaaagccgatcttcaagaactaagacaagaacgggaacatgatgaaaataaaagtaacaacttggccctaagaatagccaatggggagttgccaagaaccgatagccctaatcagcctcgtttagtcattccgtggataagtagtaggtaacagtttctgagtatctggcaggaaactattgcgtgagaaatgcataatggcccccaatatattaatcactgacgtaatcaatattagcgaacgtgtcttcgtacatgaaaacaaacacagttaccagcagaattaaaaccgaaaacaaagttggtcacataattggggcacagccctagtcaggaaatgatgggtgaattgcgaacttcaaacacggaatcaattgactagaatgctccattgacttagtttatggcttgacacaattcacctacaaagcaatttctatcagacatgcagaccgtctagacttctattgttgtttattttcgatgagtcgcggcggtagatagtatagcctctttgacttgcaccctgcgtggacaaacagatcgcgcctcccttgatgttgtgtgttagctgggtatgtacttgtgagcaacaatattgcatgcatgcaccctgtatggttcccctaattggactacggctgactcaaatttcttgggatttcttataaaagggctagagtcctggcccctcatggattctcgtccattatttaatataaccttgtttgtcacttaccaacacatatcctatcaatatgtcagttctctcaaccctctctagcagactcagtgctataattatcagaagtgttacctttctctttgtcataattactttgggattgtcagcagcttccatcaacaatatgagctactcaagaggtaatttccttgttgctacaagcgtgttttcactggttcatctaggctatgttgggccttatcttttctttactgattactctacacagattccacctttcttcgtggctatttttgagtacatcttgaacattttctggtttgcaggatggattgctatggcagacttgtggggagacatccattgttctagaagaaccagttatggatggggctactatcagtttggatcccgatgtcatgtttcaaaagctgccgtcgcctttggtgccttcagttgggtcatgtatacactctctgcggtccttgtgacaatcaacattgtgattccaattgtcagaagtggcagttacctttctcaggtgcgtgccccagtcggtttcttgacattagaccaatctccagcaacagttgcccccacggttggtgattttgagtccagtcctgcggacaaggaggaagcaactggagatagtgttgcttctccagtggctccagctccagtggccgcacctcctgcccagaatgcttagtttctagttttatctgtcaattttttactctaatttgataatgctaaggtgactatagtttgcttctctcaactaagtcctgttttcgtcctaattcctatttattcggtttggttataaatccgatccgagatcctgtactgtcaaaaccctctggcgaaccgcccgcatcagtcagaatctgaattgtcacctaaactctctatcaaaacgcttccattaggccatagttctttgacgtctttcaagcatatgtccttactaggtgtcagcttataacgaggcaatggtgaaatcaactcgaattcaaaataatgatcgtaattggacaagtcaatctccgaaagctgtgaaatatctcttttaaactcagcaagcagttcttcttgggttattcctttcttctctgattcttctcgcaaatgtatcttactatcaacaaatgcgtagacgtcaaacaaggtgctactttgtgaaaaattttgaattactcgcatcccttgatgattacgaaactggatagtagtataactatctttgataagagaagggtgatcctctattttgagacagttggactttaaaaacaattctttggccaactcttgctggatcaactccacttttatacgctcccgttctctatctttctgtaaggaagcttcgtaggcttcgtcttgttgctgtcggataagccttgcaaaatcttgctcctgcttatcatatctctggctgaccaattgaggctcataatgatcaatgaaagtctttagtcgattgcagattctctccggagtactgctttgaatatgggtgtgatgtgacttgtgaacaatggacatcaaaggtatagtgttactcagggctgagaccttggctgcaagggaaatgtgtggtagagtgtgcactccatatgtctttcccacttcaaacgcttcagcataattaacatctccaagccacaacacgatgtcattctcatcgataaaacgacaaaattcagggctattcagcactctttttaaaaattttgtggtggatactgtgccagacttgacaagaattataagaagccacttcagttcagtcttggcatattcaagtgcctgattgaactcaccggagaaaatattcaaatcgctaggttcaccaatcacagattgaaaatagtcctcaaacttggctggtggctgcgtatcctccaaataagaggcttctttggaaccatctccttcctcttgttttatatactgatactttggctcagacggtatttcatctggattcttaataccttcaagagccttcaaaaacccgggaaatatccagttaagtaaattagcaatgcctgttcccaataagaaaaatgctcgtggtaatagcatgaaaacaaagatgacagttttgaacggtttacgcacctgagtactttggggaatctgatctgagataaggcctccatgaaatttccaagtatcagaaatcggcactgctttggggaatttcggcatgatatcggacaaaagaacattttctgatgagaaagaggtaaagtcaaaatctggctccactgtatgagggggttcaattggaatcggttctggaacatcaatattgccatcaaaaaatcttgaaatggcgagatctaagttccacgacgtgtgttccaaaagtcggacgattttatctgtctgttcatcttcaaatgaagttacttcctgaaattgtgccagcttttcttcttgttctggagttagcatcttgcctgttagttggcttggtatctaataaggctaacgacatgggtagatagtgaaagacacgaagtaaggccgatcgatgggcacgtgatacacttcacgttatcaaatggtcacctgacctagatatttgtatttgtcaaagagctgtgctttgtttactattccagcttaccttttcagccaggatgacagatagttcgtcaggtctagccagaataaaagttttacacgagtaaggcctttgattggcagggagattgaaaatggtaataatagttgcatagttgaaatgccggatcagcatacgacggtctggacatcacgacattcgacccaggaatcgaagagattccaatttcacagatcactctggtcatttgaagaaagtgatcctcactacgtaagtcaggatgccttatatcagttgattggacaggacatgttaaacaattgcctgaatggttacaacagctgcatttttgcctacggtcagacaggctctggtaaaacctacacaatgatggggaataagttggatgggctggtcccttctcttggacgagaattgttcattttaaaacaaagtatgctggaaaaacagaatgccctgttgcatctgaagatctctttttgtgaaatctacaatgaggttgtctacgaccttttatcgaatgacaatgtcaaactcagagtaagggaaaccaaaaatcacactccctacgttgaaaatttgcaggaattccccctgaaagactttgaagagttgatgagttatcttaaacgaggtagtatgaaaagaaagactgcaagtacaatagccaacaaaacatcctctagatcccactctatctttacaatcatcttgcagcaggaacgatatttagatgaaaatctaaccaaacacgaaaaattggagtcgcatttgcgattagttgatctagccggaagtgaaagaactaatgtgcacaacgaagcacgtttcaaagagggaagtcatatcaacaagtcgctgactactctgggaagaatcctcaccatattatcaaattcctctagtagaagaggcaccaaaggaattccctatagagaaagtgttctaacctggcttttgaaagagagcatcggtggtaacagtcaaacagccatgatatcgtgtctttcccccaccgaacatgaagagacattgtcgactttgagatactcagaaacagcatctaagatcacaaatgtggtaactcaaaataaatcaaaagttgagctagaaggtgaccttcaacaactggtaagcaagcaagaagaagaaaatatgaaactccttcagtttattgagaagctccagaagggggattccggtctcagcaccaagaaatatcaagttttacgtaaccgcatcaagtatgagcaaaagtacattgactcactaatgtacaagactaacctgaccaaaaaactgtattttgagaggatgtctgcaatggaagagtactcaaatgagttactaaagctgatagaagttcacaacaaagatataatacgaaagaacagaaagatccatgagatatttgaacaaggtgatgaaacgaagctggagcaagttcctatcaacgaaaaggaagtttgggatcctcaggtcagttcaatgatagaaaagtatttggatgaagatgtatatgctctatagactatttacaggaagagggttgtatctggacaggaaagggccagccttcacgtccccaatagaactcctcaaaatagaaatattgatgatagggtgagaactaaaataaattcgataaaacaaaataacttaccatatcagggattatcggaaggaatatcatgaaactactggtcatcaattgaaaaaggtgagatccaacattgactttgagtacaagctactgctcatataaacataattcaaataaacttggctactaactgagacggaacaacttgcgtaactatgaattcacacttgccattcttgctttgagggcatactatatcaaaaaaattaaactaacacaggatatggatatttttcaaattcaagctctggatggagatctgtctcttggtgggtaatctcttggaggaggaggagcatctcttctataatcatctctgtaaccatctctgtaatcatcccttggaggaggtggaccataatcatctctaggagctctatattcatctctgtagtcatctctaggaggaggacggaactcatccctgaaactttctcttgcaggatagccaccacgaccacctctaaagccgcctcttggttcgtctctgaaaccaccacgaccaccacggaatccaccgcggaaatcatcccttggagggtaaccgccacgaccaccacggaatccaccacggaaatcatctctgaagcctccacgaccacctctgaattcgtccctgtagtcatctctgaatccacctctgtagtcgtctctgaagccaccacgtccgcctctgaagccaccacgaccacctctaggacctccacggaaaccacctctaccaggcattggaataaaaggggaagtgtcttcttcagcagttaaagtgtgttcctccaaaacaataccattaatcttttcaacagcagcttccaactcttccctgttgttgaattctaaggtcgcagtaggtggctcgtcgtgtctgttcagacgggcaaaggtaggaaggatatcaatctcttttgcaataaaatctttcaggtcttgccatgcgatggattctggaatattcgttacttttaccctgttttcaccacgcttagcataacttggcttctccttggcgaactcgatctggagatcttgatccccaaatggagtgttgtttaggttttccaaagcagcggaagcatcagctccttcttcatattccacaaacgcgtaaccacgcatgattttgacttcctttatggggccaaactttccgaagagatcttgcagctcttctggcctaacatcaccaggtaatggtcttacaaacaactgtgatgtggataaatcagacatctttgattattgttgggttgtaaagaaggagggagggaaggtggcgtttgaagaaaaattggcacactgttctgggtgttgcactacagtagtgtattgtccagagtggatgttttgggacgctttataaggagaaaacggctgtaaaagacaagcaagagatgagaatactcactgagctttgaagcctaaagttcaaggtttaagtggctaatatgtgaataataataaagtgaagagtaacagtctaaacaaaggtcaaaacagaagttgatcgtgggtgcacaaagctcaatgattggaaggagatctcgcgaaccaagtcttgcaagggaaacttctgtagctcatctcatctcctattgtcttgtattgtaagcaccgcactcgttgaatcttcagcgttctttgatactcatcgccgatacacaccacaaatggacctgaaatacggtgaacataaccgccagtcggtacgagtatatcagccacctaacaaggataaaatctcagcgtgctgtattttcatccatggaggagcctggagagacccttcaaacacagcggcagactttgatgcgtttggcaatgagttatcaaaaacgggaataatttgctacagtgttgactatcgattgtcacccgaaattaagcatcctgaacacctgaatgacgttttgaaagctcttaagttcattcactcggagatcaatgactttccatgttgtttgagcgggcattctgttggagctacactagttcttcaatcattacagcattctctgccgcttaacatcatgttggtagtactactggatggaatctacgatcttcctcaattggttctagagtatcctgattatctctcctttgttaccgaggcccataaagatcgagactgggagacggtaacctttgaagccgaagaattgcctcaaacaaacttctttttcgtgcatagtactgcggatgaactgctatctcctcggcaaaccaaattgttggtgaacaaactggaacgtaaatttccttcttccgttttaagcgtaattgcagatttcggttctcataattcggtttatcaagatacaaaagtgagggccctacttctcgaacagttgaatttcaagttaaccaagcccactacacttccgccagagcaatcgtcctatgccgccactcgacgagaaggcttatagcctgactacagatagctctgcttctgattcctacttacgatataatgaaaaggatagaaacccaaatataatcttggacacggatcagcatctggaaggtacggatgatactactcttttgccggtagaacagaccaccttgaaaactgtttcaataaagattgaacagctactacaaaactgtgataattttgacacgcttgatccgaatgctaagtcggaggtcagtaatcaattacggcaattgctggttgagccaaagtatctcaatggtttcagaaaaaatgcagcagcacctaaggcctttaaacggttattcagagcacaagaaattaaagatagcaatgaacccattacgaatattgaattcagtcccgatgggaaatacatggcatcatctggggatgatggcgtgctgagagtttacaaagtcatctctaacctgatcgaaagaataaatacagaatacctcgatcacagggaacattcatctacgaatcagcaaatagcctcagataacgagtctttaaaaaacgggtcttccattcatatggcccctgttttttacagcaaaccttatagggtttttgaaggccactcagctaaaattctatccctcaattggtctcagaataactttattctaaccggttctatggaccgaactgtcaatttatggcatgttgatagggatcaagtacttgactcctacgaattggacgacttcgtcacaagtgtcaaatttcaccccactgatgaccggttctttctgagcgcaacactttccaagactttaagcttctggtccatactggaccgagaagccctttacaagacaactgtttctgacttgatcactgcaacatgtttttctcctaatggtgagcacttacttgtaggtacattctcaggtaaatgtatctgcttagtaacccgtggacttgacgttgcctacgagtttgatctcaaaaattatactaagagaaggcatgcctcgtcaacaggagaaagtggatcaaaaattactgggataactatacatttggctaagaactacagtcccatcgtagttccatccccagctccagtaccacatataccgaatggtatggattggaaagttataattgccagaaatgactccaccatcagaatgtttagtttcaacagtaggtctctggaagtcaaatacacaggctacaccaatagctcttctcagataaaaccccatctaagcgaagatacccgatatctgatcagtggctctgaagaccattggtttcgaatttggcacttcatagacaggaagaaactgacccaagcatataaggacaggtataaagacaaatctggtaccaagaaatatctgctctcgcagcctaaagaagcggagaagaaaagaaggttcagtatttccagcactttggatactttcaaagatgggtactgtctgtacaaagaaaagaactgcatatcctttcatgcccaccattctcaatgtaacgatgcggtatttgctcctattgaaagctcaaggatattggaacgcagcaatgactcaatatttttactctattatgctattgaccctaagagaccacctccagaccttgcatcatccataatagtttctactgataatcatgggctgatatcagtcttcagaagagattttgcatataatattaaacgagagcttcattcaaaatattccaatgtgttaaactacaataattcaacaacttgcccgaaggaaggatcagtgattgcgagtttgatcaggaaggttggcccgtccagttcacgtcatggcagaagtcgtagtgttagccaagaacggagtacgttcagcatcacgtgacaagtattaatccttttttttttacagttttttccggccgtattatcgtttcaatcgtcatttaggtgtacgccttcatttctaagttttatttgatgagtgcaagaccccacaagaaatccgcctcgcaggaggtaagtgttattggtggtttctttgggggaggtattgctgcttgtggtgcagttacaataaccaacccaattgaagttgtcaaaactagaatgcagcttcaaggagagctatcagcaaaaaatgcacatgttccaaggccttacaagaacccaattcaaggtgttctggtggtgtatagaaatgaaggaataaaaggatgccagagagggctggtttctgcatggatttaccaattgggattgaatggatgtcgtttaggattgtatgaacctattcggaatactttgaaccgattaatgtatccatcaagagacccccatacagttcaaaacacagcaattaatgtaatatctggtgctgtttctggtgctgctggtgccactgttggttctccgctatttctggttaagactcgaatgcaatcttactcgaattcgatacaaattggccaacaaacgcactatcgtggtgtatggaatggtttgagtactatttatcgtcagagtggattcatggggctttttcagggtgtagatgcagcaatcataaggacagctgccggatcttcggtacaacttccaatttataactttgccaaacacgaacttttgaagaatcaaataatggaagagggtacaggattgcaccttacttcttccctttttgcaggaattggagtatccgttgttatgaacccctgggatgtgatcttgacaaggatttacaaccaaaagacaaagctttattcaggaccattggactgtttaatcaagatagtcaaagtggaaggaattatggctctttacaaaggatttgaagcccaaatactcagggtggcacctcatacaatcttgtgtttggtgttcatggaacagactatgaaactggttaaaggggtagaaatgactttattctctgcgttttagccgagtcaggtggtacttaatgtgtataatattatcgataattgaaacgactaactattcgattcgtcattcgaactagtgttattttcttgactaaaatttatcgaacgggttaatgctgttcgctggaatacgaatgaggattgtacctgttgatgagctcttaaaagttcgttcaattctcgttgtagagactgtgcttcattttgcaaatcttgttgaagatcttgatcggtagaatcctcagcttcttgttctcgttgcgttgacaccaggtttgattccacttcagacatacgtcgctcaatttcctctaattgtaaattatagttgcggagtaagtttgttagggccaaagtttgttcgtttgtttgtgattcgtcagaactttcaccagaataagcctggatcctttgcaaaccggatgctggggttagtggacgagaactaaatcggggtgcctgagtaagcctccttcttaaaaacatcgatccatgatccaattgatgttcatcgctggtttgttgtgtgttgatattgacactatcatctctcggtatctcctgtgtctgtgttgataattgagactgtgtttctgtttcagtctgtgaggatgtttgctcagtttgtgaagaacattggttaacagaactagaagctgacgaaccagattgcactgccacacaccaatgtttgtgatactcccaagctttcgattgacactccttggagcaatatttcgttcgtttacatcttcggcacttggcaaattgtttaggcatggtttcccattttccacaggatatgcaggcacattgcctcacaccacccctcgtttcgtcttttcgacaagaatttctcattataacaccagaccagtatgaaatgtccttcaagtactcagatttgatcgtgaacttctccacaagaggaaaaatattcaattgcatatatggtaacacagccgggtcaagatcctgcgatttacggccatcttcttgccaaaagtcataagtatcataacaccattgagaagttaatgcatcatgctcttctttcaaaagatctgagtttcttttctttagcctgaccagctcgtgttgtatcaaacaatcgagattaactttacatttgatataatcggttgatttggctagaccttgacttttttcatatgagttcaagtactgatggatgtcactgagagggttagtatcgtcaaaagcagcgtcaacgtccatcattatatgatctttctgttcaatatcctcctcataagaaacacttcgaatatcatcatccatttcgagtgctggcaaggtgatgttattatgaagtggcgagttcttttgttttgtgccttcttcctttgcacgaaggctcattcctttgatgatgaaggtattactaagctcatgcctcaaggatgaatatttggatataaaagcaagcagctgcagagaccaaagcacatcatcagctgttggtactaatataccgttcttgaatactctggggaattggactgaaacgttggggtaaagaatgcgaatcaatctcagttgggtcgaatgcctgaactcttttaagatgctctttctgttcatgtttgacaatatattgttgatagcgggcgtcttcacaacttcggagatgatattatcattcaaatccgataaattcacgtaatccagtagctcctgagttgtatttcccgcaccttcgtttaagtcagttaaaaacgaagcaaaagaaagtttgtcatccaataaatcgttagttggagaatttagcggattttcgtcattgttattgttaagtattgacacacttgatttattttcaccaatatcgtcaatactattcagctctagaggtaagtcgttaatgttcatttcatttccagtagatacaattgtatgatcttccattactgcgtcagctggagagacattaccaactggcccagattctatcatgggagtcttactggtactagtaacattagaattaccgttactgtttccctttgaggcttggtagaggtagttatctaagatagtggccaatattggaattattccagcttgtaccactttcctccttattttttcggttccccttgtacctatgaagaccaaactttggaaggtcaaagtccatttccatcctacaagtgcccagtgtttcggggactcaggttgttgacattcttgcagtatatcaatcagcctctccaaaccaccatcagtagacacagtctctcttaccttgccacttgttgaaagcaaaaacgtaagatgattcaaggagttgaccaaaggtttatcagaagtacaatccaacgccctccgatcatacagactggttgtgatgctcactgctgcgcggttcgaagataccgatttataatttgagtctctcataaattcattactgatcgttgttagaaagctggactctaggcaaggtttctttttggacttacactccgatcccttatcgttataactagttaggtgctgattattaaggtagattctacagggtcgaggtagttttgccattctaatgtaatgttagggtgttccatttttggaaggcaagattcactttccatttccacgttcgatggcgaccgttaccaaaactgtacatccgtaatcttgcgctatgaaatctatacgacatactctatacccaaatctcttttccagcattatctaaaatggtggtcagctctccgatcttaacattccaatccttcaatttttgttggagcttggagatttgagacttgctcatgatacgcggctgtatccaggtgacgttcacttgactgttgacctgatcaatcgagcctttaattagctttagagataggcatttcatgacaaggtattccacttcatcatctgtagtaagaagtgaaatattgctgatgatctctgaaaatggaagcattgtttcgttagaaggtcttgagaataccaattcaattagggccattatgcagattttctgctgaagaaagtttatattttcaagcaaaactggacactgctctgtaatgtagcctttattggtctcaatcagactctcaaatgctttcaagtctccctcgcttatcgtttgaaccaaaccatagagccatttgaggttcttatgactgttgaacacctcaaacagatgttcatgcatgatgagctcaccaaagttgtaaatcttgtcacccaataatgcgctcacagctaagtcaaagcaaaatgcctcttggacactgcttggaattttttctttcttgaaatcttcatccacacatgccaaatacagtaaggaggtataatagaaattgttgtagtccctgttgattttgtagtattcacccaaggtattataataggaggcattaatcttgttgtcaactgagtttagactttctaacttctcagatatttcatctatcatggttttggcatcctctttctgatcttcaaagccaagtttgagtttggcaatttcgctgtctatatagatcaacgattgaacgtactctagatttgagacgccctcctcgtcctctgatgtaccagaccttcggctttcttttgtaaatgcatccttgatctttgccttccatgaggacaagatctctagggcttcatcatcagttaagtcctggtcatccgacaaactcagtagtagaaactccaccagcttcaatcgatttagtttgtcccaaaacttggtgatgaatctgtcgaacaatctcaatttgagaccatgaatgatgttattactttggtaaaactcctcatccaaagtggtggtcaattgataccaaagttttctctcgtacaagtcttccaaggtataaaacactgggcttgactcctcatcagcttccagtcgcaaggtggtaagaattgtcgatacgtcgttatccatctatgttttagtgtaagaaggtctttgccactcaaagaaagtcaacgatctgatatcgaagttgagagtgagagcagatggaagatgtcgtgtgaaacctaaaataattacatatataccttacatacccatttttgaaacgatatcacttagagaagcataacttccagagcttctggagttgaccattggtctatcatcatcattcgagttatcggtatcagaatctgagtctgctaacataaacctgttggctttcacagttgtggtttctggagggacaggcctcgagtttccaacggtcttaggtaatccaatagcagtttcaggaatatttgtagcaagttcttttggaacaggaatgctagaagccagatcaatatttgatggcacatcgtaaacctctaagttgtcatcattaaccgtctgtgcctcataaacggtgttatagtcgtaatggtagtcgtaccctctgctagtattaacattatgagagagggcatactcttcgtcatcgtcagaaccatattttaacgttgttgccggtaaaatctctattatgcttcttctggtagttgtcgaacacgaactactattgtcagagtttatcttgccttgagtttctccagaattagacatggaaagttgagcaagaccttggtgatgcaaagaagaatttgatggagatctagcacgcaaaaagaacccaccttcttcgtcatcatcgtcatcatcatcttcttcatcctcatcgtcataatcatcattgttttcgtcatagctatcattatgcgtactatcttcagcatattctaaatgttggggctctttttgattagattctgtgtccaaaaacttgttcaccaaacttggctcctgataatattcctcatcatcctcctcatcgaagctgaggtccactgccatacattgctccactctatcgttaaagtggatgtgacgatctttcttctcttcgattgaaggggttggagaatccacagagaagctatcaccaatatggtctctagatgtattgttgcttaaagatataggagattcaggctgctgatgagcgtccaacacagggcttcccctaaacctgttcttgttagcgtaaaaagtggcttgttctagcattatctcacctatggttttctttttcaaaatcgactttggttgatcatcatctataggtgttgtgtcattgtgtttcttgtcattagtgttatcgtcatgggcagagcttctcttacccttattgttgttaatcttatctaggtcaatactatcgtgaaaggagttcgtcttgggcaatgatcgaagattggttccactagaggacctcttgttcttcatcatggacaagttcgaggaggaatcttctcttagaagatcttgcttgtgaggttccttgtaaagaggtccgtagagccaggtaacatcactgtctttataccagttaacagactcaggagaaatagtcttcagtccgtattttgcctgagcccaagttctccaagatgcgttttccaatctagaagaatttgcaacatctttcctcttcagtacaacgtacctccaagacttgaagatatcagactctttccaattgtgcgacaggtaatccacatgcttggatggttcatattccaggtcgttatcgtcgtgtgtcaacactagattgtcaaaagccgcatatgctgaattaggagcttcgtttttctctgattgattatctggttctgtcagtttctgttcttcgttttcggcgctgccatcttgggtctgcttataggcggagtcgttaccgttgccgtcaacaatatccgtcgaaccaagatctgaccccaaatccatatacgtcttagagccagtggtggaatcacatttagtcccagtgttgattttggaaacagtgtcgtcggatacaaagtcactctgggtcaccaacttctgagtgggctggataaagtcatccaacagacctagtgaccttgttcttttgagtttgaaggaagtttgttcgaagtggtcttcatccttagcatctacatgctgtgatgtagtagctcctccttgaaagacttcggataaattggtctgggacgccattgtctctagttggggaaagagaaggtaaaataaaattggttggctcgaatctaactgatgctgggggagaatgcttaggtaatcctagtcccttactgacttgcgggatacggacaagtcttgaacgacgttaaggttagatcgatcagaggaaaggctgcaaaattgttactctccttaggtggcaaaaaaatttacgacgattgattgctcctgcggttaggaggagcttaatgaagattatttttggttttttgggcgctatacgattacggattagagggagaaagaaaaaagcatggcttgttttagcttggctcttttcgctaacatgaagaacatgacaaataaaaatattttttgagcattataatataagagatattaagtgtagtaatttataaattatctggactttgtttctaaatacatgtattgctactagctggttaacaggttgtctccgacaacactagcatcctgcttcaagtaccatacaatatcatcatggacagacccatatttggattcatcgtcgatccttgtaatcgtgtacttaataatattcatgctaatctctgatggtactccagtaccgagtctttccaaggaaaaaaccaaaaactccatcaatcgatagtagatcttttcttcaaactctggcagtgtatgtttcttatgaatttgggccaagagttttttcttcgaaagtgactcccacaaatcaataaaccgtttgcaacagaactgtcctccatactgtattattgttgttgccagctccaatgtgggaatcatcaatcgcatctctttctcctgcaaaataaattctgcaacttttggccataagtcagaaatgactgggtacatatcatctattgacgtgctcagtatagggaagattttgttccataaactaatgatttgaattcgaagtcttacactatcatgcatgaccagtctatctccatattgtaacattgtttggaacataaaatagacatctggagtaaatggcgacttccattccttgactacctctcttgcttccacttcaggctcagattgaataccgttaatatcaagttcctcttcatcatcgctgtctttgtcactatccaaatctccaaaaggtttattggggtgactagtgagttcctccaaggtatccgggatatcaatttttgtacgctgaacagtagcccagtacttggtcagaaattcacccatcgcctctcgatccttcattctccaaatagtattagtctgcttctcttccgagaacgtgtaccccctcatgagcacggaagattgatctaccaacttatgaaaaacttcgaaaaattgctcacagagcacagtgtagccatggtaatagtccaacagcgtaaacattgtactgattaaatcacccagttgatcgagaatgtcaacacctccaatttcaatcagtaccattaaaatggaacttgtatatggagttatctcactgttaagtctggaagaaactccatcgatcagatagtcaatatttttgtagaccagatcgaccaaagatccattatagcatttactggcaatattttccacaacatatctggccgatgttcttactgctatatcttgagcagttaatagctcaaaaattgggtataacgagcctaccaattcttcggtgaactcgctacccattatatctattatattattgatggctttcaaattcagtagtaaggtattcttcttactttgagtaataggggtattcaaatcgcaactgtcgatcaactcgttagcagtttctaaaatcaagtatttcatggagtcatccctggaagactcgtcaaatttaaccagctctgaaacttcatcttgcatcgagcgtcccagcagcatttcactagtcatccaaactgataccgacttatccaaaacatgattgatattattcattggggtaaactcagtgattaatgattgaacggcagaatcaggcaaaatttggcccaagcttagcagaagactcttcaaatcatgttcatacggcactaaggatgctaattgagagctatccgcctcaagcgttagcgatacagatatttcttgaatagtcttaacaggcgcagaaaatttctttctctgtcctatcagatacttgaaaaactcattttgcaacccttgtaataaggctggaggcggctgatcaacataatgaattaaagaggatagttgtttgagaaaaattcttttttgttgttcgtctactgtgttcaatttagacggtatttcttgtatctttgacaatatcaaatcgttcaaagtatcttgtaccaaataccggttgaggcttaggattcgtgaacatgtttcataatgcgtgggaaacagttgcagtaaagagtctattaaaaatggtatcagggtccccaaggaaataggacacttttctatcacggcctgtacaaattcaagccaagctagcgttacctggggtttatgatgagtcaaaataacaggtgatattgttttcaacgattgataaagctgtttgacagtgacctctaaccagtccgtatttctatttccttcgcccatctgattcacaaccaacttgttatcaaaaccctccaaatcttgcaacttcaaattatctaaaggatgcgtgacatgtaaatttaggtcattaaacgttctttccactaaaaaactgagtaaatttagacattccaaaagcacctcatagtgcacgggactcttgatagtcttgactagacttgacactattccaggtagaatccgagccaattgatctccttgataaactaaaacacagattttgttcaatgagataagaatagtaacactcaattgagagttggaatgtttttggttcaatgcatctagtgatactaatatcagatgacttagcttaccaacattatgcaacaatgaatcgtcattcaaattgatcatattatccaaacaagtagacaaacagttatatgcactcaataacaactcatcgtctcgagttatctttcctttgtataacagcggatcttttccaataacaaacaaaattaaagtggcaattttctcgttcattccatcagacctatccgtagaccaacctcgtctgactaatatttcaagaatcttgaaaatcatttgtaaatgaacttcctgtagtgctctatcgtcatggcctaacagaacaccgattggttgaaaaatataatcagtcaattgagcagaaagctctaaattggggtacaaattttgctggttgtcaagctcattataaacgttttctaggagtttggtaagactttttggatcatgattcactagtgcctcttggcttaagaatgctactttagagagctccacacaacaaggttttaacttttcaggttagtataacagatcatacgcgcaaccggacactaccttacttacctctctgaaaacctttcgtgtttgatctatattcatgtacctagacgatcatgtcctatagttcgtgtgcgcgagcttaacgatgtagataaattatattgtcgtgcactaccaactattgtttattgaaaacatgaatcttgaaaacttttctttcactcactatcttccttattgtaagttcatgttggaacatgctgtgtacccaacatgaaaaccactgtttgagaaaatctaaggtgaatgactctcatttgggatttgttatcttaaaggcttaagtgataaagttccaagtgtggaagtagtgatcctttgataccctcataacaagccggttcatgaatccttaacgggacactcatgtagccttaggaaacgtatactaaccttcgaatagaataaaacaaaaaatgactagaacctccgtactagcagatgcccttaactccatcaacaatgccgagaagaccggtaagcgtcaagttttgatcagaccttcttccaaagttattgtcaaatttttgaccgttatgcaaagtcacggtaagtgtcactttaagatagaagatgaaacttgtggatccaccatagctactgaattatgaaaaaaaagttcaccgaattgataactggatggtttgtcccttcccatggttggctgtcttttaagtcttcggaagagtaaatataggggtttaaaaaagagggttttcggattctattcattgcttcaatatcgttttgttttgatgtttaggtctctgtgacattttcaacatgggtccacaatgtatttcgtcaaggggttagttttttcttttactaactattatttaggttacattggcgaatttgaattcattgatgaccatagggctggtaagattgttattcagctgaatggtagattgaacaaatgcggtgtcatttctcctagattcaacgtcaagattggagacattgagagatggaccgacaacttattgccagcaagacagtttggttacgtgatccttaccacttctgccggtattatggatcatgaagaggctagaaagaagcatgtttctggtaagattttaggattcgtttactagatctaatgtaatgtattaaatgtaagttattgcgtagatgttggaaccatagatgccttcaacggttttcctgacgactatttcgatttcgattgtttttcctgtttcttccttgtttttgcctattcttgcttctatctttcttttggggtacactatcggcttccatacttttcatctgagcttgcaccctcaaactttcctcttcccaccacttttcaaatgcttgctcctgaatcacatccttcaaggaaacagtggtttcttctgatttaacaggttcttcaataatgctggtctttttctgttgccccaaagagaattgatccagtgagggtaaagcattgaggttgacgcttttagtgcgattgattctcgaactccaacttaatggtgtttttgatcctaaaattgaggatgaggatgatggtggagatgaatgtaatgaatttcctaggttcgatgcagaaagcccattagatagtcgtctagtccaagggttggtcatgatgggtgctgaaaccggaataggctcaggttctaatagtagtttttgctgtcttaccctttcctctttgttagctttaaaggatccctttactttaataggaatcatgtcaggactagtttcaagcttaggggtcatcaacctttcaagaggagttacgctgtcaccttctgtagcatctgattttaccacccgtgaggcatcactggatccttttcgttgactttgtcgaggcaagttcatactatcggatattgaacctttatgactggacagctgaaggtcctgtttagaattggaaggaggaggagtcaacgtctcagtttcagtcagtctccggcttgatctgcgtctaccattctgaacttgaatataccactcattctcattagatctgtcctgggttgcagctgattcttcaaaagtggggacgggatcctgacccttagctttccgcctaagttcctgaaccattgaatttcttgtactgttcgaattgattgcgcaagctgaccgtgtttttaatttcacattatcttcaatttcaaacagtgttttagatccctttggcatgaatctcaaattgtatttgtcatgttgttcaaggaattcctgcactaacaattccgcattcttcttataccaattatctttgacaaacatgccagtattcttgaatcgatcgaactcctcgaataaagagtctattctacttataagatcctcgtcgcattcggaaatcaatgagtacaacttgggactgaaaataaagaggtccatattcacataaattttccaaacacaacaatagaataactgagtagcattcagctggtgtacattcaaaagaatgggtatcacgttctctatagtgacaaaatccttaatagctaactgggctatatcaaggaggtcaaaaagcattaattcatcgctgagttccataacatcaaacacgaaattgatgaaactcgatgagtcatgataaactgcgtcattgaatagatccataaatggaacaccataaatgaaattaagcactacggtgaacgcttcgatggagacgtggctaaagtctataactttgaacgttattccgccatgttcttctgttggaagtgtccatgaatcaaacagcaattcaaagtaagcacatcttacagccaatagtgaagaaggacaatggataatatgtccatctgccagcttcactattgtatcggtgtgaacagcctgttttattgtcctaagttgggtaacaatctgcttttgactggagtttattctgccaaaagggtcaataatctgaagcaattgtgccagctttgagactgaatctttagtatccttgattatttgaggcgttttgtttaagggaaaagaatcccaaactttgagaaacttcccggtataaacaaagtgtaggaaaatcaaaatgctgtgccttgttacatttggacctacattgatagtacttcgatttgagttgtaagtcatccggatgtctttatgaattaatgttttgccgtcgaacagttcttttaatgcaggacagcgtgccacaagaatagactcatgacagccaaatttgattgattcaattccgttctggtcaactgtacaaaaccagcagtcgtagagttttttatcaaaatttgatttagacgcataaagactttcaaactcagtattatcaagaaccttcaggattgactcgtctatattcgaaaggtttgaatatctatcttcaaatttgctctttggtacccatcttgaatcccttttacgtttgaataagtcctcatctagggttgtttcatcaatgtccctatctcttagggatactgtttccacgaaatcagtatggaacgacgcacgttgtgtaagtgattgatcaaaaacttgtttagattttcttctctgttcaaaatggactaaaggagacaaagttgcaaaatcaaggaaaaagtcgttctcatgtaattcatgaggcaggttgtcaagctcatcccttatgaaagcaaacgtttgaaagttgttatcacaatatatcttgcatactgcattaattccaactagctttgaaaacttttctgatatggatgtagattccgatcttgatatgctcttgtatacggttccatcaaagcaggatataatcagtttacctgtggatgaaattttcacatcagttgctctcaaatgcagcttggacggaatccagcaattcttaaatttaagtgaagaatcaaattgctcctttccaagggcttcatggtcaaaagtcaccttctgtatttcaccggaatcataaagaatggcaaatcttcccttgctagagttgttgactgctatttgtttgatcgatctctttgacatgtagtttttgggtttgaagtaatcaaagttgaacttttcaaaattcttgatcaacggaacattcaatttgtgatggaacccattaatgtaaatataaagatccgcttggttatccactaaaacaagtaggaacttgtccgtcatgaacacttcttttattggcccataattgaaagaaagggacctgggagtattttgtctaaggttagtgaaaccaaactgaccgttattctgtccccagaggaataattctttccttgaatacacaacagtagctttactggaacaacaacagccaatcagatttctaaatcctttccaatctccagttgtaacttgtctgggtacattgctgaaaggttcccgctggatgaaggaattaaaagcaacttcgtacccgagctgactatcagaattcaaaccccatgtaaacacttcattatcagcagaaatgactatattgtgatcattggatgagcaagtaagaattatcttcttgtctttgaaaaactcaattggtttgaacagtttggaagagtgagttgaggcatctccaagttgtccgaagttgttgaagccacaactaaacagattgccgcactcatcattagtagccagtaaaatgtgtcttgctgataaagataactgaacgattcttggtgcagctagaagagacgctccgcgctgggcctctttaaattggtgaagcaaatccaatggataagagattaaagtttcatggtcaacaaagtcaaacaagtgcgagagtgactgagaattgtaaaacagtatatcagagccacctctggtgttcgaatcaaatacaaacatttccttctggtttttccgaggagcactgatcattcccttaaaatttactgcaattggcaagtgtttaaaaaaagtgatatgagttgagctaagtatgtccaggggagtaaagccgtctaaatctttttgcttaataagagattctttgtcctttgagcttaaggactgcaatatcatggcagccatgagaaagtttctgaaatgtaatgcataatgaagacagttccaaccgctttgcttgtccttgacacggatatctaaattgggattctttagtaattgacaaagaagatctcttcggtccgttaaaatgatcagatgaattaaatatctaccaaaacagtctctgtgttgcagctggttaggagtaacttgggacaaactattctggtcaaaaagatggtcattggctatctcgctatcgcgtctacttgtctccacctttggtggaaaattattggaagtgaaaacggctaaaattgcattattggcaatgactttgaagtagagaagtaaaaagacaaaatgaccagataactggaggaaagtgaactatccaagagagtttagtcatatagaccattggccatgcgcgcagagcatggtatgatgtagaggtgcacgtgcagagtgagttcaataaagtagtaattggcagaccttagtattttcgcaataacgggacgtgaaagggggccaacttagcatgtagagatatcttcaactcgacatcagacactttttcaacgcttcatttcctcgtgccgtttgttccccagcagtgccaaacacatttttcagatggtcatctttattacccgccatccaacatcgtcataatattgggtagaattttcatcctctctcaacttaactcatctccgctccaccagaacatgtctcttttcctcaacaagaatacaatttacgatcatctggaggtggacccgcagagggtgaagatggctgaaatccaatacgaagccatgcaaaccacattcaacacccttattcgtacttgtcggacgaaatgcattgctgaggagtatggagaaatcgacttatccaagggagaatcttcctgcgtggatcgttgcgtagccaaattcatgaaggccaatgttcaaataggatttttggcacatgcagcagggctggaaccaaatagtctgcgggtgcaccaaggcattgtcgaaacatactgcagcgacgcacctaaagaggacggaatcaacaaataatacatcagttaactaatacacaaaacaaaagataacggaataatacacaataaaaaaggagattactcaaaaaaggaagcttattcctcctcttcgtgttgctttttgaaatactcggccttctcaagctcatatctcttcttatcttcctctgccttggattcataaggagcttttccttcagcgtccaaagccttccatttttcaccaagcaactttccaatttcaccgaactggatacctgggttctcggaacgcacaatgtctctttgctcgttggcaaaaaacatgtaagcagagagcgatctctttggagcgtttgggtctgcaataattgttagtattcgagttgacatgcctaattgaaaaagaacaataattctactcacccttcttctttcttcctgttttggttcttctttcagccattgttctttaatgtgttagtaaaaataaaagaaaacaaaactaaaaacaaaacatagtatggcaggcaggccagactagatgaggtgtagtgcaggaagcgagaatatgggagggtgcgtctgagtaaacggtggacggaaaaaacgcgttgtttgttgtgacaaatacgactgacaaatctgtggccatatgcgacttaagataaaaaacagatctctagatctcttccttagccccctctcgtagtgcgccaaccatcaattttccaccaaaaatggaagtccaggcgttttggagcaagcagaacaaaaaaatgacctgcctctttgggattccaatggctgactgggtccttcacaacaaccacagatatgcctttgtaaacacaaaatatccccaacgattgtaattcaatcattatcagtgttttctggaccgcttttccagcgatttgtagtcgcacatcagcgcggttctacagtgccgcgcaatcttcactagtacctgtcacttcttcatcctgggttcctgctgctcccacttgaaactccacttccacaatcgacaggccaacagagagcaaccagcacacaacaacttcttctttggtcatgtcgttgtagctagagcccgccaggtcatgtcgcgtccatctcttagtttctcacgcgcgttcctatcctcctcgaacttgatacatactttttttttataagccctttagtatgtggttttattaggtggcaataaagtaagagggagccctctataacctatatatagggattcgcgaagaggatgtactacgaccatagaaaaaaaataaacacagatggtgggttcgcgcaaatgtcaagtttattccccaattcggttttacttcctgataattcctgtcttctcgtcttatacttatatacttgattgatcaaaaagattctgggcccttaaatccaccctttagcattggtgttattgtagtcattactgttaggatacaccgggtattcagtgtaaggagtctgctgggcaccaagagcctgttgtccaaagtactgacctgggtggccagggtactgttgaggtaactgggcctgctgaccctggtgctgaccagcctgttggccttgctgttgaggcttgggctcctcaacttccttaccttgtggctgagattgaccttgaccacccacctgctgctgttgctgctgagggtactgctggtacagagggtatccatttttgttcaggtatgcttgttgataaggctgctggtagccttgaaacccggctagttgctggtttggaacctggcctgaagttggttgcacttgctgagtctgctgggatggactagcagttgggggtacttgtggctgatgaggctgagtctgaggctgtccagctccatagcccatgtaaccagagtaaagttgagggttttggtagtactgaccatatgggtagtatacgtatggagtgtagaactgagggttgttgtatgcgttaacagggttggcattagatgcagatggagttccctggggttggccttgaggcagagcgttgctggcagctggtgaggcactgtttaaatctgaaccaccagcagaggcaacaccttgagcttgagcctgtggatgggcccagtattgttgttgttgatgctgctgctgttgttgctgttgacgaacaaaggaatcatagttgacctgctttccatcttggtagaactgacggttattgttgtaatactggttttcataacgttggtactgttgattttgggtctgtgcttgcacttgagaagtgggttggcttgcctgctgagcttgctgagcagaactggcctctttttcattcaaagatagggaaccaaatgaaattcctccaatagaatccaagtttacagcagatggtagaacaacaggttgttgttgttgttgttgctgttgctttctctccaaaggcttaggctcctgaacaggtttctgctcttgttgtgagatttgttcattggtctgctgaagctcaatggactgaataggttgctcagcttgggtttctgcttgagtttgcaaagattgttgctcgtcctgaatttccccattttgttgcgacaattcctcgttgctagagggctttgcagcttgttcaggtcttttcaaaatcttcttcttgggtttagcagattgagcgaccatagcagcccaagactttggtttagcggaagtttcaacaactgcggcgggggcaaaagactcttcttgttcagactttgtctcggcaactggagactgagatgcgttttcgccatttggagtttcggtttcagtagtgggagttacggttgaagaaggtttatcctcttgtttctgatgtagagcagccgcccatgaactttttgtgcttggattagacgatggcgtcagttgagctttagtagatgcagtagtcgtggatgtcgtagaacgcggttgagacttcttggatttagccttaacttctttcttaggatactctttctttgcgctgttaggtgtttggtgataagagggagttgataattcttcacttgcattaaaggattcttctctctttttcttctccttcttagctgatggatcagtccatttgtttatttttccgctgataatgttttctataatcacattgaggtcttcatctggatattcctccagcacaggctccaagtcttgtgccgtccaatctgggaacaattcggtcaaagtggccagtttagtgctttccagcccctgagaggagccctgtgacgaacgcttcgcgccgcctttagggcctttcttgctgcttctctctgacattatatgagtggtgatgtgtacgctgtgagctttttattactgtctcacaacaaagtgttatgtttcttgaggtttgcttagttgagtaagttggtcattttcgtcgtttttttttccccgtcttgagagtaacggattcgcgaaggactcgtactacatcatcgtcgacgaaatactaaacggaatttggttggtaagtacactcatatacattatacacaccactgtagatactctgctactactactactacttacaactggtttgcagtgtggaaaatgttcaaagcctcggtgactctagcactcatggtcttttcaccctcacgaacccaaactcttgggtcgaagtacttcttgtttggcttgtcgtcaccctctgggtttccgacttgggacatgatgtagtccttcttcttcaagacgtagtcacggataccaatgaggtaagcgtactgacagtcagtgtccaagttgaccttgacgacaccgttacggataccggtgtcaaactcttcttgggtagatccagatccaccgtggaagaccaagaacaatggtttgtcactctcagacttcaattgctccttggcgtatttctggtggtcacccaacaaggaaggacgaagaacgacgttacctggcttgtaaacaccgtgcacgttaccgaaggcagcagcaatggagaagtttggagaaattggagcaagagctttgtgaacagcaaagacggtctctggcttggtgtacagcaattccttgtcggcattctcgttgttgacaccatcttcctcaccaccggtgataccaatctccatctctaaccattggttcatcttagccattctcttgaagtacttgacacaagtggcaatgttctcgtcatcagactcctcagacagatccaacatgtgggaagagaacaaaggttcaccgtgctccttgtagtaagcctcatcggcagctaagaaaccttcgaaccaaggcaaaagcttcttggcacagtggtcagtgtgcaaaataactggaattccatacaatggagctacggaacgaatgtaatgagcagcagcaacggcaccaccaatggaagcctcctggttagagttcttgacacccttaccagcaaagtaggcggcaccaccttgggaagtttgcaaaataattggggagttgttgtccctagcagcttccaaagcagccacggcggtggaggaagaggtgacgttgatagctggaatggcgaagcccttcttctgtgcgtgaaggaacaggtttctgacatcgtcaccaacgatgacaccggtctttctctttaaaaatgataattgatctggcattgtgtaaaaaatatgttcaattgatatgtggggaactaaggggagaagaaaaaggatattgtcagcgggaactggcaccagttaaatagtacgcagccattatttcgaagcgctaggagggttccaatgagagggggaagaggcctggtgagctccggggtaatcgcgtgttaagtgtagcacaactgggacatagttgctggttcaagtcacgttatttcactttatacagcccggacccctatctgttcaggattgctctggatgccattggtccgttcacgaccttgatctggtgattgttgtatgagaaatatctggcaatagcggatccatgtacaccggagaccggtgagagtacgtaagcaacggaggtgtgaaatgaattcaagtaattcggcaaggacgggatgagttgaagactcaattagtcgagaaaaagagcgtttttttgacgggggtagtctggacagtgtgctagaggtaacggttttcaattacgaagtgtgctttggggatgtcaggctagcatcagcttggtccctctatagtgttctctggtgggaattcccaatcgaaaccttattatctcccgaaaatgataccaccagtgaaggctgaaaaagctctcaatttggtgggggaccatgctttccggattatgtaagggccttctactgtagcccgcacgaattgtattgaactaggcaataaacctaggcatccaatccaggcagctcgaatgtcatctaggaggtgtggactagaagaggatcaaagaaaaccttaattaggaacaatcgagataacagataaactacattgtatccccactatggtagatactccaggttcgactgtattactgatccttgcacccttccccatacgagcacacaatggtaaactcttagccgaataaatcgaacagatggaaagctgcacccaagaccaataacttcattcttcagacaaacttgtagaacttggacaactgtaccaccatggtcaacggccaaggacgtctgtaaagagtccaacctatatggtgattctttcctatgttgttgtctgcctgttaaatttgcgttaagaagagaaagagtctggtctgaaaaattttatagctagtcagtcgtgtcctaaccatatagcaggcgttccaaactttctagggatagaagaccgtcaagaaatgcaaattaaaggatgaaagagggggagaaaggggacaggggatctaggaggagcatgtgaagaatggtagttcaacattaacttgaggtataagcaaaatggtagtttgatcaactcaatgggggtgcattccgctatccaggtggctattgtggatgggcaccttaattggtcagctcaaatgtcaataatatcaggaaatgacgtcaggtttgtacccgccaagtgcggttctttgtcctagcacgcatcgctggatgcacgtcctattctcttcttaaatgaggtagcaaaaccactcctttaggcatcgactttgctcatcgcgctatttcttcttccccggcataaccttaaatcagcccctttaaggtcaaagtgcaatgaagaatttagctaaaccaaagattaattatccttttctcattcttcttccattccttttatttttcatctggtttccaaatttcaagccgttcaatagagaaatgccggaagttcaagctccctctaagagcctgatcagacttcaaacctggaatcttcgattcgattcgcaacccaatggcgaaagtgttcaagacacaattagtagaatggaacgaaaagttcctcaagataacaaaatctcttattacgagacttctggtgaagttccatggtcaaagagaaggataagcattgccaaccacgtggtcttcaatggagcaggtatctttgcagtccaggaagcattgtatagacaagttcaagatctcaatgaacttttgaacctttttgattcctcctcctgggactggattggtcttgggagagacgatggaaaattaggcggtgagtttgaggctatcttctatgatacagaaagatttgagctgatagaatgggataatttctggctttcaaaaactccgtttgagccttctaggtatcctggagccggttccttgagaactgtaacaattggactatttaagtttaaaggagaagaatcaaaaaacccctttattatcatgaatacacactacgacgaacagagtgaaaatcaaagacggttggcttcctctctgatcaaatatagagcaagctatgagttcgaacgtttaaaaaatgaatatggtgttgaaaatccaagtataatactgtgtggtgatttgaattctcatagtttcaatgaaaattctggaggttatagaatcattacaggaaaccagcccctagagactgatgagatttcttcagaatttgcagagagatttcgaagtgccaacctgagcaaattcaactttagagatttaatggaagagacccctcctcaatttcgttttggtcacttatccacttttactgggttcagcaaaattggcgacacttccaagttttcccgtattgatttccagtttggagcaacatgggaagaagatggcaagaccaatcatggatggaaggctttaaagtacaaagtcgatgagatattctatgacaacgagtacccattgtcagatcaccgtccagtagttacagaacttctattataatctgtcactagcttatctgtatcgttgcatatctttgaggtccttctatttcaaagacaggctgtttcatgtatggggctaacaactttgaaaatcgcttttctacagtctccacctgttctgcgagtggcacttgttcagctaatgtcttaagaatggttgggataactagtttatcaacattcttaccccatagtagatccatgtgttcataatcttgcactgggacgatatccaggacattttcatgaggcagatatggtagcatcgtaggtatgttcattagagtgtcattggtaccgtacatcaatagaagcttagtagaaatattattagttggaaaaggagttggcaaatgccccttgagaccaaagataacattgagaggggagctatcgtggtccttctcgtcaaacatttcaaaacgttgatttttgattatctggaaccaatgcagaatcgatttaactgaactattggaaaagagatggggatatccgatttgcttctgctgtgatgagatgttatcgccttgccaattgaacaaataaatcaatgagagatcaacaacacgctgatagtattcctgtcccattgcccatttccaaaaatgaactgagggcattatagccctatttccaagaaccagtggaagatagtggtacgcattcactgcaaacgaggcaactgggtgcctcaaattaggtggaatgaatgcaggtgaaagacctatcattaactgaattttgtcgttcaaatatggattcaaagacagactggctagtccttgagcagttccctgactgaacccaatataggccagtattttgtgtttattggtaatgtgtagaatggtacggatggaatctggtatgtcgtaaatggcatactcattcaacgaaaagttccaaaatcgttttgatttagtagatattgatgtgtggtttctggagtatttgttacctctattatttcccagccatacgtcatatccgttatctaccaatctgaaggggataatcttatcaggggagtcgttaagcacaaaaagttcactgttcgtcaagagaccgtgctgtaagtagacgacaggattatcatgaatcttatccttatatatcctgtgtaccgtcagcagatatccgtctctagttgtaacgacatactccttacattgataaccgtggaattgcacaatatctttaatgtctctagcgtcggcaattctagcatcttgagaactgttttgtataaatggagggaataatagccgccaaaggtaaactatagccctgaatatgccaatgaaggctttagtcatttgttgtattatcatgtgtttacgctgaactgtaggcagaaaaaaacggctgagaccacagattcagattgggaaattacgtacatccaacatcctagattagaaaaagtacctccactaaaaaccgttataaacaggaatgatgctatgaaatgctatttacagtagtacacacgccatcttgcacttctactctatctcctaccaaattttccaaaacggtttggtctctttagtactgccttgtttcttcaaggtctcttctgcaatgtccacggctctgagcatcttctcctctctttcttgcaatattctctctacctccattaggtgcttttgagtcggtctttgcaaacctgcagcagattcaacggttgcgatatctgctggcacagtttcttcccgaataaccttgaaaggaaggggtttagaatttccacttagatcgaactcttccttgtcagataattctccagagatgaactttttgcattttagtctgaatcgatagaaaggactaaacacattgtcgtagccttcgttccatcgataaaagaagactccgtacacagtcactccaaacattaatagtctagaggtaattttcaatccattttggaaccttgcctttgtgtttatacgcttgagcactttattctgccctggatatagctcacttggaggcctgggtgtatatttaagttgattcatcgagtgccgtatttgctcatattcagttgcatctttcgggatgtcagaaaaggatttttgctttcctgggggcaaaaactcacttggataaccttctgggggtctgatatcattcggatcgtatggattgtatggagcctttggaggaacccagccaggagggtttggtcgtcggtccatactggtattgagagaagaagaaaagctaataaataagcgaactgatattgaggattatgtaaggctctataaagtcaaggaccgaggtagctattaagttgaccgtggaatcgtctcacggccagctgtcacttatcccgttaaaaaggtttcccaataattctacaactattagtatcgacctccgaattatggtcaacgagtagttcattactaggtatctccatccaaccttgaatatttcttcgcgatagtcagatcttccccagtcttcacaaatcagataccacagcctactcctcttttatcttttgccaatcgttcctttcctctcaaatgcatccaattctggaattcttctccctccaggttctggatgacagactgcttccagattcaaagaggaaacaacaagtcatttccaaatctcatatctcaagatggaatacttgggagtttaggatctacttgctggtgttcctgttcattgtcccgttgatgtacaaaacttgtatggatgcaagcaatgaaacaaacccaaactataatcgtttccagcatttgctgagtcaaggttggatgttcggtagaaaggttgacaattctgatagccagtaccggttcttcagagataacttacccatgttggtgggcctgatagttttacattcaggactcaggaagttggtgggtttaggttttacgattcaaaggacaacatttgactttgtgtttggaatcgtgtttctttttggcgcacatggttataattgtttgagaattcattttcatgtgttcgtcacttatttattggcaagacttatccccaatcccaagtatgctactttggcctgttggatatgggcagtatctactttatttatcaatgacaattataggacagtgcaatttggctctttgttgcccagcttatcattcatggatcaatttcatggaattattgctcgttgggatgttttctataacttcaccttgttaagaatgttaagttttaacttggattatctcaatgccaaggccgaggcagctgctttcaagccgaagaaagatgataatgatagcggaacagaaactcacaacattttggagaaacagaacccctccactactcctatattatcagataaggaaagaatgaacaattccttgccattgaacgagtacaacgtgttcaactacatctcatacataacctacactcctttgtacattgcagggcctgttatcacattcaatgattatttttatcagtctttcaacccgttacccactataaactttaagaagactgcaatttatggattgcgactactattttgcattttggtgatggaatttttactgcattttatgtacgttgtggctgtttctaaaacgaaggcatggcaaggaaacacgccatttcaaatttcaatgatcggacttttcaatttgaacatagtatggctgaaacttttgattccttggaggatgttccgattttggtcacttgtcgatggaatcgacccaccggaaaacatgatcaggtgtatggacaataattactccgctatggccttttggagagcttggcatagatccttcaatagatggaccatcaagtacatctatgttcctttaggggggtctcgttacaggatattgacatcgttggcagttttcagttttgttgcaatctggcatgatattgaactgaaattgctcatgtggggatggataattgtattgtttttattaccagaaattacgttgacaaatatgtttaaaccttacagtgaatgttggtggttccgtcatgtctgtgcggtgggagctattatcaacatttggatgatgatgtttgccaatttatacggatttgtcttggggggtgatggaatgaaactattgatcactgagatcttcacttcttcggatggccttaaattcctagtttctagctgtgtctgcctgttcgtggcagctcaagtgatgtttgaattgagagaagccgaaaaaagaagaggaattgatgtcagatgctagtaaaattcgaatcggtggatgaacaacccgaccacaaatcaatagatatattatagtgggaataccatactatttgtatagcctcttgtattctcctggggttaggcccctttcgattccccacagtcctttctttttcttcttagctttgttctccacttttagatacctttctttcattccatcaaattctgcagatgatttattttcatacactatcgcaaccccatttcgtagcatctcttcactgacatcgttccatccgttccaacgaaaaataaacactcttcccacaattctgttgtattggtcaacgctaagtggttttactttgactttctttcccagaataaattgcctaagccattgcaaagcctcttcactgtagggctgggagggcttaccaaaatgggatcgctctggtgcatcgactccacacaatcgaacgtgaatggttttatttttcagttttctgaacttgttgatctctggggtctcccttatccatccccagcctgcaaagatcccacctggcaggtgatagaaatgaaagttatctccgtcaccgacagaggtaaccttgccatgtaggtgtttagttcggaacaaggtctttggaacgtccagtgaggtggaaaagcggacaaaatggctcctataaatgctcattgacgccaggatagcagttgtaagacctatagagtaaactatcacctttggattgtaaatcgacacatgttggttggactgtgccatgacacagaaataaccagttgtttggggttggatggagcatgatactctcagagcgaaatcttgatctccgcctagcccaacatcttccgtcgctattcatcagcgccaattgttgttctcttccctttgtatcaaggtcccaaaaatgccccaattagaagcacattcggaccacctgaaggactctaaagttaattacacttatggcacagcaggttttcgtatgcatagttccaagttggatcctgtgatgtacacggtgggtatcttggccgctcttagatcgaaaaagcttgggaaaaccattggggttatgataaccgcctctcataatcctcctaaagacaatggagtcaaggttgttgatcccttgggagaaatgttggaacaaagttgggaatcttgggctacaaagtttgccaattcgaattctactgaatctttagagcagaatatcaaacaattggtcaaatctgaatcaattgatctctctgctcctgctcatgtggttattggaagggactcccgagaaagtggacctgcacttctgagtagtttgattgaaggcattgatgccattgagattagtagaccatctgattttggattattaacaaccccacaactacactatctagtaagagcttacaatgatccaagtttcggtaaaccaaccgaggaaggatattatgagaaactgagttccactttgaggcgtatttgggaactatgtggctcctctgaggaagtaattgatgttactattgatgctgcaaatggaattggagcaaacaaaattgaaaaactgtcttcatatgtgaaagatattttgtctctgaaattggtaaacgataattgcgacattcccaatttattgaatgttgactgtggtgctgattttgtcaagacgaatcaaaaactgccacatggacttaacaatccaacacccttgaagccatattgttcatttgatggtgacgctgacagaattgttttttattacatcaatcaagaaaaccaatttcgtcttttggatggtgacaagattgcaacactattgactcaatttgtcaactcattgctgtcccagttgcaagatgtacaattgagtatcggagtagtacaaacagcttatgccaatggttcatcctcgcaattcattaaagaatcactccaagttcctgtagaggtgactccgacaggagtgaaacatttgcaccacaaagctgttgatttcgatgctggtatttattttgaagccaatgggcatggaactgttgttttttcgcaactgtttattgaaaccttacaaaagtaccgcccaagaggggagcaagataagaaagctgtatcagctcttttgctattagttgaccttatcaatcaggctgttggagatgcaatttctgatttattagctgttctagtagccttaaaatatactaacaaatcagcattggattgggatcaagattatacagatctgcccaacagactaatcaaggttcttgtccctgatagaaatatattcaagaccacaaacgcggaaagaactctggttgaacccaaggggcttcaaagtaggattgacgaaattgtattgcaatatgaacgtggtagatctttcgtcagagccagtggaacagaagacgcagtcagagtttacgccgagtgtaaagactcagataaaattcaagaatttgtagacagagttggtaagttagtagcagaagtttaaatagaagatatattgattgaccttgccttcatacaacattatggaacccgtctttacccttctccaacccctttttaacgattttggaaatttcttcggggtcgctagtaatcttggtgaagttttcatacccatctttcgtaacaagaatatcgtcttcaattctcacacctccgacataccaatacttttccagtacatccttgttgacatattttgccttattatcatccttcagtcccaattcaacaagatagggagagaagtagattccaggttcgttcgtaactaccatattttctttcaacactcttctcaatcttaggtatctcaatagagggtttggatcatcatagttggggtgcccaccaacatcatgagtatccattcctaaaaggtgacccagcccatgaggaaagaatgatactgagactccactctcaaatatctcatcctctgttccgttatgaaatatgccgaggctcaaaaaatgcttaatgagaacacgatgtgccaaaaggtgtagctcatcccaatgggcttcaggcttaatcttcttcataacttggtcctgcatatccaaaacagcattatagatctcaagatgctctttcgtccaatctccattgatgggaaaacatcttgtaacgtcactagcatagttgttccattctgcaccagcatcgattagaacggtgtgtttattctccatagaatcgtcattcttaacataatgaagggtactacagtttggtccactgcaacaaatcgggtcataactttgaaatttagatccctgtcttaacgaatgataaacaaactcagcgtgaatatggccttcgtcagtttcaattggaagagccgacatgacagcgtaatgggaattgtcagaaatttttgacgcatgtctcattagagtgagttcatagtcgtctttgatcaatctggattcatccagagcccagaacaagtcaggatctttctctgttagtagattgccaaacttagaattttcatcattgatgtcagttgtatatatttttccaaacgacgacaaaaagccttgcaaatctttaagatataccaccttgtccacatcaaacgtcttgtaggcatcttcaatcgaaagaggcatcccactccacatgacatcatcccaatcaatttctggtagcaccagaattaacaattcggcgtccaagtcaaaaaggacatgggatccagggatattacaacctgacagataaaagaaataacgattctgtctgagaggagctgtttggtcacagtaaggatacaacttgagatcttcgccactaataaagattgcagaacgacttgaaatgtcagccttcttttggataaagtgatttttgaccgtcagtgcatgggctcttgctggatacttgcggccctccaattctttcggacctttgttcatttatgcagtttgggaactagtgactgaaaaaagggagtcaaaataggaaacgagatactgaggattgcagagccgaatgcatgcggagagagcgttaggaaggacactccgctacttggtagggccagttgataggcagagaacaaacgtcaaagaagatacaaaaaatgcaccttttaaaacaaaagataattgtcagcaattgtctaactatatgtaaggccatatcttctagaataacctaacctccttcgccaatgttcgtcatcacatcaccaaagaatacattattgtgagatctccagaataatcaccctctgacatccctcgaatttaattttctacctgaaaatttaaaaattttctaaactaagaaaccttctgcataactactatctctaattatggtggccgaaaccaaaattagtgatccttatacgatctcctacttgcctcggctaggtgtagaggttgagggtggacagaactataaagtggcaaatattgagtccaaagataacaatttcatagatatagccataagtgggtcttttgtaggaacgtacatcctaaaacccactccaaagttgatctggtcccatggtttgagtccgagcactaaagttaatagcattaatgtggtccaaaatcaagatatctctgaaggatccaagaattatttggttggcctgtcagagaaaaagaagcattccctttccttattcaagtaccaagaatcaaccaatgagcaaatgttggaagttgccactgatgacgcagttgtggaaattgaagagttatacaggaattccaacattgtttttggtttggaacaatcaggtaaagttgtactgtatgacattagtgtgaatataacaccaatcgctacgttgaaacccaccataggttctgaggtgagagttgtatttcacaaattcataccagatggaaaagggtttttgctgattgtggaaagagtcaaccaatctctgtctgtaaggctcgttggtttggacacaacttctgctttcaacgcttccacccatcagcttgacggcttgaatgctgaaatttttgaatacaatgatggtaatttactagcactagatgctaaatcaaaagaactgtcctttttctctctaccagagttacaaaaagtgaagactattagcctgtcaaacgttttggagagtgcttcttctgataatttattgtggtcactcaagtctgtggctcctaacagagtactgctttccttcaaaaacgacatttaccttttggataccaagtaccaatcattactagccactttctccactacatcccataaatctattactctattgaacagtccctcccaagtgagtggggatactccaacgactagagaaactttcgttgtggccgccgtgaaaaatagcaaagaaaaccttagcaaactaaagcattacacagttgacgttggaacgggcaaactaagtgattctgtgggaaaaagtctgaacagtaaaccatccgaattgttcactgcaatcccattcttgagtccgagtttcaacccttcgaacgagactagggtattgaatgccgagttgaaaaaagtttatgaacatttggtaacagcttctgcctccaaggacgtgaaagcgtgggagaaaatatgcgttccctttttaaggaatactcccctggataaaattttaaagggcaaggcgaatactaaatccattaaaacagataacgagtttcatgttcatgagccaaagactgaccgtgtggtggattatacttttattggactaatttgttcattgattttcgatgacctcgacttggatgcttttaatcctgaaaggtctctaacttatctgctgactcatcccctattccccaaagagttcacagaaggcttactggagaagttaaaaccgcatccgagattattcagacaggctattgtgacctgtccaaatatagcttgtattgatttgatttaccaattgcatggcgttgagaatgatgaaatagtcaaggacttactcgtaagattatctgacgagttcaaaagtgaaactattactcaggagactgccaaattagccaacaccaaaaacaaagatgaatttgaccttaatattgttatcagtaagattatgaggctaaactttggttatgaagttcttaatgcatttgttgattctaacggtttggccttgagtttgaacttatcctctacagaatccaacttgtctaagctaattgaccaagtgaacggcagaattgagactttgatcgaaaactctgaaattttgacactagttaaccagtcactaattcattactccaagatcaagcaatcaaagaaggaaatgaatggctccatagttgagagcaacggtcctgtttctgttgttatcgatgagtctcgtagcaagatcgataacatgctggatattagcggtaagtcgaccaaggccatcaaggtagcttcaccgtctttcattccgtcttatcagtatgaacagttaaagttatagttaatactaaatataatgtaatataatcaaaattgaataaaagcacgagtagtcatgccagaggatgaggtgagcgttacgataaactagagggctaggtttgttccataatactggaatagtatctgagctaacacgtgaagcttatttagctggacttgattagaaaattttaagtgtacatatagtgataatcacatatgaaccgtcacaaatggttgtatagtgtagtggttatcaccttcggttttgatccggatgaccccggttcgaacccgggtacgacctttttttcttttcttttaataggcaacctgatacgtaccgtaaaaatgaactcagcccatttctctgcagcaaacggttgtatagtgtagtggttatcaccttcggttttgatccggatgaccccggttcgaacccgggtacgacctttctttttcacactttttttaactcaggtaggtagtcagtgtagcgttacattctgatattacctattgcgtaggcagtatgaagtaagtctcttccttttttgtcctatcagaactgaatctgaccatctagtaaagttaaacaaattgaaaagcttaatcaacaggaattagatcagaacatacaatttgaagcatcatggcatcaggagtatagagactctgcttacatctatatcggttctctgccatacgagattacagagactgatttgcttacaattttctctcaatatggcgttccaacccatgtgaagctcgcaagagactatgccaatggtggaaaatcaaaggggtttgcctttttaaagtatgaagattggaggtctactgccctggctgtagataatctgaatggcatcaagattaaagatcgcacaataagcgttgatcatacaacatataggccagcagtctaccaggatgaggatgacgaaagaatggataaggaatgggaagctatggtcaggaaggagatggagaaggactttgcagagggagtgaaaaaccaggaacagcccccagcacagcatcacctcataagcgaaggtcaaaaagagcaaagcaaacaacagacacagaatgacgacaatgaagatgacgctgatttggaagatccaatgaaaaactttttgagcaaaggttgaatatagtcaatttcattaatcaaccttccacaatttgcaactgcattaagaaattaattaccactatttatctaattaaaagaaaaattccacaaacaatcccccagatgatgaaacagctcgacaccaacattcttatttaagctcttgatatcgtctgtgctcatttctaaagcacccaccgcaagagcatgttcttttccctcagcgtagatagtcactattgtacctttttccaagttttcttcaggcaattgggctccgggcgatgtcagccctggacacatgatattagctcctgagaggacaaacttgatggcgcctctgtcaacttgaactttcggaaagcagtctggatatttgtgaacaatctccaaggaggggatcagatcatcaaactgctggaaagcaactaccttgttgtcaacgcaatacagctggatcttatcttcacatttgatgagaatcacttgagacttttttgggataatatcgtcaattacagactccaacgcaggaaactgtctgacccatttggctttgaggttcctttgctgagaacttttgatatttgatcgggaatggatgtcttctttggtgaattttttgaacatcttgacgggaatagtagaaggagtttttcaattttattatagagcgagcccagcctgcgagggtgtttagaaggtaaacttgaaagggggaaaaattagtgaagggaagatgagggtacactaactatgtcgtaagcaccgtacatagatgaggagtgaacgaacagactacgtaatactgcaagcagtttcccaaggaaagtgagtacataaaatgaaaaaaaaagcagcgtttgtacgaggtaggaaataactacgagccagccactcatcatctacaaattaatccaccgtattcaaggaattacggtagaagcaacaaaatggcccaaaaattcttcatccgtttgtcacagatgaaagcagtcatggttagttttcaaccagcaaaaacatgatctcggacgaatcctcactgatacacgtaatgcccttgcataaggatgaagagattgtagtttagtctttcggacctttatatagccaaatccgggtaatggccgactgaatatttcactgtgttagatgttactttgggacatcacactttgaacttgcacagtttacatataaagatgatatgtcatataagatatcaagcttcctattataacactcattttttgagattctattgacacattgcacaccatattagcggggcaacgtgtagtctagctatctatttataccaagatctcgcgacttcaaagttctatatctaaaaagtgccatttaagttcttgtctataatctttccttgctttacctctacgccatggtgcaagagaactatggcataatcgtagactcaggatcctcagggtcacgattgcaagtttacaaatggcaagatcctaacgagttaagagtaaatactgatgatgagtccattttaaagtcggttcctaggatggaacaggaagagtcttggccaatgaaagtttccccaggaatgtcatcttttgcagatgatatggatgatttatgggacgaccatttcaagccgctaattaaacatgcacaaagcataatacccgagtcaaaacacgaagaaactcccatatttgtgtatgcaacggcgggaatgagattagtatccgaaaaggaaagaaataagatgtttaaaactgtttgcaagtccattagaaaacattccaagtttatattaaacaactgtgatgatcatgtgaaactcattgacggagaaactgaaggaatttacggatggctgggtcttaattatttacttcgacagtttgacaactactaccctgataggcactctcactcgtcatttggattcatggacatggggggagcctctactcaaatcgcattttttccatctaatgaaactgaagtagagaggcatagtgatgatatgtttagtgtaaccttgaaaaacgttaatggtgatgttcaagaatggccagtatttgtatcatcctggcttggatttggagctaatcaagcgagaaaaagatatttgaaatcattggcaaagactctagtggatgatgttgactatgatcctgatggcgatggaataatccaactgaatgatgtttgttcgccaagaggtttaaagctgcaggaaaagtatgatgggaaggtgtaccaaattcaaggaactggcgactatgcatcatgcatgaagagtatatacccattattgctcaaacatctgccttgccaaggatatccatgccttttcaatggagttcatgcccctatgattgattttcagcgagacaaatttgttggaatctctgaatactggtatactgccaatgacgtcttccagatgggtggagaatacaattttatgcttttcaatgaaaaagtaataaatttttgttcctcttcctgggaggagatagagagaaattataaagagaacttgtatggagagaatattaatttagaattgcttcaagattcatgctttaaagctagttgggttatcaacgttctacatgaaggattcggattacctcgtatagatttagatgaaaatgtttctgaagatactttggagtccaacgatcaagaattcaagcatataccttttcaaagtgctaatttgattgaaggagccgagttatcatggaccctgggggccatgttactctttgcagctagccagataaacactggatactctgaagctaagcaggtgggtatcaaaccaagtaagacagccgctaatgttgcaggtaaaacattcatttcaccagttccaaactctttattttatcaagaagatgagttttccggacttggattgcacacccttctattattcctcacgctttttgtcgttttatttttcctcgtttacttcaataaagtttcccttatgagatttaagcacaatggatttgtggacagcatctcatcaatattttttcgaacatatcattttctacagaacaaatccgctcaattgtatcattccaagataagaaaagaaaagaactattttacagagcaagagatagatattcaaaaagctcaccttgaagaaggtttactgagttattcgaacgcaaggatatcttctccaaatcatttaaggacgagaccatcattgtacaatctccaagatatcagtgacatcaatgacaatggaaagcaagtccaaaactcctcaagctcccccaatctgtacaagaaccttgtctcgtctaggtcaaatatctcactaccgaacctaaacacgtacaataacacaattagaaagagtagctccaaccttacagatttcaagaaatatcatcagttggcagggtcatttacagacttgagtgacaaggaagtctaacattctattatattcattcccaaaccaagtttccagaaccttcaaccaaagagaaccgaaaaactaacacatacacaatcacttaggcatgcaatattaccctcatccccatttattttatcaacgtcaagaattcgtctctggtcttttgctgggatcggaaacatcctaacatacaactagtagttgttgttgccccaactttttggactcctctactaaccatgcacatatgagtggcctccatgacgacggcgaccccccttggtttcaggatctcatatacagccatagcaatttgtttagtcaatctctcctggacttgaaacctcctggagtacatttcggccaacctagccagttttgataatcctaaaacttttttgttcggaatataccctatgtgaacctttccgaaaaatggtaccaagtgatgttcacacaatgaataaacgtcaatgtccttaactatgaccatttcgtcatgatcttcttcaaatactgctctcttgattacatccttaatgttgtcttcataacccttggtgaaaaatagcatcgctctggcatatctttccggtgtttcaagtagaccttcccgttcaacatcttctcccaattcagtgagaattgtctttacagcagaggctattctcttttccctggcttcagcctcttctggagtagcttccaaacggttccgcgcaccaagtgagggccacgacaagccgtcattgtcgatagggggattcagcgtgtatggcgaggctggtctggtattaagtggggtatccagtcgcttgtaaaaaggctcatggccagttcttttttgaggctggggctgcgttagggttttatggtcatccattatgcttaaagttgggtgaatctgacaaaaaaaaagtctcgagatagaaaatttttaggggggagagcgaagagtcatcccttgcgggggaaccaggatgggggaaagcgcttctaggcggaaattctgtactaatgtcaaaaatgacaaaaaaatcaagactaactttttgtcttatctattaatttacatttaatttcttctctgcttctttggtttggaggatttgccacttgaacctatcgtgatgttcacacgaggagggacactgaaaccgaaggattgggcaactttgtttagatccaatttgtcgatttgataaacggttttcaaatgatgggaagcataagcctgcaaatatgctgtataaccatctctggcactttgattgagccaatagttggatttaatgagtttttccaactgagactggacgttggcgatcttgttagttggaaattcaaactcgtttaatgggactttagccgcttttaagtaacggaggaaaccaagttcagaagggattaagaacatcagcgattttcccttaccattggatcctctagcagtacgaccaactctatggatgtaatctcttggatcgtcaggaggatcaaattgaataatccagtcaactgaaggtatatctaagcctctggctgcaacatctgtgcagatcaatacaccttgtgtagcattacaaaattcgaaaaaggtattcgttctcttctgttgcttctgttttccgtgaagatctaaaactggtaagtcaatgtagtttaacagttcactgtagtatttgacactattacacgaagagagaaatacaatgatcttcttcttttgatttctcttcaaaaatgagaaaagaagcaagaatcgtttgtcagaatcacaaacgacgtaaccttgttccaaaccatcgacagtggaggtctcgttttcactgtccacattgatatacagaggaccttttctcagggatacacgtgccaaatcttcaactttggttgtctgagtagccgagaataacatggtttgtctgttctcatttggaagaatctttattatttgtttcatttcgtcttcgaacccaatttccaagattctgtcagcttcatcgatgatcaaagccttaaggttcttgaaaatgaatcccttagtgttctgtaagtggtctaacaaccttccgggagtagcaatgattatatttacacccttcattaacttttcagcttcagctcttctattggcaccaccaataaggataccaaaggtttgagaatgactctccatcagttccctagcgacaccaaaaatttgaagagccaactctctggtaggagtgatcacaatggctcctgtaccatttctgggcttaaacttcaaagagtacaacatttcaatggcaggaatcagaaatgccaaagttttacccgatcctgtcttagctgcacctaaaacgtctctgccagcaagtaaaggagggatagttctggcttggactgctgtcatcttggtaaatcccatgtttccaatggctttcaatgtaggttctgagagcttcaagtcagtgaaattttcataaacggtggaagagtagtccttggatgacttaacgtcatcaatttcttcaacggcttctgaaccagaagcctgtgctttactgttctcgtcatcttcactttggtgctcacgttttctgtcagccgaagttgagcccccatctacttcactatctaaattttcaacttcgggtgacatatccttggactttttagccgtggtgatcttgttttttttggcacttttcgtacctgttagtttagccatggtattaaggagtggtagcaaaatttttttacaatttttttttactttatctcatcgcacgcgaagaaaaaactgggaggagagcagaaagtacgacccaccaaaagtttccccaactcaagctgagccttacaaaactcgccacacaattacttctaactctttttcatgtcaaaggattttccgattgtcctggtaaagaacttgccatacaccacgacaggcgatgatttgtacgaggtttttgggaaatacgggaatatcatgcaagttcgacttggaaaccaggctgacactagaggttcaggattgatagtttttaagaacttaaagtcagcacagacttgtgtcgacaaggcgaacggttacaactttaatggaagatacctggttgtgcttcattacatggtagatctttcaaagattcaagacgaaatgttggaagtaagacggaaagaagttgcaaagatagatgctcagcaaagatctctgactgacaaagaaacacaatgactgcaacggaactactcccggccctactaagacccaaataagatataatacaaattaaatttttttatttcaaaaattactccaaatcagtttttagggatgttctctaacttaactttacctgattcaatccattgagggtcgaccaattcctcccgcttgtcatacaggtacttgtatgaggtctttatagttccatcagatacgcctgctctctgagcaatctgggctggggaaatactggcatcaaagatgctagctgccatataaattaccgttgcagcaacagttaccggtgatcgacctgcaagaacgccgacttccttagtacgacgggcaatgtactctgctgcattggttatttgacgagacaaacccaaattagaacaaaatctaccaatcaaggcttctgcattcgtctgggttgttgctatgctttcattttgaacgttcaatagtccgccagctagagcatgcttctgctgtatcagtttgtgaataatcttgaaaactttaccaatctcatttttgggaacatcagtcaatgcccaaagctctttgaatgaacgtggaacattagcttttcgacaggctaacccaatagctgctgccatgatactctcctgggacttacccttcagggacctttcattgtacaccagtttatacacttcttttgctccattttgtacaatattaggcagctgaaaaccttcgcataactgagatatcttagcaaatgctgcctgtaaagcactgtctttacggtcagctacggtgctattctgcgctctactaagttctcttcccattcgggtattatctgtgttatatgcaatgattgtggacagctggtctccatccaataaagggttctgtgcttcacccacacgggagggatcatcaccgttttgatcgtcgttattgaacgtacgccattccgatctcatgtctacgatatgttcactcaaaaccaatccacacaatccgcaaatgacgtctccctcactaaatctctcgattagttcgggaggatccaccttacagtctcggcaaatcaaagcaacattgagatccggacctttgaaacttccttcttcggttaaggctgtcatggttggatggggaacagacaggagaagaacgaagttctggttgccactactcctacaattttatacacctctacatcgatcgcgaaataatttttctagttccaaaaaaaaataaattttccatcttgcctttaagctttcagagttatcactatcgatccactatgagagttacgaagcgtgcttccaagaggagatctacccgtatgagggagggtcttaaaaagaaagtcgctgcccatggaagaaaacaaaggaagttagaaaagaaggatccaacatggaaatcaagagtacgaaaagatccaggtattccagcttcctttccctataaggaggccattcttgccgaaattgaacagaaacgtagagaggacgaggaagagaaactagctcttaaggaaaaaagacgcgccgaagcggcagcagctagaagtgcccttccggatgatgaaaatttgatggatgatgagagcgatgaggacaacgatggtgctaacggattagcggctttgctacaatccgcccaacaggcagctaaagcctatgatgggactgaatccaatgatgaaatggaagaggatgatctagaggtgaacgaatatgaaattgacttcgaagaagacgaacgacttggaaatgaatgggaaaagtctcgtaaagctttcgacaagattttcaaaaccgtagttgaagcttctgacgttatcttgtacgttctagatgccagagacccggaagggactagatctaaaaaaattgaggaggctattttacagtctcaaggaaagagactgatattcgttttaaacaaaattgatttggtgcctgataatgtgttgaagatgtggttggatttcttacagtcttccttccccactgttcctttaaaggccaatggtgctgcttctacgacctttaacaagaagatgacccaagcagtcacttctaaacaattgctagagtctctaaagtcatatgcacacaaatccaacttgaagagagctattattgttggtgttgtcggttaccccaacgttggtaaatcatcaatcatcaatgctcttacatctagacacggaggaaatggtaaagcatgcccagtaggaaaccaggctggtgttacgacatctatgcgagaagtcaaggtcgacaacaagctgaagattctagactcccctggtatagtatttccttcatcaaagaaatcatctaaagaatcgatggaagccaagttggctctactgagtgccattccatcgaaacaaattaaggatcctgaagctgccatacaactgttacttaagagattagccaagaataccgaaatggccgatggattcaagaaatactacgacattccacctttagtttcttccgacttggaatcatttacaaagggtgtccttatacacattgctagaaaacagggtaaacttggtaaaggtggtattcctaaattaaatgatgctgctcttgtgattttgaatgattggagagatggaaaaattgtaggatggactctgcccaactcctcaaaagctgcccaagttaccgataatgaggtttcctcaaaggttcctcctttgacaccatcatcagagcaaacgactatcgtgaaagaatgggctaaagagtttgatttggatggcctcctgaacatttaatcttgatagacagtgtatattattaaaacatcaacttcaacttttagttatattttccgcccatcgtgcaagtaaaagttcttcaaccctatctcttttacgatcatattggtacgttttctttaggagagtattctcccgctctacagtcttatagtgatgtgggagcagtttttgtttgagtcgttcattattggatttcatgatgtttttggtgatgtctttatagaatactcggcaaatctgttcatcttggttgtgagctattgaattcaaggatttccctaacaaatgagatttgaagtgtactaacttgtcgtattgattagtagtaagactatacttggtggtaatcttattaaaagattgattcaaaattatattcagttcgtgctctgaagtagatttctgacttgaaatggatgatacatcgtctctaacaactgaagaatcatacgattgagctctagagagatctttaatagtttcgaactggtcgtgatcaacaggaaattgaattttcagctctccttgctcatccgaagtggaattgagattaaattttacaactccttcattgacagtatcaaggtcaaactgaacactttgaggatcatctgattgattaactgtgggtttataatatttcgtgactttgcttcctgtttccaggtcgtgtttaattttcctatcaattagtttctgaaggcaagactgatcaacattgcggcctttggctatgaaacgatgtttcaaaagttgtccagtggatggtcgatctgcaggagatttttgaaggcattgatgaacaaaattacgaaattcttctgagaaatcagatgaaagtgaaggtggctgattttttggtatcatgaataaaatttcgtaagtgctgtattgtgatagtggaggttttccgtatgccatctctaatagagtgattcctaaagaccaaatatcggccctgaaatcgtaatcttttcgtaatatcacttcaggagacatccaattcggtgtgccaacaaatgtgtgtctacgagataatgtatttgtgagttgagtggcaaccccaaagtcaccaattttgacttgtcctaatcttccaatcataatatttgctgccttaatgtctctgtgaatctttcccgatttatgtagatatgccagtccttggagtagattgtagcatatcacagatatttcggtctcatcaaatggtccagcttctaaaagatcattacaagaacccccatctaagtactccatgacaatccataatttgtaacctttaacgaaagaaccatgatattggataatattaggatggctacaatttgataagagagttatttcattctgtatctcctcgattgagtcatctgtactctctaagtctatttgttttattgccacatgcatatttgtcaccttgtcaaacccatgataaaccacaccaaaggcacctttccccaaccgttcgaatagttcaaactggtctgcgttaaactccctcatcaaattttctttgaaactgtgtttcctcgcagcaagtggtagataagagcaagcaaagtgagttccacttgattaaagaaacgagatactatccagcaactagaaaatgtaataattcgaagtgaatggggaagagcaagtgaatgaagttggagatttggtggtactaaatgttaaagctagcgaataaatatataaaaacatttacatatatatatgattattataatattgctattgactggctatgttaaggccaggaatggtagagacatcaataccagcactggcaccggtaaacatcttggtttcagctgtaatggcttggcttctcatgtgaatgccatctcattggtggttcctgatgttatcgggaagttcttcctagtcgatgacatgagtgtcttgtttctatgttcgtcacaacaatcacaatcaaatctggtttgatctccatggtacagcctctcatgtgattcaagttgttttaattggttgaaggttttacagcagaagctacatttaaattctttctgatgcgtcctatgatgctttgtcaaattagaggattcgttgaaggtctttccacaccctggatatttgcataccaatggccgttcgccggtatgaattctcaaatgaatggataatgaagagctagtcttgaaggtcttcccgcatttagaacacttgaagggtttttctcccgtgtgagttcgaatatgttgctccaacattaggtcaattgaaaatgccttaccacatatatcacatttgtacggtttatgttttgtatgaacagggaggtgtctcaaaactttttgcctttgagtgaactccttatgattgcgagtacaccccttccaattgcaaacgtactttgattttctggaaccgacatggtcttccgtgatatggtcagtaagatctgttgtgttagaaaatttgagattacaaatttggttgttttccatttcccactggcatacgttttcttcgatatcgggcaatgcatcgatggtttcttgcttgggcaccggttcttccacaatctttgtttgttctgaaaaatgattcttgggaatgtgattcaataaggactctaaatcggagctattgaaatcacagtctttccatttgcaggcaaagttatccatgttttgaaaattttcaatcgtcaatgtatccaagtttatctcactcggatcaactcctcggtccttaacccaaggtaaaagatgggacgaaaagacatggttctgcaaatgtacatcatctttgaaagcatccactttacagtctgaccattggcaaacgagagaatccgagacgctctgattttgaacttcacttggatctccagaagtagggaactgggtatcataatgattgcagccgtgctggtgtggtggatagtgcaaatgcatttttttatcttgtttactctgattctctaagttgtaaggacatccacagccatatttagcccaatcaacgcagaattcttgaaactggtgaagatgatggtggtgattttgtttgttgacagggttaagatgatccatatcattccaatacacgggcttggttccatcttgttccactttaactcgtttctgttgttgcatcttaaaagaaaaatctcttgattcaacatgaggtcttttttccctcaggtcactgatcttgctagagttgaccatgaaactcatatctggatacacatttttgtccaatgtgacgcaaccggtagagcatgctgacactggcgtgttacttgaaagtgacactgtaccagtactatcgtgaggactggactcgtaattatttgacggctgtatcaaatcacagtctgaatatttcgggcacggtatttgagaggagctatcaacggaattactattcagcaaagccggattttcatttttccaaaacccttcaatgtcattgcatgtcgaaaaagcggagaggtcgcaaagcgcagcatgactagtgactgctccgttgtagtcactatcgccattatagggattctcatcctcattatgcgaagaatcgaaacagcatctcaaaaaggcatcagagttggtactttgaaactctaatgtgttctggcctattgaacatcctttatcagcacaaacaaacggatcggggcaactgatgtccttcagtggatcacacttgtcacaactgtcaaaatcagcttttgggtcaagcagattccatactgaagcagagccagaactctcagatttcgtcttactcattaaatgcagcaacgcactattactaataggtagtatttcttcgtcttgatgctttgcgctatccgttggacacagattcccggggtatatatgagagcgggatttgtcattgtggacagggtctaaaatcggttgaattcgttcactaacaatggggccatttggatggtgaatatgttgatgaacatggccatgaatatgactatgggcattgtctatggtatggatgtaccctcttatctggttgtgtaatatgggcttttgatcatgagagtgagtctctggatccgtagttggactcttcattgtcaaaaaatgggagtatggacagtcaagaattttttcacctcaaaaattaaccagaagagacatatccttctcctatcttgtctaacactgaaaaggtgggttgtaattaggaccttggtggttcttttccatatggagcataaatgtgtagtacacatcctgttattattgacatactgttgacttcttggctggtacggctttagctttcggcaaagagttagaagggacccgatgattcatgcgcgaagcccactatcagaattgccaccaaacgcgacctaacggttctggataagagactacagactaaggtgagaacgaagaatttcttttcttcatatcctcttttgtattcccactgtgatgtctgaagagtactctatttatgagcacctggagcctgaattattgaaagatgcggacggcaatgttgttaagtactctgatagagtcgctttgcccccttcgattttggaatcgttggttaatcaacaacagcgtttatcaattgcaagtttaccacatcccttgatctttcgtttacaggcagaaaaatcaaattcagcagttaactcttttgtgggtgtgaaagagttcactagccaggaaggaacaatattactcccagagttcatttacgacaaactagtgtcaccagataacaatgattctactataaatattactttggctagtgatatccctaaaggtaccagcattgctttgaaacctttagaattgtaccctgaaatcaaagattggaagtattttttggaagcgaagctcattaaaagttacactacgctgtccacgaacgacaccgtatgcatatccgagaaagataaggtctataaattgcttgtagaacaagcagaacctacttctgcgatttgcttgatagacacagacatcgatctaagtattgtgccattggatgatgaaatggcaagggaaatgagcaaccaacaggacacagaaacagtattacagtacgggactaacgccgtaactatagcagacaccgaacacagtcatgcatataaactacaacttgataatagcaatgacttatgtttatccctttctatcaattcgcaagatgtcaatcttgtggacctgctaatatccaacaaccagttcatatccaaggattcacttcaatggtcaacaattccatttaatgagaactcgaacatcaacaagaatgatggtactatttctatatgtatacccaagacagatcactggattgaaggtaaagagtttgtttacatcttacctatagtatggagcgaaggagaatccttcaagtcacagctatcaatttctagaatagcagaagcacatgtaaccacaagtagtcttcaagaaaccttaaaagctgacgaagccaagtgttctaattgtggcaagcatgtccctaagcagtcaatttcattgcacgaaaacttttgccacagaaacaacatcaaatgctcgtgtggtcagttgtttttgaaaaagatacccgatacccattggcactgtcagaatgatgcatattttggtgcaactattgaggggagagatattcatcagaaacttcaccacactgaatatgaatgctccttgtgttctactacactccccaattacattcaattggctctccataagtcaactgaatgtcctgaacgactgcatatttgtagatactgtcaattaaccgtgccccaggaagtaccttcagctgaagcaatgctgtcatccatgactcagcatgagtatcaatgtggatccaaaacaacggaatgtcatcaatgttccaagattgtaagacaaagagatttgcaaacgcatatgcaattacatgaacttgatcgcaagcaacaagttgctcctattgtatgtgcaaatgtcaattgttgcagaatattaaatgaacccactgatttacagttgtgctcagtgtgttttgggccactctattccacagactacgatcctaattatgtcaaattgaaaaatcggctggaacggaagtatatactgcaattgacacgaggctgcggtacttcgtggtgcaagaatgtggagtgcatttcgtcggggattaacccaagtttaaaaactaccacacttaaggagaaaataagccacatcagcaatgatcttcttacatcggtccctttgataaaccagaacgtagttacagcaaaatattatctttgtgttgacaacctagttaccaaacgaaagtttatggctgatatgatttacgagcaaggccaatatgaatacggctggatttgcgaagcggtgagcaaacttagtttcgatgaaaatggttctgaaatggggcaagtttctagtatggagcagtggcttcataaacatgcggttaaagtgggcgaatgaggtaaatagattatatgtaccgaattatttaaacaatttagctagagaaactgcaccttcatcattcttggacatgaccttggcaactgcgagttcaaaatcctcctgagttacgtgtatcctgcgttctctcagggcatacattcctgcctctgtgcatacaccttttacatctgcacctgaacaaccgttcattttttcagcaattttcttaagatcgattccacgggtcaaattcatggaacgagagtgaatcttaagaatgtcggttctagcggcaatagtaggaggcgggaattcaatcttacggtcaattctacccggtcttaacagagcaggatccaagatgtccaatctgttggtggccataataattttgatgtctttggaagattcaaaaccgtctaattgattaagaagctccaacatggttctttgaacttcagaatcgcctcctccagaggaactttccactcttgacgaaccaatggagtcaatttcatccataaatataatagacggagcatgttctctagccataatgaataattccctaaccattctggaaccttcaccaatgtatttctggactagttctgaccccgagactctgataaacttgcactctgtgtgatgtgctacagctctagccaataacgtcttacctgtacctggagggccgtacagaatgacacccttaggctgagcaatacccagtgattcaaacaattcgggatgtttaactggtaactctataacttccttgatttctttgatttgctgatccaaaccaccaaccatgtcgtaggttgaatctggaaccttttccaccatcattagggacactaatggatcgactttattaggcaaaatctgatgcaattcataagtatcgctctttagacaaactcgcaagctgggcgagatcttcttgatgtcaatatctggtgctagattgacgatatactttccttcgggatggatcttgactaaaactttcttctttcccattactttaaccacctcaccgacatacgaaccgggctcttgaagcagtttcaattcgtccttcaaagctctgaccttggagttcaaagagttacgttgggcctccagtcttcgaaggttttgagtttttgctgctatttggatttctgtatcttgtattttttgagcaaagaatggcctcacaccaccttggtgtgtcattgcagacatcttagaagcgtgtgtttgaaagagagagtctaaaagtggtgatttgccttcaaggagattcgccttcagagataggagagagtctacaggaaatgattcgcgcaagaattacaattacagaggtgaggtgagtgccaaaaatcccaacaccaaaaagtccaggtttcattcctctgatcttccccagaaacaccaccgatgaaggtacggatattgggactaattgcagtactttcagtggtgtcggcgggataccaaacttactgcagatgccagtgtggagatgagtcgcaagttctggaattgacactccaggaagacgcgcctagcagcctcaataacgccaatatctgccagctgtgcaccagagatcgctgtcgagaagagatcgatgcatgttcaaaaatacctcaggagaaaacccttgagctcatagaaatccaatgtttcagtaagtatccagcacattatagacgtttcaccgagaggtccctactaacccacattttcctcctagcacgtgaatcttttaaaataaaactggtcgtctacctctttgtcctcatagtgacggccctcctcctaaatattgtatggtggtcgcggcaaactagttagattatttttctctgaaactatgagttaaaccaaatttggtagcatggtgcctgacatgcacacttcacatttccctcgctcgccggttcgctcactggatcgaaaagaatcgtcaggtcgaagaaaaaaaaatcaagtttccacttaatctcctctttgtacttaacgtgtgtattctaatcaccaaagaacacatatctttacttagttgatttcttcctattggtccagtgactcaaagtaggctcaagtaaaaggaccaaagaagaaacagaaaagttcaaacacggtaaattttttttctcctaaaaagaaagaaagaaagggatccgggtttcacataaagcaaagaaggcaaataactttcaattctctgctgccaatgtccaataagaacgtggatacagctccagataatggttctggtggctccaattccccagcttctgtgccgcattatccacagcaacaccgtgctaattataatcctcataagaatcatactaatcatgggggcaataatggaggcgcccagggttacatgcagcatcagcaacagcaacaaatgtattacaatcagatgggctaccctatgccgtatccgaatgctggtggcaatttcaaccagaatgtatacttggttccttataatactatggttccaggtactccatatggtgcaggtgccccgggcgtgcctccaagctacccagtgtctccttctccagcattcgcctctccacaaaagactcatgtgccagtaagtctgcgtaccccttctggagaacctataaatttggttcctgctgggcaaacgagttccagttcatccaatgcctctcctcatgttaagtctacctctattcctccttctgctgtcactagtcctgctgcttccattgctccaactgttgcatcaccgactaaggccgcggctggatctgaagacgctggcaagactagagatgcattcaagcagatggttcaggctttagctgctaaaaagaaggctgcagctgctgccaaggctgaaggtaaaacagatgataaaaaggagtctgtggagtctaagcctaagtctgctgtacagcccgagacaaagccaaaagttgaggttaagttagagccaaaaccaaaagttgaggtcaaattagagccaaagccaaaggttgagattaaactagagcccaaaccagtatcggaggctaaaccagagacaaaaacagtacctgaggttgaagaaccttcaacagttgcaacgatcaaatcagaatccacaccaattgaggagctcaaacccaaagttgaggtaaccccagaagttgcatccaagcctgaacaggttgagtctgcacaggagccggctaacgatgtaaaaccatctgaagtctcagctaaagaggttcaagaatccaaggaggagtctttgaaacaacctaaggaagctttgaatgacattaaatccaccgaggagtcaaataaaaagttttctcttccagaagaggagtctaacgatcaccagacactttcccaaattcaaggagttaaagatacagaacaatcgcaagaatttgaagaacctcaaggaacccaggaaactcaggaaactcaggaaacgcaggaaaccgcaaagcctttggaagctcaagcacctcaagaaattcaagaaacccaagaacctgaggaagttcaggaacaaactcctgaaacatctgagactgtttcttctgtcacagaagaagtgtctccagctccagcacctggattgcccctttcaaagttcttggacagaatcagaaaggctcccgccatttcaaacccattcaagcatgagtactcaggtgatttccatggtccagacgaaagtttaagtggtctgaaaaccatcaaatatgatccgggtttcttgatccaattcgccaccttcaacttccatattgatgaagatttcatcaacgatgtcggttctaaggttgtgatccctgtcaacaccagaagagacaatttttccaagagcatgtctaccagcaatttcaaaggttctggtagaaatatgggttctaatttcagaaatgattttggatctagaaacaactccaagcaaggttccaagaaaaagaataaatctcaaaagagccaatctaggaggggtccaaagtactccaatgaagaagaacctgctgaaccagccgtgcctgctgaattgcctaatagagctgcaagcaagtgggtacctcgttcgttaagaaataaggaggctgaagtcaagactgctccagacggatctataatagtatcagaagaagacatcaaaaggaaaactaaatcccttttgaataagttgacgttggaattctttgatgatatctcaaacgatataattgctttgaccaagcaagctcaatgggaagatgacgtgaagactttgaaacaagttattgagtctatatttgcaaaggcttgtgacgaaccctactggtcttctatgtacgctaaattatgcgccaaaatgtgcaaggacaccccacctgagatcaaggaaactaatgagaagggaaatactttcaccggtggtgatttggtgagaagagtgttgattaatagatgtcaaaccgaatatcagaaaggatggattgaccagctaccaaccaacgaggatggttcacctctagagccagaactgatgtctgacgaatattacaaacaagctgctgctaaacgtagaggtcttggtctggttaagttcattggtcaattgtaccagttgaacttattatcagacaatgtcattttccactgtgtccttggtcagtccaaagaaacagacaatccatcagaagatactatggagaacctggttcaattattggaagctgtaggttatagaatggagatgtccagtgaacctaagattagaagggttcttgatctcgcctttgccaacatcaaggccattgttgacgctaacaagattccttcaagaataagatttatgctcatggatttgatggatctaagaagaaatggctgggctacaacagaagagaacgctggtccaaagaccattcaagagattcacttagaggctgagatcaagagatcagaggaggagagagaaaaagaaagagacaggcattctcgtagaggacgttacaacgactccaaacctaactctcgtcaaaagtcatcttggggaagttcagtggtttcacctaatgatattagaaatgcaggctatgttagaaactctgacaaatctctggggcctgtcaacagtttttccaggggcaagtcatcccgtcaagcttcaaagcaatcaaacagtgattttaccagtgttcctatcacttccagtggtagtagaactgctctaaaccactctggcgacagctcaacgtctctgaacgaacctcaatcaagagaatattcaaaaaaatctgaatctaggcccgctccttccaacatttttgctgcattagaggatcacgatcatgatcatgaacatggccacgaacaagaagaaaacaagcattccaaggatctccaaaacggagaggccgaagcacctgaggacgacaatgtgggagaaatagcccaagctgacgaaaatgtgcaagggcaagagcaagaggaagaacgagaggaagagcgagagcaagaagaggaacaggaagtttaaggtgagcaaactggtttctagggccaaggctctgaagagccaggaacggctatcaaactttcttaatctcaagagaggatagaaaagccttaaaccgaagaaacctgttgaggtagaacaagcttaaacttagaagtgaacaaaattgcattattttctggttattatcaactgtatttttaccttattgtgcatgtccaatgctgctataatattttttctatatcccgtgattgagggcttattgataattaatgtatagtctgttgttaagttaaaatttgtattacatgagccgtaggaaggcagcatattgttgtcaaacctcagggttttactagtgaactcacactagaagcagtgagtttgacagcatgggatcctagcccagcgaccatctctgttcctccattcacaagtgaggaagctgattgctttaaaattgaactagcttccgagccaattttggcaccagcggttcctgttgttaatctcactccattggttaataatttcttgtatgagtttatttcctgttgttttgagggaaactttgaagaacctttcactgaattttggaaaagatctctttttctaggagatcctgagtatgttttccaccttccaggggttcttcctggagtgggtacatgatcggtgacttttctccaattaaaggatttagacctggttggcgacgaagttcctagaaccgatatagtcgagtcgatagactcaactgagctatcagaattgacctcattcgatgtcaggttttctctgtttatcagagtagaaaggttccttctaattctcaagggagatgaggatcttttgggtgtgacgtcattggctattcgaattttgtatcttggatcattggcaccaagattctctttctcagattcccttcttttagactttctttttgccttaatgtttagttctgacgaatttttcaaaggtatgtcctcagagcacattttcttgacctctagagaagttcgctttaattcatgagggtattttaaacgtcgaaaatctgaggagacccctatcatttggttgttccaaaagagttcctttaaaacttggctatctagctcttcgtaaaagtccagctcgacgaaacgggccagatctgggtcattcatatgatactcactagcgatttcttttcgtttgaagtatatccgtctgttaagccttttagccatcctgttgtatagaaaagtgaacaatagaactgggaaaaaaaggatctccttaacgaccattgagtaatgttgcaaagttagaataatcagcatgtgtacaaaaaagggcatccaaagccctaacaaccagatcactaagatcaaggtttccagtgtctggatatcaaaaaaaagggaaatgagacccaagaacaaagacggcaagattcccattcttcccatatggtccctcttgaacagcttcctatggccgttcacagctttccctggatagtaacctggtatttcatcaaaatcgcctttgggttggatcttgtccttaaataacattctgttttttactcactcaatcaaggtgacacaactagaaataaaaagacgaatgaggaataaaattctgaaggggaagagaagcctttataagcttcgagtttcggtatgtgatttcccttctaaactatccacatcccacaaaaccaaatcaatgttgtattgtatacctgcatgaacttgaggagtacaacaatatcaatgtagtacgtatccattcatatacaaaaaaaaaaaaaaaattaaagagagactttgaacaaaaatatgtctctgaaaacttactaaatcaaagaagaaaatacccttcccaaaaacagtgattgtgtccttacaatatcctaccaaaaggccgctcaacagctgttataaggttccgtcatccaaaactcctagtttgaaccattcatgttccaaggcctgcttggctgaaattcgatcctgtgggttgaactgaagcagtttagagactaaatctatgaaactgtaccaaaaggtatactgatccctcagatcttcatcattaatgtcataaatctcaaagtttgaagccaaggacttggtcatgtctaattgcgaaatcactggaaccttttctatgatcgtctgttccataggtttcgcatttctgaccatattgatcgacttggttgaactttctgaattgggaaaattgaccttgtggttggagtgtattaattgggaaccaggttttttgctgctatcacggagatattgttgcaggtatttatgacacataaaggaatctacaggcttttggaataccttctccattaatgccaaatgctccctatcctcatgactgttgaaaaaaacgtcaccagttactagttccaccaataaacaaccgacagaccacatatcgcaaggaaacgaccatcccaaacctaacacgatctctggagctctataatgcctggttgaaaccatattggggtgaaattcatcctcgaacaccgctgacccaaaatcaatgatctcgatagagggatcctgtaagattttgacatgttgcttttcgtacgaaaacctggacaagttggggttgttggctatcaaatgagactctgaaaggctcttacgatggtatgaatcgtccaaaagtaggatattttccggtttgaggtcggtatgaattaaatttaaatcatgaaggtaagcaactgaccttaggagttgtctgcatatcgcctgtacatgcgatcctggaaaaggcagcatctgattacttttcatgaaatcatagagtgagatgcgcaacaaatctgttacaatacagatgtgatttcgaaaatcaaaacactccttgatctggatgcagtggttattattattgggatcatatttgcgaagtgtagacaacaccctaagttccaccttagccgcctctctgtacttgggtactgctttgatgatcttaatggccacagtctgttttaacttgtagtcataagcgctgacaacctttccaaaggtcccctgaccaatctgctttttgataagaaatctattgttggcaaaaaagctgttcggcttgacaatataatgaccatttttatcatcacattcgtcttccgtttcaccatcagaggattcaacgtcaataacaatagcattccgcgaggattggctcacattagagaacgtacgtttttttgggttctgagcatgccccgaatcaatagagagctttcggacaccattaagttgggtatcagaatcaaaggtgtaatttagcaaatcttccgactgttttgagagatgtggaattttttcgggcaaaacacttttgattttctctttgattacgagctcggttatattaggtttggtcggagtgtacgacaacttgcaatgaggcagctgaggcaaggaatatgttcggtttttcttctgttcctgagggaatagcaaatcatgaagcataccatcttcttggagcatccgttcatcgccaaaaatattggaatcattgtggtctgcaatctgagaatagtctgagaaaggattcaacaagtcgtgatcatcactatccgacagtattattgcatctgaatcgtcgtttcgagtgaaacttttggtattggggacagtggatccggaaggaaccttgttgaggcgtctaacacgttttctattgagatgtagcatcaccatcaaatgaaggagattcgaagtatcttcgtgggctcaaaaatactctatagggagttcttgcagtgagcagctgtattcttgagtcttaatggatgggtaaagggggtagttttggatatgtcgataaggaaaagtttgctgccctttcctctgaaggtgtggggggtcgcgatgcaaggactttggataatgtatgcaataatcgaatatcttgttacacatttgggggctagaagggtgacctagacggagggagggtcgagaccagtaaagtaagtttgcaagttatccgttcgcgattggtaaagccacgcacattcaatccatttgaaaattggtcaaggacgaaaccacacgtggacaagccactaggtgcctcctcaacccgtactatcgtagacagcatatattcacgacaaaagcatcgtcctctttgccctttcgtttgctctttctcaaattacgcgtctatacatatctatcatcttattataaaaggagctccaaggggttctcaacaatctgtttcagggcgcgcacccactcaccacccttggctccgtctacggtacggtgatcaaaggttcctgtaatttggataacatcgtcaaacacaaatccatgaggacttcccttgtcaggaacagccttcttctcagtcgtaccaatggcaataatagcactctgtggtgggttgaggattgaggtaaagaaggaaacggatgggttcattccaaggttggagatagtgatagttcctccttgaaattcttcaggcttcaacttgttctcctttgcacgtttaccaagatccttcacagtcttggaaatagtctcgagtcccttggaatcagcattgaaaacaattggcgtaattaaccccgttggagtggcaacggcaacagaaacatcaacgttctcaaactggcggataactccttcctgctccaaataataggcattggcctcaggaactctcttacaggcaacagcaatagccttgatcagtaaatcattaacagaaattttgtagcggtcattagaagaagcgttcaaggatgctctcaatttcaacagtttggatactgaaatagaagaggaaatgatgtagttaggggcggattgcttagactctgtcaaacgcttggaaataacctttctcatgtttgtaagtggaatatcctggtaagcagcagtggctgtggagggagctggagaggaaacaggggcagcgggagcagcagtagacttgggcttgtaggattcaacatccttagctacaattcgtccattgggtccggtaccagtaatttccttgagggagatacccttttctaaggcgatagtcttagccaaaggggaagcgataattctgctgccagcaggtctaggttgtttggaagacgaaggtttggcctcagatttagattcttcactcgaaggagctggtgtggcagcctcttttggctcttcctttggttcttccttagctagggcagcagcagcagctggggcaccagcgtcttcaatagtgaaactttcgaaggcttcaacatcagccttgtcttcgacataaacagcaattggctttccaacaggaatttcttgagttccgtctccaagtaagattttagccaagtaaccatcctcttggaattcgaaatccatcgaagctttatcagtctcaacctcggcaatggattcaccaggttccaattggtcacctacagctttgtgccatttgacaatattaccctgcgtcatagttggcgacaaagcaggcatgtcaatgacagtatgttcgggccatgatttggaagcatacccacgagcaaacaagtttaacgagactcttgctgcactggaagtctagttagtaaaattgccatttttgacaaagaaagaagctgcaatgaacttacggaaaacgcaacaggggacgggtcactctcaatgctgttaacgctgacattgttgaagacacttgttattagggtaattagatatacgttcaattaagaggagaaaggaggaggagcagagtgttccgatggtgtacggatgtgacagggtgatgcacaattcggaggaacaaaaacacgcgaggcgagaggggagtaccaaacaaaactggggacttgccgcaattgaagcggctcaaactagttgtcagcgccaatgagtatttctggtgcgagtggggggttatggtcctacgaacagttgagaatattggctctcctccaccaattaatgtccccaccaactggtactgatttctaaatccttaaagtcggtcttctgtttgctcaaccccagatcaccgaaattaaccggggtaggctcctcttcgccaaacacaactttgattgagttgtgtctctcaagacaatctttggccgtctgccacgaaaacctgacatcacgactccagccaaacaatggatgtatagactgggctagccatttcttagtatttgggtccgagggatatccagacccacaatctaataggttctcctccccatttgaggttctcaaacagacgtctctagtgaccttggcgcaaactgaagcacttgaaacacatggatagatggcatctgcttttttagatacggtgatcagcagtgcgggaaacctttgttgcagtttcttttggtatgatgctggaggtccgacagtatctacgtagacgtgccgtaaattgacacctttttggatgactttatctatcagttccatggtgacatcatgagcctgctcattcaagttgtaattgcctatattatgtggctttagcattgcactggaaatatcgcaggcagaaatggatgttgttgcccagcctacgttctttctaagctcatgatctccgttgcataaactctctaataattcacttcttttctgttcagtaagtgttttagaatcggcaaacccaaagtctttcaatcgtggttcatattcttccaaacaatagcttaccccgtataccatagggccaaccacaggacctcttccggcctcatcgactccgagacagcatggcttttcagggttttttagaacagactcaggaatctcactcacatacgtagttgtacgatacgttgaaatttctgggacagaggggggaataaatgtagttgtcataggtgaggaatcacatactctattttcaatccgtgtcatatattttccacaagcgcgttttttgtcttccctgcaaaggttcagaatggagggaacgagacaactccgtccgttggggtataaaatactctgccggcgggctgacctatacggctaccgttctatagtaattttattaattatgtccagagttgcaaggactattaagtagcaatctcacatcagaattcctaaacactctttacgacaaccatttgaacatgttccatgaaggattgaagactgacatcatcagaaccgacgatagcccctccactttgactggcggatgccatctggttgtctttgtaacttgtggtagggttgacttttgacagcaagaaacgagcttgagatccgcctgcgtcacagtcgataaacctgggcaaaggaaacctgtctatcaacaaatctgctgcatcctctcttggcaattggaagaaatctttcaagtaagcaaactcctcctgttcttggtatttagcttccctccattggacaatagtctcgccatggtaaatgacgatctggaaaaatgtgtctaaaagaagtattctatcagcggtgattgacattgaatctagaaagattggctgaggctcttgattgatctcatatgctgtcaacgttggctgaatcataatcaaagagttgaatgtgtcttctgtgagaatggaatgacggtaaaatgttgtttcgtcgggtgaattattaaacacttgcatgaactgagatcttctcaaatggtacaaaaactgggggaataaagagaatttagcacccaaacggaacgattgaagatcattcttttgatagctgccaaattttttgcacaactccaccaagatcttatctaactctctgataacttcagtgctgttgtccttcaccatcttatcgatcatttgcctagatatcaagacaacggctgcttcttggtcaaaatactctgcaattagagattcctgagactgttgtagtattggcttggccagtgttgtcacctttaaccgcaatgttccgccgatttcctggtaatatgtaataaactgtatcaacgatctaggttttgtagttgtttgagaagagtttgttgctggcatttcaaagtaaattccaaaagatgactgaggtaacaaattgcatagcttccaagcatcagttttaccccttccaatttccgtatcactgacattcttggcctttctttccaacgaaatggcatggccaacaagcccattgatttttaaatcgaagctagttttcacctccaatgtaccatttattcccattggtagctgcaaaaatctttgaaaagattgcttaaatatagctgtagaaaaggcatcggttaatactaatgcccctcccgtttgatctacaagcagttccatttctgataatccaatttggtcgtatgaagctgcgaacacatcgactgaatgacattgcgatgtagctcttttggctaatgcagcatagtgcttaagagatttcttatagtgtttagcagacccattttggatttcataatgtgatcttataggttcttttaattctgagccaacgacaattccaggtcccaacgtacaagggcctcctgcaaacaacattaaatgtgctcctgttttacctaggcaagtatccataaagtgtaaagctacatcgagagcagctcctgtagctcttagactccgttgaaattttccttttggccaaacatctggtttcaaactttggaccacctctgataatgaaaattcgcagactcccagcggcttcaaaaatcttcctcccacagactcactagcatcctttcttctcaggtctcgtgaaagtagacctagagatctttgaatggaagtcaggtcgtatgttttggagccgttaaatgtatagtaattatgggccaacccatcctcaagctcatgcacattgacattgcgaccaaaagttatcaacgaaaccaaagcgtattttggaagaagttgaaatgaattcaaaatgctctcctttaatgactctaattcttgagcttctagcgatgtatcgacgagataaacatacgcaggaggagacgaaactcttttggataaaacatactcaattgttgtgcaatcgccagatgcttgatatggtatttgattttggtaatgtggcaaaagaacatttagcgtggcacaaaaagaacaaatccaatgttgggcttggacagttacgaaagggttgaaaattgccttacaagcacgacaaatcatagggtcttcctgaatgattgccaaattttctctctgcttcaagggagtataaatacaagctattggaacgcaacatcttgccgcctctatctttgttctaggaaacgcattccaagtgaaacgtactccatcaatgtcctcaatggtctcaaacgcgtcttggtcctaagaaaagttagtaaacggttgctcttatcttgaacaggcaaactcttgagcttctttgatttcttaccatcgtagattctgatccacttgggagaatttcggttatgattgtatggcgtctgatggattgtagatcaaagtactggagaattttgtatcatgtgactaacaataacaccaaaaaaacttcaatatttggagggaaggaaagaacaatactgggattaactagagatgtttgcaaatttggtttataggcggacatccctggttgtaactccttccataagaatcagatcttacatttcaattacaacagaaactgaatttgcaaataggaaagcaagggtacaggagaatcatgagttttactatccattggtgaacgatctacgatacggaaacggggtccagacgcttagaatacccgaatttcggaaaaagtttgaatattatcagtttccaaattctagcaagaaaattgacactttgttctcagtttgtggaaagatttccagcatccgaagagctggtaaaggaatgatctttatggatattatccaagatttcaccaagttacagttggtaattcatcataagatgctgaatttgaataaggaggagttttccaacattcacagtgaattcagaattggagatcatgtctcggtaattggattcccaggaaagacagatgtaggtgaactgtcgttaaaggcaaaccagagagtcaaactagcagctccagcactacacccgttacccccaaaacttaccgatacagctaagattaatagtctcagagtggtagactaccttgtaaatagaaaatcacaggagataatcctggcaagatccaaaattatatcaaccattagaaagtttttagaagacagacaattcgtggaggtttccaccccaattatagccaattctggtactggagctaatgctactccttttgtaaccagcagtgaacatattaagaatgatatgttgcaaccggaacctcttcaattaagagttgcaccggagctgtggctaaaaaaactgattatatctgggtttgataaagtatttgagattggaaaagtgtttagaaacgaagggattgacagtacacataatcctgagttttcgacttgtgaattttatcaaacttttacttcattagaggagttaatgaacttgactacagaccttttccgttcaatatccactgaattgctgaatgctgaatcattgaagctcactcatattcaagcaaaagctcttcagcatgaagagttcgaaacgttagagttcattcctgccatcgaagaagcgactggaaagaaactacccgagaatctgggggttgcagaacttgaaaactatttcaaaagtataaatttggagtttccaaaagtgaagtcaccagctcaatttttagatactctatcgtctgaatatttggaacctcaatgtgccaaaccaacgtttatttaccaccagccagcaattctttcacctctagccaaatccaccagtattaaatatggtgatcgtcaatacgatatttccagacgatttgaacttttcattaatggaaatgagtatgtcaatgcttacgaagaggaaaatgatcctttctcccagaatgaaaagttcaaacttcaaactcgttccaaggagaagcatcaagatgaagaggcattagttcctgactacaagtacgtcaccatgatggagtggggtatgccaccaacaggaggatggggaataggtatagaccgattgacaatgctactgactgacagtgccagagtagagaacgttttgacatttggaaaattgaatgatgtcttgaagcattagaattagcctcaactgcgtccagcgagccaaaaggtgattttggttttttcgcatgctcgcacacttttcgccattacctcatcgctaaaaaatattttcttcccctgtaataatctatacccacaggatgttgagaagacaagctagagaaagaagggagtatttattccgaaaggctttagagcttcaggaggctcagaaaactcaaaggagagaacaactgaaacaggctctagcaactggtaaaccccttgcaaaggaggttgccgatgacacacaacttcacaaagattttgcttatgatgaatcaatccaagatgaggtcgatgacgaatacagtgcactcagcggagtcattgatcctaaagttgtcgttaccacttcaagggatccaagtagtaagttacagcaatttagcaaggaaatacggcttttgttccccacttctgttcggataaatagaggtaactacgtgatgcctaatctggtggaaagctgcaaaggatctgcagttaacgatcttgttgtgcttcatgagcacagaggtgtcccaacaacactgactatctcccatttacctcatggacctacagctatttttaccctccacaacgttgtattgaggcatgacatcaacgacactagtaaccaaagtgaggcatatccacatttaatctttgaaaacttttctagcaagctaggtaaacgtgttgaaactgtcctaaagcatttattcccaccaggggtcaagaaagatagccctcgtgtgatctcattcataaataaggacgatttcatcagcgtcagacaacatgtttacgtgaggactagagatggagttgagctcagcgaagttggtccacgttttgaaatgcgactgttcgagttgagactcggtacgttagacaacaaagatgcggatactgaatggcaattacgtcgtttcgtccgaacagccaacaggaaaaactatcttgccgattagtgactgcgatatgaaaaaggctgctgtttatttcagcttgtatatttagggttccatatatagacttagaagagatgtattgtgaacgtgcaccaatcaaaatgcgttattagttcgattcttgcgagcagcatgttttcttctacacgaagacctggtttaaaataatggtttctacgccaaaggagatagtagaatataccataaatgagctctgtctcattggctctaatggcgcctcactagaggaattatggaccattgtagtccagaaacaaccagaattggacgagttcttcaagtcaatttgctggtcatggctgatagaggaccacgatttcgaagtctatcttaaaaaaaatgagttattgctaatcaaaacctcttataaagatgtcaagaacacggaaggattgattgtcaaagcaagcgaaaatagggagtggttgttcctgacaggaatgcccaagtttgaaaaccctgtgactccattgttatttgagctattacatgcgattgcacaaagtagagaacacggaatcagatcaacagatctggccaaaaaaaacaggccaggacctcaagagctttacttctaggttcaaatttttgaaggactacaatctgatagaaaggatatccttgagagaagggaaaactatgaccaatttcatatttcattcaaaattctatgataagaacaagttaagggctcatgacacaatatacttgaaagaaaagaagctgaatacgatgtccaatattgtttcattggtgaagcaggctcctaaccaaatccggggagtttccgatattgcaaagcaattaggactttcaggccccaaggggcgagctaagatgtatcgctacattgatgtaatattagaacaaggctctttgaagcaggtttatttgtcaggatttggaagtcagctcttgaaagctgtagaatatgttaaagatttggagatttctaatgttccagagagtgatattgaggatgttcccgataacgatgaaggggaagagcccgatgacgaaggtgaaccgggagctatcgaggaagagccaataaccggatcgtcaaatcaactttccgaggccaaaatagaagaattaatgcccaatttcacgccaggtttttctatattcaactgtatgggtgcagctattcacaattcaggtatgaacggtttgtcaagcatgcaattagataaaatggctgtaggtgaagacgctggtagaataatgggaaggctttctgcatatattgtaaagactgaaaatcaacttagaaaaggattcaagaatggcgatttggaatgtgttcgtgttattgacttttctggcaagatgaagtttaacaagttttacaccgcttcaaatttaatgaagatgaaaaatctggaccccataccgtacggcgatgaattttcttccttacctgaatatttattgaaggacaagacattgactcaagttagctgtgcccattttaaggatccatcttctgctctagacatcgtcacttgtaaggatggcgtgagacgcttgcactggcaaggctacccaggaaccttcctcttaggcaacaaacttccaaaagaaaaaagagattatagtcttgtaaccgataacacagcgacgccggtgatcgaagtaccatctctaacgaaaaaagggcggccaaaaaagggcgtcttaaaagttacgaaaacctctcccttgagtcagtctgagacagcggaaccagaaactgagcctgaacctgagtctgaacagtttaccgaacaaacgacaagaacttcaaattttaacatcaattttgatcttttgaacaagaataccccatttagtgagaaaatactaggattgtttgataatcctttaacgcttgcgtatcgaagaagacaaggaattcttgatttgttgagaaaaagtgacggagctgcattgttagatgtcagttttgtgcatcaactggataaacgaatttccaacacaaccgctagttcagatagaagaaccattattagagatttcgaatttttaaccaaagaaggcgaggctattctggaaagctttgaaatggagtgtaacaatggcagaaggaaacggaagctactcatgttagatctcaaaaataaacccactcctcaagctatcgagaaggcaaaactacaggctgaacgggtcagttattctatgccatcaggagacctgtcagtgactgagaaggacataacttttcactttccgttcatcagaaacagggcctccaagatcaaacctgaacctgtaactagttcagaatctaatgcacttcgtagtcatgaaagtgacaactccactagagtcaagattcttaacgaaccaccactaagagtgtctcgatctaagaaaagagcagagcctgaaaatggcaatcagattgaaaagttcgttagaaagactaagagaagaaagaagctatcagagactgagaataaatcaaaacatgaactgcaagctagaaggactaggagattgatcaatcttgataagaacatcggccttgtgctattgcgtgcggtaattatcagcaagtcattgtctcaaaacggattattcccactatgggataaaattgccaaactatttgatgataaggctagcacccaggttttaaaaagatcatgggataggttacgcaaacttgttggatctaagactatacagagaatgacgaatatttggaaaaaaattctgatatctgctattaaagaccgaagagtaactagggataccgttttgaaccacgatttgaggcgttttgttgaactctggagagaatctgatggtgtttcttttggacatataacgtccctgtatgaagacattgaagagaattataatgagtttgagtttgtgaaagaccctgagactgaagaccctctgttttttttcaaaagtagcatttcatttgtggagagagaaaattttgtcaaggggctaagttttggggttcctattgatgtgaatggcgataaaattgaatctaaacaagtagaagatgaatcatcaagcatagaaaaattgaaatcaacactaaaggcaatatttgccacgcccaaagaagatttttcaagtacaatagccaataatatcacctccaagtattcagaaagtatgatacatgaagccttaacatcccttgaaaaggatagacagatagtgttcctagggacagatgctccagttaaattcgctttgtctgaaaaagtgataagttcaatgacttccaagcttccttactcttttttccaagactctgttgagtttgtcaacgttttatcgaacttattcaaaaaccaacagggcatgttattatctccgatcaccccagattacacaatccctgtgattttgtcgtttatgatcaagaaaaatattcacgttattagggtcgacaatagcattgacaaccttttcactggatatacatcaagaactattgacagaaagaagctggaatctgatttcatcataacaccaggaagcagatctctagaggcaatgaagccaagacatgtacctgttcctgtagatgtgccatgttccatgctctggattggggtcaatggtaatatcaacacaaaaatctggactaacctggtgtgcagtatagtgagtaatgttgagaagagaccaggagtggttcttgatatcattcatgaacccctacggccatgcataacgaagagggaactaaaactaatactagactggctagtagcaaaaggtatattcagggaaggcctggataatgggtattgggcgaccgaaagatggaacattggaatttaggggagtgaatagttgaactagatcatccctatggtaagggtttcgtgcgacataaaggtgttttgcattaataggctgaattagtagtaaactcaaaaacgcggatgaatatttaatatatatttttggagcatccccttttcctgtattccacatccacattttgataccatgctagccgcaatcaaggtactaatatttctttatggtatttggttgctactttctagtgtaataccttcttttgagaggaatccactgctgaaattggacgattaccatggcgttcttggctccgatcaccaggcccttcagtatcaattgctgaacacatcaaggtataatttgaactcggaagctgtagtggcaaatgggctagtaaatactgatgtctacttggtcattgctcatcctgatgatgaagtgatgttctttacacctgttgtgactgaactggcaaaagaactatatttcaacaagttgcatattttttgcttctccaacggtaattccgaggggctaggacaaacaagacacaatgagctattaagaagtgctgaagtcattggtattgacaaggaaaacgttcaaatacttgataagcctcagtttagggacagcatggaccagatctgggaaactgaagatatcgttaaagaactagaaaactctatccaaccaagaaagctggattttttcaatctgataagaactggaaaagcggcacataaaatctcaattatcacgttcgatgacttgggcgtctcaaagcacccaaatcataagtctttgtatcatggttgtgttgaatttgtgaagaaaaggcaggagactcagagtattgacctctttgtgctcagaactcaaggcatgatcccaaagtacagcgctactctgttatcaatttttggcatcctcaagaagcggttggactttgcggctgaatggcttgaaacaaaagacctcaaggttatttctgacttttgttcaaccttgaggcagtacaactcaattccagatgatactagactatctatctttggagacattacgaccctgattactgctttgcattcaatgaatgttgcccatgactcccaaatggtatggtttcgctggctatggatgttttttagcagctacttatcctataatgagttgacccgtctttaagacagggaaaggaaaaaaaaagaaaaaaagacattacattcgttcattatctctgtaaaataaaattcaccacattccatcgtcatcatcactattatagttcttcattgtttcaacctctgcttttctctttctaagcattgaaaccacgtacttttcctgcaaattttcaacatactctagagattctttttccatagccgtgcttattgagaaagatttgaccaggtccaaaacttgttcgtaaaatcccatgctgatcattttccgacttaacttgttcagtgcagtggttagtaagataatgcttcgtctgtgtgcctctgagttgaatccgaatttagttgatatggctttcgcatgtaactcgaccaggagctgcttcaaattattgattcgaccctgcttatgcaaaaaattgatccgttgaagatacagagaaaaattgggtcgagagaaggagttcataagatcccaaagatcatcaaaaagcctgtttacctgaatcttaccatccgcaagtgtaactagtgactcttgggaatgaatctcagcacatttgaataagctggtccaaaaagacatatttcttccgatgctcatatctgggtaacttgtaaggaaatggttgacataatctagtgacatcataaactcaccattcagggtggatgattccactatagccttaagagtgtgtaaatctggatagaaatgagatctaatgtccactggtttgtgctcctcattcagagaaataccccatatcgatcgtatataggtttgaagcatttcagggtttctcatagcagcgattgatcttagaagaatattatgtgtttccaaagtgggagtaatatcgttctcctgtaaaagagaagtaatattctcaatagagtctagcttcttgggcgaacgggaaataaaagatactaggcatttgtctctcagtaagtgcctattagattcttggccaaaactccatctatatggcaaagcgtcagtaaaaagagccagtttggtattcaggagatccactgtccataccagaaaacctttggaaatttcggattcaattttctctaacatatcgtaggcctgcttatactcatgattggcaactattaacctcaaagctgagtatgctccgacttcatttaataaccgagacgacaatagcatatctgtgatagtttctattttttccaaaatgattttcttttccgtaagagtcttctttcttattgaggacatttggtgattatatccttgtggaagactctcaaatttcaaaagtaatctgtactggtactgacaaaggttatccagaatccgagacatttcaacaacagagattccaggcttcaaaacatccattttatcaccaatatctagtaatgcttgcaacaattctggatacttcttctgtgtaaccaaatctcttataaactgaacagctttctgtacgttgtcgtcagtagttggatcaacctcagtggtgacctggcctatcggttttccaaaagacttgtttatcacgtccgaaagctcccatttttgcagatgcgcaactttaaaaggcctggcttgaacatttgcatctcttgttgtgtgttctttgagaaaatattcatcgatctgggtgcttccaacgacagaagatactcttctgagaccagaaagtccccagccatgcttcctaattacaaaatatttgtaggaagatccctgattaggacaaagttgtcttctcatgagttcaactgaaactggggctcaaacggattatgaaaggggtgattaaaggttttcctagccttactttccaaatgtcgaccgagacgaacatttaaaatcctaacatcagaaatttctatccttaatctcattgatggttagtacacttcgcagagtctccacatttgcagaccctcctggataaccaaagcttatctaacagcggcattggacctttgaaaagaccctcatgtttggagaagtgggttctttcttgacgccaatcaaaaaacagttgacgtatgtgaatgctgactctggaaccaattatcgaaagacgacgagctttccggtctttgaggaaggggataccttcaacgaatatatccgaaagcataaaacatggactgcagaaaagttatatcaggcggaagagcctactcaaccccaattaccactccaagaagtcactggctcgttgcagtttttatcttatttgtatattccttcaattttaggagaatgccttcctgtctgtcttatctaccacagtagtgttaacgttggaggcacgatttactattttgggggactaaggttaatgacagatgaggagagagatgaatatattgaagacatcactaataactacttagtagctttgagccatgtgtctgttgatttcaattatgacctaccacttccattgaatggtcaaatcttgaaaagtttatttctcgtacccaatgaagacgtttacgcttatgacacgattacaaaaacttactacaaaaaacaacttcaagagacttatcgtctagatgggctgggaacgtcgatgaaagcagagctagctaaaactgcgaattgtactgccacctctggtggctctttactgttcagaagtgaaatgcttcctcccttatgttgcccagttactaatagcctctccgatagatacgtaattatcgctggaggttttgaaattctgacacaagtcaacaagaaaagaagccatgtgcaagtgactaagacgatgaaggttcatgattccatatggatatttgattcacttgcgtgtatatttcgcaagcacaatatggtgctacatcccacggtatctttaaatgttcctgactcatacccacgttttggccatcaaatggtggttcacaagtactcaactagttcggacccaaaatatttcaagtctttctctgataggagaaccgacaagcaacagtgtataatttatgccatgggtgggtacaatatggattccaataatagattcattgcctcaaacgacctatggagacttgacatgattgacctatggaagggaaagaatggatttattgtttactcaaaggacattgtggcctatcctataggtggactggaaaccgtaattaatgttacaaataagtcccaatgtaccacttcttcttgctggccctcacccagggcattttttggctttgcgatggtggataaccaagatatgctggaaagcgacaaaagcagtgatccatcaacctgcgaatcgtctgtaacaccaagagctgggactccaagtcctcaagatgacacatcctcgatcacattgcccactcagttcaagtcaatacttgaaagaaagctcttagtagttcatggaggttcaagaatagtctataaaacagtaaagacaaatgatgcagcgggatcggatggcgtagaaacatttcaaaagcatgagatattaggtgatttttggtgctttaatatggcagaagaaaaatggataccaatcgatacgtacctacaaagtacaaataatgaaacaccaatggctatttcgccaacccttatccctagatgcggccacagtctgatatatttagcgggttctttgatgattgccggaggtgtacatatgttttcatccccttcaaagtcttttgtgttttccaatgatgatggagatattttacccaatcaggaatctatgttcgaatcagaagaatggaaacgaatattcaaagctgaaaacgtttacttggataatttgagcaccagttcgttcccttatagattttttcaattgaacttgaaaactcaagtatggaaaatttcaccaatattcattcctttgagtttgcagtccaagggaatcgtaactaccattggaagtacgtatacgaaagtgaattcagtcatttatgtatcaggtggtgaaatgagactgcttgatgttgatatctcacgtaaatggcttcaaaatttcgatcaaggtttatatgggggcaaagccaattcgtcggcaatttctatgaatggctgtgtcctagctctcacgataccactatctgcttctgatcagtttgattcaaattagggatataatttcaggattacgttaagagcttatgcagctcattttgtaacattgtatcaatgatggaatcgaacatggataaaatttgagtctgtttgtgattacaagatccttctgtctcttgtttttgccacttgtcatcagtgaaatcgtttagttcagaccaatgagtgaattgagctaaaaattgtttcaagtcatgaccatgaagtctttcttttacttccagcacctgctttaaatatgctaatgctaactgatcctgaagaaacttatcgtaaagccggcgacatattatcttatttatctcgatgtagttgtccttgctgagtgtgttggagtcataaagatttcgtaatctaggctttataaatagtttctggatgactatcttttggtctagtgagagggtctcagtctttggaatattcagtttgagtgtcggatcgtgagactgaagagcttctactgtcaatttttgagttgaatttgtgaagcttgggtgtctactgttgcccctagtctccaaaagaagatcgctgataagggagctggatggtttgagtatttgtgtagactgatgagagctagatcgttccaccacgttcttctttatccctgacgcccttctaggcttttttaactttcttccaagttcatgtgtgtttttcaatggtacaacgttattttcagtggagaattctgaactctgtgagttctgtgtccctgactttaatgcttcgtctaacaacttccaagattcctcttcgccactgctttgggtattactctcttgcaattgcgattcaagcagtttttctctatgctgatcaactatcatagtataatctgaatcggtcattaagtgcgctcgttgagccggcctgttggaatgactacgataaatggaattggtccgtctggtattgacaatagatgtgactctcctcctaccttctcccacaggggttgcagatatcaaattcctgttgctagcttcacccagatgattctgaaacattccgcataatggacagcaccattctgaatctaactcatctcctatcccaatacagttgaaatgaaaagaacccccacatgactcgcaataaatcaacgacgttgaaggatcttcgcatagagcacagagattcgtgtaacttattaatctttccctggtctcctctagtgtttcgtccaccaaatgcaactctaaactgcgatttttaacagagatcacttcctcacctatccttatctgagaataatctcgtctgcacttggggcaagtattcgccctcttggtccactcttttatgcactcattatgatagtaatgcagacaaggttcggtgaaggcctctttgtctaccagaacctccaaacatatggaacaaacctcttccatcgtcgttactacgctttgataggcaaagtcagtagttcgcttgccttctaaagaaccgtggtataaaagtagtactttgtccagaataggaaatagagggataatatattaccttgttgggacctgcctataaatgatacataaatagcgcttctggataaggtactattgtctacacaggatggttctagtgggctctattgaacccagcttatgcaattctttcatagaataagacgtaaacatctcttgagctcagcatattaattcccaagtttaaatctccatgactgattccaggcctgacagattcatcatcaaagtaacaccagtatgggttatgtaaatgcccagacttattgactaccgcggtgtaatgcccagacttcaacgaaccaaaatgattaattaaagagcataatttgtatcttgccacattcatagacccatcctctttgtggatgggtatttctaatatcagcggataagctattgtgacatctaacttgcatgcttgaggagagaaaccattaaatcgggataggtgaattaccagatattgaggtaacgatataaatgatagggctttctgactggttttcactaaattggccttggagtggttagaattgggtgagtgcttttctttgcttcccaacatcttgaataattttcttgatcgtttcttttcctcatcgttgaagacactattgttcatttggctcatttcttccttacgtcttttttccctcttttcacactcaggacatgaccatgcattgtccccccttaatacttcgggctggatgaagtgattgatgcaatcgttcactgctaccatattatgatgggaaggtggaataggcaaagacaagatttggaactgagtaaatgagcctgattgattcccacattgattgcaaatcagggtactctttagctggccttgaaacatggtagaaattggagaaacaccttccttctctgtcagttcagaaaaccattttcgatattgtttatcatcaagttgcggtgcagtactatggggaaaatctaatttcactatcgatggatagtttaactcttcgtggatcttatccaggatgaacatgagaaattcctgagtatcttgctgttcttgtgggattctcaaatcaggtctatagtagttacaaacgctcaggaatcgggttggagatatagacattcctccattcgctgtcatacttcgaaaaaggccagcaactgacagagctaatgtgttggttggcgacctcgtcaagtaacgggtaaattggtcagtgaggaatatcttcttaaactctccaaagctaaaaaggcattgaaccatactgttaatatagcaggtactaccaaagtttttcagcccacaaatggataattcttcataaacaggttttctggtttgagttacctgagcctggtcaatagggggagggatagttgacagtgcatgagatggatgtaatacctgctttgccctatactgaggtatggtgtgattgtactgatcaccattattgaagggagtagttgaagttcgatcattgtgagaaaacagtttaggaggcgtattttgtctgggtctatggggcgatgaatttatctgtgtttctgctctcggcaagtatgatgtagtttgagtaaggggcttcaagtagtcggtattaggaattggaggaggagcagattctggcaattttctgggccctttcagttttctgtcagcgtagaagactttcatgggctccgtagaatagtactttaaccattcatccattccaccttgcaagaatatcggtaaatcagacaacattttggaagtattcaggcttgttaacatattgtataacctggtcatgtcgtttgaaggtaccttcgagtctttatcgaaatatattatggttgaaaattgatcccttgtactgaaaagctgataaaaagttggatttgtcatttgcagtagcttttcaatctgctgatcactggttgaacttctaaggacatgtgcttcgatattgacaatattctggtatcttattcgtgatttttcgaagtcgacgctagatctcaaatccaacaacaaaatcttctttgattgaactgagggagaaaaaagaattccgttcaaagtagccacatcaatatgaggcacaaattcatccatactagaattggtttcggtaacctttgagggcgattgaagagtactttcaacctcaggtgaatttggcacgccgcctccatttgtatccacatattggtaaatgtctagtacgtctcctgtatcagcttcggcggaagaaatgctttttgtgtccaaacgttccctggattttagatctgttggggcttggaattcagtcactgtgtatgtataatcaggaggtgcctgatcccctttgaacgtaggtgcttgagtagaattctgtgattccccctgtgagctgtattctgacaaattaacgttagcagtagaccttttgatgggagacaatgatcttggcttagggactctatccagttgttggtcagctgaaaagctttcgttcatggcaacaactttgccgtccatgttgccatcctggatttttagatcgttgactactttcctcattagctctgtatttaaagactcctcatacagtcttttgagagtattaaacaactccacatcatcattcttccacattgaacaatccgagccaatacctggaataataatggtcaatatgatatatcctttcaaatacatagccacaccagtctcattatggtgggatttataagattgataactcttttcatagcaatgttcgctcatgtcaatcaaatctatgaccttgtgatacctggaattagagaatctaggattgatcttagttgatgctttggttgccaaagagagagtggacctgtctctttggatggtagcctcaagatttttcaattcattcaacgctacttgtctgtagtatatctccaactgactttgagtgtcatgaagcggtgtttttgtgccgttcatttttgtcgacattggagtctccactaacatctaatcttggagttcggagcttcaaattgctgatcccctgatcttaaacgacaggcgtattgatcaaaataagcgtaaaaatgttcgttagatgcaaaagatttccggatggaatcgcaggtggtgagggtctaaaaatgggttttattcaaagatggataattctttccctttgatcttgatgaggctgtgaggtctgtcctttccccgatctggtaggagaagagttcggcgcgcatgacaaacagagcgggatgggaaaatagcttccatgaaaatcgtgtaccatacgaatatttagtatgtatgtacttcaaagacaagagccaaattaaaactatcaagttttctcacgacttacaagcatttcgggcttgtgattttggactcatgtcattagtagccaaatttcctgactccgattattagtataaactatggaggaagctaagttgaaaccagctagccgacagcagtttgatcctttaactgtaactcaatcacttggatatcaaacgtttcgaagagaggcaaggcgtccttggaccaaggatgaagatgagcacttgaaacgcctagtaatagaacaatatatggacagtcataatgatgacaattacaaaacaaaacctatccctcttactagcatcaattgggatacggtagctgaaaagttacccgaaaggaaagcttttgactgtaagaagagatgggcaaattctattgatcctacagtcaagaaggggaaatggactaaagaagaggatactctactcttggaagccttccaaacctatggaacctcatggcagaaagtctctacgtggttggttggtagaactaaagaccaatgtgccaaaagatatgtggaagttctagatccaaataaagatcgatttaaaccgtggaataaagaggaagatttagaactgataagattggttcaatctgttggcacaaagtggagaactatttccatgaaccttcctggtaggcccagtttaacatgtagaaacagatggagaaaactggttactacgatggtacgaggtaaagcagatccagatattcacaaagaaatggaaaaagttcaaaagaagaaggaagttttaggttccaccatcaaatctcccgaaggcatagattcagataaaacacctaatccaaaggccgtccaaagcgccaagaatgtttcccacccacaaagcactagtagcgctagcccgccacaacctcttcaaaaggccagccctaatttagttcattcccacactgagtggacgttcaatacaacgggtgttgaaggtcagattctatccactggttctatcaattccaaggaggaggtggaccggctagttgaacaggctaagaaatataatatcgccatcactattcatcagcatgtacatcatcattacggtaatccaaattcccagaaatcagttttagatccggagacgcaattaaacagacatcaacatttcaactacttgggaagtttgaaaaatgttcccagattgacatcaacatctcggaattcatcttcgaccaacttgaatcaaatagatccgcattcgaataaagtgtcgggtaaagaaagtgatttaataagattattgaatcaacccccagaaacctctcaatcgccttcaaactttaattcaaggtattgggattttggatcatccagtaaaagacaaagggtacataatccagaagatttaaaaaatgacaccacaactcaaaactatagagcaattcccactaatacttttcacccacattttgctccagatgacatagaagaggatattgacttttgggactcgttgggaaagctcgctgatgtgaatccagtcaatacatccgcctctactccgcccgtatcgcaacaccatccccttcattatgataatagccaaagtaaaacccaagtggctacacactacacaaatttccatcctacccatcagcaggaagttaatgaacccaggagtactgccccttttggtccattatacggaagagaatacgaagaagacgaagattatgaacaagaaatcagaaaagatgaaccaaaagttatggatagagctcatcaagatgaggaggatattccaaatgatgccagtagttttggagtatactacaacgtatttccgactaagcagttgacgaatggcattgctacagagcaggctcgcaagaatagccataaaacagattccaattctgaaaaaagtgtgagtcatgatgacgcattcggtttttttcctttcaatccatcctaacatatttgtttctattcaaatcacagtgacaccattccatgtgtccttattgtagatacaggagtattttctaatatatccttgagatttgagataagtcagtgtagattcatcagtgccgtgacatccatctataatcagtaattcaatcactagtttgggtgctttctggttagtcttttttaactgctgtcttttggatacttgaaataaattgtaaagaccagtgttacttattttgttaaatgagagatccaacacttcccacttcaactgtggtaaagcgtattgttccaaacgagtaagaatagtctctccaaagcatttcagtgtgtaatcattaaacgttgaaatctgattgagatacaatttctttaagtatggaacatgaaaaaatatgttgacatcaaaatgatttgatcgggaatcgaatacgtcactagtgaaaaatacattgaaacagttaccgatggacaatgaagttaatgtgtgcgaacagtggaaaattaaattcgataattctcttgttgatattgaagacccgtacaagtctaaatgcgttagttgtttcagagcatcatatgctaaaagtgagggggtaggagattgaacgttcacggctggaattgagcattctctcatcactagaactttcaaagggcaggaatgaaaatttactggagctatcagaggttcattggtatcgggagagttgttgactagatcgttatactgtaaaacttcttggtagtttgaaatgtttcttaaaagccatgcaaagttcatccccttgttgaattgaagattgagagttacaagattggaaagtgatttgaaaaactggcccagccatggttcgtctatcacaggtgaaaagtcaatgccagttaatgtcagggaagtgagattgctgagcatatttctctggattgctaaagaaaatggaatgtgtttagttatgctattgtaagaaggtaatgcaatcaccgataaagtgttcaacgagctcgtggcagcagaggactctatctgttcagtgaatggtgccaaatatctatcacctggaactcttttgtagtcactaattgagtattctagagtttcaaggccagaaaactgttgtattaagaaagattcatagttccttgttagaggaactgaaagcttcaaatgaacaatactggaaaataatcttgttccattctttgaagacaatcggcaaataagtaaatctcgtagagttaaatcctgcaaataaatctctaactcatttatcagcaatggtttagaggagagcgtgttcaaagaggatctttcatcagatctttttggtttgagatggagatactcaatctctttgctacttgaagatttcatagttttaatcaaaaaattcaaacaattgtttaacgccttgttggacagttgggatttcaactgaagttttcgaaacagttccggtgatgaggatataattgagttccattttgttgagaccaataaacaggcatacatgtctgagaaattcaacaggcgaaagatcagcttcactagctctatcggcaaaaaaatggaaggatctattgttcttggagtgactaatcttagtttctttgtacaaggcactggtgcgtcaaactttaaaactttgaagtgtagctgatttttcttgtccaatttgattttcagtgcatttttcagttcctttaattgttccaaaagaaccttggaatatctaaattgattatcctgatctcttctagtttctattatggagatcccttctcttgctgtagacaaagcctcactgatcttcccttgtaggtctaaaattttgcaagttctcaaataacccttgcagttgtggcactctctcttgatcattttaagaccatctttcaaggccatattcaattgatctagcttttccaaacaggctgccctacaatctaacagagatatcagttgagatacacagctggcggccaactcgggatcattctcaatgaaattgatagtagaagtaaatgccttgtagcagcgcctatactctttttgtttgaaaagctcaatacctgtcttgagtccctgatcaaccaattgacggtccatttgctgcctccttcagggccccacgatagtatactctttgccagttcaatgcacaggcatgtaaaaacgcgctaccatcagataccaccgataccgccccaaatggcccaactcggtaatatctggggaggctatcttagactaaaaagattaaaaaaatacccgggaaccacaactaaaatggtgtcaccctcttgcaaacttatataacctcttcatgtcgtttgggaaccactattacttccccgtttcaactacatcgtttccaaagtggatagaccgtataatgacatcaaatataaatggttctctgcctcaaagcgctaatgtggtggttattggttctggatttgctggaaccgctgtttcttactatttacagaatgaaattgctggtgaccaatcgattgtgatgctagaagcaagagcagccgtctctggagccacttcccgaaattctggacttataaaacctgagtaccatagaaatcatggtgaatatgttgacaagtttgggtcgaaagttgcggggcaattggtcaattttgaggttgacaacatgaaggagctggctagaattctaactcttgattccgatcttaatgaaaaggcagacttccaagagcggatacatcttgatgcttactctaaccctcgttcgtcggagactgccatcaatgatttctatgcttttatggaaaatgaagaagtctccgtagacctgaaaagaaaagtgcaaatattatttggggatttggccaagcaactgagtaatgtgcctactaccccttttgtcattcattatcctaatggatctgttaattcgtatgatttcgtcactgctatgttaaccagagctattcaaaaaggcctagccctatataccaatactctagtggaagaagtgcagcaattggattctggtgtatggaaagtatctacttctagaggtgaattatttgcggacaaagtggtttttaccaccaacgcctacacacaaggactcctgcctgagttttcgaaatcaattatacctatacgaggcgtttcatcacaagttaacgttcgtaatacgggtaatgagcactctctgtccattggctccgacatttatgttccacaatccaagaatctgctctacagttcactgggtgagctggaaaagcagaccaatttcatggctaattacaacactgtggacgattcaactgtatcgtcccaatcgttagaatatttgcaaaaaaatttaggtaaagtgaactcacttgctactgccactgctacttcatcatcgtctggaatcatggcctacactgatgatcattttccttacgttgggcaattgagcgagctgggaaaactaaatgcatatattttggctggttgcaactgttcgggtctttccagaatgctcctttgtgctaaagaacttgccaagtccgttgcattggggtcggagttaagcgacagagtcccagctccctacaaggtaactagggaaagaatgggactcgttgacaaattgatgcaatcggtattgaatgaaagagaaattagagagactagagcaagactctagattcggaaaagcgaaaatctttatatcggtatatctaacctattttaagtcgaatgaacatcaactctctcaaccttatcgccagatctaacagtagcttgtagtagaccatctacagtaattctgacaatgacctctaacttgccattggcagtctcacctttgaaaggtatctgagcaagcagttgtccaggaacatacacaactttcttcaacacttcaggctcttcatcactgtattcctcctcgccttcttcaggttcaacagtcgattcttcgatggtcctctcaccttcatacagttcgatcaaaacatctcctggggtatcaaatgttaaggatctcttgattgggtaggcagtttctctagatattatttggatgaattcaccatcagcattcttgagaccaattggcttggcaatgtgttcaaggttaactacaacgggttgcaatgattggttaatctcatcctcgtcataggattcaatcagagcggcttgcaacgcagcaccacgacagattaactcacttgggtcaagagccttggagtctaaagctggggacacaacgacagttgattctgggaagatgaattgaacattagaagccaatctgggagtattagaagtacctccaacaagtagcacttcgtcgatatctaaagtttccaatccagctttacggacagtttcctcaacgaaagcagccatcttggaaaagatatccctagcaacgacttcataacgcagtctgttgatagatgagtggaagtcaaagccatcggataaagagtcgatagaaatagtggaactttgcacgttggacagagtcttcttggtggtgatacattcactcttcagcttagctagggaacgttgagtctttcttgggttagctttgtatttcttctcaaactctttggcaaagaattctgaaagagcagcgtccagttggtcacctccaagttcaaagttgtgctccgtggccaatatagtgaagattcctcctcttgcagtgattacagcagcatcagatctgacaccaccaaaatcagccacgacgtatattctatcctcttccaatttgttattggcggtcagatgagccaacaaagcagcagaaggctcgttgatgaactgtagaacatttaatcctgcctccttggtggcgctctttagtgcctttttctgctcatctgaaaagttggtaggggtggttaaaacgacaccttcaactttgtttcctatgtagtcctcagcagcagccttgatttgctgaaagtgtctcttgatgacctcatctacagtgatcttggtcgttttaccatcctcttcgatttcgtaaccaaccttgccatcaacgttaattgccttggcagagtttacaatttcgggaagaacggccttgtcaaaggagacgccagcaaagtctctaaagtttatgatagtattttgtgggtttctaatcaattgagctaaagcctgaccaccatggtactcatctgttccaacgtaagagagagcagatggaatggccctttcaccgtcgggacttgcgatgacgtcgactttaccatcaccttttgtgacggcaatagaagtagatgtgttaccaaaatgtagaccgataaaggacattagctgtgatatgagttactaaggcagagttgaggttagttcttgaagcaaaaatttttttcagaatgaaggtacattttcgatgttggatgtcgagactctagatctcaaatcagcatgtgtgagacaccagcaacgaaggtttttccaaacaagaagtgatatattcgtggttgatatacacgttttcagtctcaatttcatagttgctaagtttggccgggcttttcagataaggaaagtttctgggctgattacactctcatcccaatgaggtgctcagcagtgtatctaacggaaactactttctgacttggaggtaagctgaacagtttctaatgtgactatatgtatcttcgaaggatgttaaaccgcctcaattaaatatattaagatataattaaaatgttatgtgtactcaaggtccgcttcctttgttgtgaagaatcaattaaacataatttacatcctttatacctgacggaactgaaaaattgctctcgtttgatatcaattacactcgttaaatcttaccaacaagctgctattgtcttttgcattccaaccgtctgttaaacatccaaaaagacatggccaaacattcttaggttatagtatagaaaagcgcgattcttttacaagatgatgcggtggctcaatggtagagctttcgactccagttgataacagtgcaatcgaagggctgcaggttcaattcctgtccgtgtcatactttaactttttggcatgttgtttaattatacttttttccaacgatctgcccccgaaccaccgagcaaagaagaggtacatagcgtatgacctcgttactacttccaagagtcttactcacccttttgtttccctggttctccccattctgcctatccctagcgttgtacttaaagaggtttcgagccccgattattcagacacgagtacatttcaaaattgtcgagcattaaccaacattttcctttcctataatcagtttgttagggacagcatggcagttctagcttcttcgatcaccactagggatggaaagactatcatctctaggcaattcaaagatctgtccaaagaccggattaccgctttgttggctgaatttccgtcacttttgtcggagaattcaaaataccagcacacatctatagaatacgaaggagtgagattcatttaccagccattggaaaacgtttacgtggtattgattaccaaccgtcaatcaaatgttctgcaggatattgatacattacatattttgagtcaatcattgtcagcactcttgagatcagtagaggagaaggaagtgctggacaattgtttcgagattataagcgcttttgatgaggtgatcaatcttgggtacaaggaaaatctatccttgaaccaggttcgtgcattcttggagatggattcccatgaagagaagattcaggaaataatcgaaagaaacaaagagttggaagccgctgaggagagaaagagacgcgccaaagaaatccaacgcaaggaacttgcaagaagaaatagggaagattatgcaaacatgataccccaacagcattctagtgcatttgatcaacagcctcaacaacctatctattcaaactttgaggctccttctgctccttccgagtatgaatcctataacccaaccactccttccactagatcagcaccaccaagaggaaagggattgaaattgggtaagaaatccggtagttctgaggcgcaacagcctttgcttgttcctcaaagacacttagagagtcagttcaatagtcaccaacagcagaccccactacaacaaaatcatccccaccaacaacctcagcgatatcaacagtcaccaccacaacaagctcatcgttctcctgttccagaatccgtttcttcgatcccaccagcccataatgttgtctccccacacacgggccaaaatgttcaaaggcagatacctcatgaagcaagtacaactaggtccccagtatcgcgtccacaagttggaaaacctatcaacaatggtattatggtcaccatcattgagaaagtttctggtaaagtaaatagagacgggactgttttgtccagcgagcttaaaggggatctacagctgagaattaatgaaagttctttagctcatggcgtgatccatttgggattggcaaagcagccaaacacccaattcaagactcatccaaatgttgataaaaatctattcaacgccgagtccaagattggtttgaaagatcccaggaagtcttttcccgccaatgatcagtccttgggagtactgagatggagaagcgtcggtagcggtttgttacctctcaacgtttcatcatggattaatagcaatgatgatggtagtgtctcggtgacaatagagtatgaggtcaatgaaaaattagctttcaacgaatactctattgatgatgccgagctagttataccattatcaggtctttctttcagtattgataacccagagaatgtttcagttgacaacaagggggattctacctctgtgtttttgacgagattaaacgaacatccctcaggatccttcgaatttgaagtttccaacgtcgatgaagagaacgtcttcccgatccatgtcaatattgacctgcaaaacaacttcgacaacctgagtgatgttaaggttaatagtatcaacagtcttgacttggagacattaaacgaggagctgccatatgacttgtactacaacctggccacagaatcatttactatcgaataagtatttagactcaaataaaaagagtgtttaacggatattactgcggagcctaactccagccagctaatcaattagttgagagaacccagtggccttcttcctcattcgcagccaaaacataatcagtgtcgaagcgttgattcgcgcatgtatcaaaaggaacacctctcatctcttatcgctgccatctctctccaagtataatagtcattatggactacgtaaagaaagcgatatggggtccagaccccaaggagcaggtaagttactattgttttcttaaatcaggccttagatgctaactttactataggtacggaagtgccagcagctggtaagaaagaataaacgtcagttggacagatatatcaatgacttgaggatggtgcagaagaaaacccagtcgatgattaaaaaggccgctaaatctggagacaaaaatgccgttagactgtatgccagagagttggttaacattaataaacagagtgataggttacacgttaatagagccacgatagatagtattggaatgaagctgcaggaacaacaacaaatgctcaaaatccaaggaagtttatccaaaagtaccgaaattatgagggaggtgaactctttggtaagcttgccacagctgagaaactctgctcaagagttagaaagagaactgatgaagagtggtatcataaacgaaatggtggatgacctggtggatgaagtcgatgaggacgaggaactcatggaagaggaagaagtgcaggcgatcaatgagattatcgagcagtacactagtgatgctgtcggtaagctaccagagactggtggaactccaatcgaagttgcgtcccccaaagttcctgagaaggaggaagaggaagtctcagaagataacgaggaggtgctcaatgctatgagggaaagactgaaagctttacaggattagttaagtattaattatgcatgattcaattttttttttgtattgatccgttacctatactactacttttccaattatttaatccaaatctattcttgcttttcccccggtttgtgtttattaattcgttctagcttgtgaatcaaatgggtcttttgttcaatttgcttgttaagattccattggtctgccctatcaagagtgtcactacagaacttgatcactttggtgaccatgtcgagcgattcctgagctaaaacaagaacacgaccgttggggtcagataatagagatctttcagttgtgtttgctgtggcaggggagtcgccagcgccttcaccttccacaagaggtaaaactgagtttgcccagttatcaggcagttttaagagtacttctcgtacatttgaccgtgcaggttcaggtaatgcagacccactaaacttggatacaacattaactattcttttgacagtggtaacaatgtcatttttcacctggttcagcggctggttgttgaagtgttggtccaacttatggttgacttggttcaaattgggagatgccaaccctgtgctggttgcatcttcatagacggtttggacactcgtaatggaagaggaccttgatctattagattcactgtctttccctgagggtgcatctggaacaatggtttccgtttcagtgtcgtcgtcaccgtctcctcgctgctgccgacgtaactctacgatcaatttttcaatacgttgattcagttgcctgttccccagttttaaaaagttaattaacatttgcaatttttgtctgctttccaggttgaaattaatcattccaatgtctttgagatcttgaaggtgtcgtaatctggaattgtcacgaatgtacgatggagccgacctttcttcaggtttcgaatcgttggtagttgtcttttgacgtttggttgtaaccacttcttttttggaagattcgcctttgatatagtttcctgctatgactagatttcgttgccacatatagttgataccagtagaaataatagggtatgaagtaactttgtcgatcagcttggtggtggtggaatccactttgcccatcgggggcaattgtgcggagtctagatcctgttctactcctactgatggagaagtggacccattatttcgaagttggttgagagcttctatggcaataacttctctgttttcgtcaccatcagttgagtattcccctgtaagttttcgtttactcatggacgctgctagatagaattatgagcaacacaataatcgggggcaaaagcgttcgatagagggggataatttggttttatgttggactcaacagattgcagataagcggaggaatgactatcagagaaagcttaatagaagagaggagccaacaaaaaattctttcgcacgtgaaatgatattggtgtaaggatgtttgtttcacatggacgattggagagaggagaaaaagctggaagaagaaagaggagtagcaatttcatgctcgaggtaatcaagcaggtgtcatcaacagtggaatgttacacagtgctaatatgctgggtagaaagcttcgaggtttcatttaaagtttaggccggccagtggaagttgaaagtgtttaaatctctaacatgtgaagaacgctctcacaatcagatgttgcacaagaatctgagttctgagttcgcgcatatgaaaaagatcaaaaaaaaaataaaaaagttccactcgatcttgatcactacctccagttccctatgaagcatcctttccaattgatattggccaatagagaaggatcactactatttgcgtctaccaagaatgtggtgcaagttttttctacggagaatgggcaactcattgcgaaatggatagacccaatagatacatttcacaccttgaagaaacaacagaaagagaagatccaagctttgaaagaaaaaacagaaggtcctgtaaagattcctaagattcccgtgccaggaaaaggtgcccctcctattttcaattatattcgtaacatgcatctgaccggagacgagtcaaaattgattgtcaccactgattcagataaggccgtagtgatattggaattgaaccttgacaattcagattttgaaagtagaattgttgtattgtcaagacaagcatttgcaaaaaggccatgtgccatctctatcaaagaagatgattccagacttgtcgtagctgataagtttggcgacgtgtacgatgtctcactggataagaacttcttaacattagaacaacaagctccaaaaaagtcgattctgggacatgtttcaatgttgaccaatgttatatttgccaagaatcatattataacttctgacagagacgaacatattagagttacccagtatcccaagacctatatcatcgaacggtacctctttggacattcccaatttgtttcatgcttgaagctttgcccatggaatgaagacatactgatatctggtggtggtgacgatttcattaatatttggaattggactacgggggatctcttatttcatttggacctaacatcgtatgtacagccattgataacggatcgtcacctggctcctatgagatttcaaaataaggaaggcaatttaacagagactaacgtgtccgaattgcttgttcatgaccacaaactgtttgtcttgattgaatgtacatctgccgttttgatatttgacttccaatctactgataatctaccactcttacacgtcataaagacacaatcgccggttgttcacatttctatcgccttgtcaaaactgtatgtcgctttggaggactatacaattgacggatttgaaatttttgacactaacacttttcaaccagtccttgaggatgtatcaaaaaatatatattccaacagcacagtggaatttgaatctacaaccgagcagtatcctctttaccacgttgcacaactacgtaaacgtggagaacattaaacacttacatttacaatctactaattattatagtgtaacacaagaatttgtatatttatattatactttattaattaaaataactacttcgacatctgaacgcgaacaaattttccttcctcccagcttcttcaatgaccaaaggcaatcaaaacccggctttcaaggccttgggattgcccagattgaggctaccatcccgaaattggtgtattttttggtctattttgggtggtacgattggttctatcgtgtatgacaaatatcaacaaaaacatatcagaaccttgcagatggccaagcttgaccacctcagccatgcgcaagttcctttcaatatgatgccccgtaaaataacggtgttcattgctcctccgccatcagactatttggaagagactttgagagttttcagaaagtatgtcaagcctttgctcaattctgctggtttggacttcgagatatacaccgaagaaagacagggcgacattaggttcaaagtggctgaagatatcagaactttaagaagagaggctttgaatccaaacgcggacgacaataaatctgagcattcaatttggaacaaggtttcctcaaaactttccaagagtcagaatactcaagaagacgagcctttggtcaagatgagtgaaaaaatttcagtgaaggatatcattggtatcacactgtataataaaaatgacgaagttgtcagagaagatcaattggtgcgatctcctgaagatgctggaggtgtgatttgtattggaagaggtgctttcaaggaattcatgaatggcattcatgagggtttactgggtccattagaggagccagtgagggatgagccggtggtactagattcgaacgaattgaagggtgaaaagtcttcaatagttgcccaagaaagtgagtttattaatgaagaacaatccagggatacctctggtgagtcgctaatagatccatccaacgaactaaaagtcatacctactgcaacgtccgatgaaccaactaaagaaggtgaagaagacgatgaaaaaccgaaaaacaaggggcccttgcccttcatttacccagaggattatgctaatgcccaactggctccagagttggatctctctagaccaattttagacaagaatggcgtgcccattatatatcaccaacctgttctcgtcctgagacagttcaacctccccgggttcataagaacgcctgaaagattgtggagatttttcacaaagagatctcaggcagagtattactgttccaaaacagagaatcttgttctcagtagaaagcatccaatgacaattaaagaccaagagttggcagtagaagaggaacgtgactggcctaagaaatgggtgaaaagtgccaaagagcgtaatagtgaatgggtcagaccattcgaattcgacgatagggttattcgtcacatgtgggttgttaatgacgacgtccatgatgaggacactctgccctccgttaactgatcaccacgtccatgatatatacttgtagatataaatcaatccatgataaattaatattgtataatcttacctcctaacatcgcttctcaacctatagtttgtttggctctataaacagggccttctagaacattatgaggaggttctatagccagatcgcccgtagaaagccactatttgacgggttagaaaagtacctcaattcttccaaggtacccaatactaccaagaacaaaatttcaacagtattgaattctttgaaggtccagttgcagtcacaagatagcaagtactctccttatactgtcaaagttggaatttattctcatgatactcaattgtcagtcaaattgacaaaagcaattcttgtggatccgctagatcctaaaacttactggagtgactatgaacaaagtttggatatagctaagaataacgtctatcaatatggcgaccagtttcaggttgacaataatattgaatcgaactattatagaatacccagccctttcctttcttccgagtataggccagttgtcagggagaaaatcaaagaggatgaagtgaaagagattgataacactgaaattgggtacgataaacagtactttaatgatatttcgatagttcaagttaacgcagagcagccgaaactagatgacggctcaattcctaacgtgaatagttcaaccatagatttgaacaagaatctgaacacaaatcttaaagtttcaacatttgttccaaaaattctctatgactgtcatttcatcattcatttgaagtcaaatctgcatgacacactccccccagagttatccgatactattccagttttcacgattgtaaacaggaatcaaccgatagccaaccatattaccgttgatgttgatgaagctataaaggctaacgagcttttaatgaaatcgccttctaattcaactcaatatcttaacttgctagatgaatctaatattcatcaattacttaacctgttgaacattgaaacatccaagtacaacccgataaaatgtctttcggcaactataatcaatgacttgtatgcattgtttgacaccagcattgggggctccaagtcaccaaatgaaataacgttaactccgagactatccgtctccaaaagtcaaaaagaactcgagaaggtcaaagaacaacttctggctagtataaatgattggagatacaatgcccatatagctttacaaaccaaggtgatcccatttgttcataacgaagtggtgaacaagttttccaaagtgcacagaaatttagctcaacttgacgatttgaacgtggtaatatcaaataaactgtttgacgaaaacacagatggatttttgggtcaagaaataatcaaattcaatcaattagtaggacgcattagtgccctgaacacggaaaactcagctactttatcttctgaaataccccttctagacttgaagcaattagccaaagatgataaactactggtattacagaaccaaatatcggattatactatcaaacagttatttgtcatcaatatcccaacaattttagtatccacgggattttttgtcaagggattttggtctggtcaatctttagtcgcagttgtactcttgggactggccatttcactgaatgacatcagcagaacgctcttcaagagtttgtcagagtttgagaaatggtacgtcaactcacttagagaaagaattgaccaatcggccaatcaactgacaatattattacaacaacaggtcaagtccacaaacgacacattaattcaatcattgaatgaggttgaagaattagaagccacttttgaggacttttggaaagataagtaatccattaagtatacgactgtattacataatatgtaccatctcatctcatgcatatctcgaaattgtgcatagggatcttagaaaaaaatttgccttcaatttttccttttccctcgttatactccactattattgaaattgcaatgcattttacgtgtaatacttgtggattggcgttccatgacgctgagaatcagagggagcacatgaaaggggactggcacagatacaatcttaaaagaagggtggctgatttgccaccagtagatgaacagacttttaatagcaaggtttccgttttgaatcctaaagaaagcacagacacaacgaagataagaggccgcaaaggaggcaagaatgaagaagatgttcagaaaacggtaaccaaaaaggaacttcggagaaaggaaaaggaagctgcattgctcgagaagaagatggctcttctggagattgctcgtaagagaatgacagaatcacagcaaccaaatgacgaaacagtaaaagagacaaaacctgatgctcaggagtacgtaatactagacaaggataccaatagctcagaacaaagtacgaaaggcaccattgaggaagattccctaacggaagagcaactgtacgaagaaaaggttaagaacagagtcgagatcaaacctgaggaatgtctgttttgcgggaaattattctctgatcaaaaggaggctattacccatatgttccattcccatgggttgtacattccagaaagagattatctggtggatgaagctggtctgatacattatcttgctgaaaagattggctttggaaacatttgtctgtgctgtaattttcaaggaagatctttagaatctgttagagatcatatgctggcaaaaagacactgtagattgccatatgaatcagaggacgaacagttagagatttcagagttttacgattttacatcaagttataaggcaaaggaaaaattgttgttgttgatggcgttggcggaactagcatcgatacagatgactgggaagatgttgaaggtgaagaaaatagtgacgaagaagaagcccctaaggaggtttcatacgttgttggatcagatctggttcttccaactggattgattgtggggcacagatcgttacagcgctattacaagcagaatctaccagctgagcggggtttgaaggagggagaaggaacagttattgcagcagatgcaagacatttgtctgtcacctatgataagaaacttgctcaagaacaaaagagagtgtggactaaacagcaaaaagatgcttacagaaacgatagaagatctgccaagttcatcaataaccagccccattttagagacgagcttttgcagtgattttacatttatatttatatgtatttttttagtataatgtcaatgcgatgttggatgaacgtatgttggtatttttacccatcaaaggaaaaactactgggaattcgcgcctctgtacctcttagccttcttatctacgacttagcttctctcttcttcatatccgtttacatcacactgatgagcttaaaatgagtccatctgtaagaacggataatggaacaataataaaatggatggtagtcttagtgctgagccttgccttgctttgggaatgtttcgtttcctttcattttggtagcacacctcatgatccgttgctacggctccaacatgtggctcccatcgagaacaagacgaggttcagaatacgacacatctaccatcataatagtggcaaaaaccacagggttcacaaacgattagacataacagaccagtttattgcaagatttgacttggatcagccaaatatatcaggattggtcaacactgatggaaatgaggatggcgaatttgatgatccagaaacgctgatgccctacttctccagggaatcaccctgggtgtcagaatttgatatgagtggctatatcggaagtatacgccgaatggcagaacgagacccagactttgtagagtcatatttagcttatgcgagggaaagtggtgctgaacaagtctcaaagataacccttgattggaacgatgatagggatatcctgccaaatgtcaccaacaatgagaccatcatgaatcttgccttgatgtcctcaaatgcatacgttagaatccctggagagggcgattggaaagacgtcaacaaaccttggtcagtaaacaagactgacgaagagggtagcactggctttggttggatggaagatggtgtaagaggtcacgtatttactaacgaggactcctcaattgtgattctttctataaagggaacctctgcccagggactgcccggcggtggtggcgaatcagataccatagaggaagataagatcaatgataatttattattttcatgctgttgtgcccgagtttcttacatgtggactacggtatgtgactgttataagagttcatatacttgtgatgaagattgtctggagaaagaattatacagagaggacagatattatcgagcagttctggatgtataccgaaatgtaacaaacttgtatccagattctaccgtgtgggtcacaggacattcattaggagcagctcttgctggattattaggaagaacatacggacttcctgctgttacttttgaagcaccaggcgatcttctagccacgaaaagattgcatcttcctcaaccgccctcgcttccgtcatatttggaacacatatggcatttcggacacacagcagatcccatctttatggggacatgcaacggggctagttcgtcgtgttcagttgccgggtatgccatggaaacacaatgccattctggcaaagtttgtatttatgatgttgtcaatgattacggctggcacgttaacttggtaaaccatcgaatacatactgtgatagacagcgtattgacagcatataacaagacagcctcttgtgaaatccctctgccatgccatgattgttataattggaatttcatcactagggacagacacaaaggtagagatggagatgataaaaacaaaccaaaagagcccaaaaagcctcaaaagtgtctaagaagatcatggtatggaagatgtttggaatggggtgatgatgatagcgatgatgtatccacataagctttgtacagttgagaattcaccacagctttttgataactggtttcccatctactttataggttagagttgccttatcaattagaagagttttggtgtggtcaaattgaataagtcccgtaaaatgaacatcacctgaatctggatcaatgctgttagacgcactttttttggaatctttgagagagagcctaccttttataataatgtcataatcagcatgaagctgagattttgtatcgtataggaaatcaatgctatcgctattctgtgtagtgaagggttctaacatgtccagtactttatcagtcacggatatttctctattggcccattgaaaccttggctcgttcttgcctttactattggcattgatctgcaagccctggaacgacacgttatgaaacttgataaaaacttgaaacgtttccaattcttcgtcaacttgaatgggtagaccaaaagattgttgaacatgtgaacttaaggacaatttggtaaccaatgcagacttacacttccgtttgagtttatccatatcaagaagagtgttgttctctggggtcaattcgacggtggactggtaccacaatgggatgaagacatcctcaccttttgaaatattgtaagctgtatatacggataacgacactgtgatcgggactaatattgtgagcgcggccttgaatacatttttaaagttgaatccttgctgcgctaggtagtactcttggacgttctccttgagcagcttctcattgaggtcgctctttagtctgtaatgggtcttcaaaggtttgatatagtgaattggccttttgcagcggaaaacagattccaatttggaagctgattgccgaaacatagttatcagctgctaaagttacaatcacaaggggtagatgattgaaaacagtaacgtgataagatttgttaggaaaatcgaggctaacataatagattacataatcttggattgattggttggccgcaatgtggcatttttcctttttttattagattttctactgatcttagagctccagggatcagcggaggaatattagacaaatcgtacaagtgcttggcgggcatgcttagtagtgtctggtgcctgggcaagattgggtttacgttgcctggatctagtcacaaaaaacgttccccatatttctgccggtgagaaatgccgtttgtgagaaaaatgccacttcgttcagatagattttattgtaggagcgcagttgaccttgcatttaaagaaatagtgccaactgttttcctctcggcatgctccagcacgagaagcgcccgatgaactctttgatctgtcgaagcgtttctttttattgcagcctctaattcatgataggcagaacaaccaataaaacaatttcagtgcccctgatgtagggctgcattgatagggaaaaaaagtaaaaaagttgactcccaaaaatgtgaaattttccgtctgcaaggcttttttcagcttacaatgcttggcacatgcatgatgaccgataaagagagaaatgccattccccttatgtagtgatctgtcaaacgggtgggatacccaaaaaatgcccaaccgggtgcggtgctaatcatgaccctaatcttgattgctggaagcagataagattgtagatagtggtttcatacccgaacgtatataaaagtggatagttctcctctccctagtctatcttctaattaccgtcaacacaactatcttataatgagtgacaagaaaacatccgtagaggcagtgattactgaggttgatagcagtccagcctatgaggcaggcagcatcaaatctgagaacaaaagaaacttcgttcagaattggtttgatggtttcaagccatatgaaatggaggaactggatccaaatctttcggaggtggagaaggctgccattgctactgctaacgcgccattgcaaagaaaacttaagaaccgtcatttgcagatgattgccattggtggatctattggtactggtttatttgtgggttccggtaaagctcttgcagcagctggacctgctgccctactgattgcttggggtttgactggtatcatgatttactttaccgttcaagctttgggagaattatctgttaccatgcctgtttctggatcctttgccgtctattctacccgtttcattgacccttcatggggttgtgccatgggtttcaactacgctatgcagtggctgatcgttttacccttagaattagttgccgcttctattacattgagttattgggaaggttctaaaagtgttaacgctgatgtttgggttcttatattttatctgctgatcgtcgttatcaacctgtttggtgtgaaaggttatggtgaagctgaattcgtcttctccttgatcaaagtcatcacagtcattgcatttatcttcatgggtatcattctgaactgtggtggaggtccaaaaggtgaatacatcggaggacgatactggaaaaacccaggagctttcaataccgagtataatccatttaaagccgtttgttccgtctttgtcacatctgctttctcgtttgcaggtactgaattggtcggtcttgcagccgctgaagctaccaacccaaggaagtcccttccaactgccatcaagcaagtgttctggagaattatgttgttttacatcatttctttaactctgattggtttattagttcctttcaacgatccaagattgatcggttcaagttcagtagatgcatctgcatccccattcgtcattgccattgtcagtaacggtatccatggtttggactctgttatgaacgttgttatcatgatcgcagttctgtccgttggtaattctgcagtctacggttcatcccgtatcttgcaatctcttgctgcacaaggccaggctccaaagattcttggctacatcgacagagagggaagaccacttgccgctattggccttactttgttatttggatgtttggcatttgttgctgcttctcccaagcaaggtgagatgttcgactggctgttagctctctccggtttatcttctattttcacatggggatctatctgtcttagtcacatcagattccgtgcctgtttaaagtcccttgggcgtggtaccaacgagttggttttcacagctcaaggtggtatcatcggttcatggattggtttaattatcaactgtctggttctgattgtttccttttgggttgctgccttccctctaggtgataagtcctctgccgaaggattcttcaaagcttatttgactgtccctgttgttattatcgtatacgtgatccataagatcgtgaagaagaactggtgcttatacgtcaagctcaatgaaatggacgtcgacagtggacgaagagacttcgacttggagttattaaagcaggaaattgtcgaagagaaggagactctggcccgaaagccattctggtaccgaacctacaaattctggtgttgatcatcgggggtataatacatgtattttgatagaactttgatattattaattatctgattgaattgtaggtccctatgcttttcagaaattgtgccaccatttttcattagttgagcactataaaacagttttcaagattgtagtcgtctaactcctcgcttggttgggcggtaggagttcagtcggaagataaagatctcttcgcgataaggtttagactacattcagtttctccttgatctattacatactcccaagtatgactaacgatgctccgttatgggttctaggctatggttctctaatatttaagccgcctcctcatgcgacacataagattccaggcaaaatctcaggttttgtcagacggttttggcagagttctacagatcatagaggtacaccggagagcccaggaagagtggtaaccttaattccgtacgcagatatagtaagggatcaccggtttctagaaagtgttcattactttgagtgtaacggagataaaaagaacatcatcggatcagacttgcaagtttggggttgtatatactatatccccgcacagcacagggaggaggtctgcagttatctggatgtacgagaacaggacggctacacacagcataaagtcacgttcgaagtagagttagatgacgagtacttttctcagaacccggagatcaaggaatttgttcaatcccatactatcgttgatacgcatacgggcaaaaatgttattcattctttggtttacataggtaccacttccaacgagtcgtttatagggccggaacacccgacaacaactgcaaaagttattcgatcgaatgagggtcccagcggatcgaatctggattatcttaaacgattgcacagatcactgatggatctggataaaagtggtaacaaacgatctcatgatagatacttggatgaattgattcagttggttgataaggaggattcttagatggttcttaactaccattacccagtctctgtcctctgcctctgaaggcctctgtaatagtgcttttaatgaatgatgatgacgatcctgcagtagtgcctggcctcatggttgcatttcttatcgcagtagcttggtttttccgtctttgattttgatatagggaagatttatagttgattccagtgagccttatgcaaagattcgtcagccagttaggagcttgcagatatccataatcaccataaatccaagttgatgcttgggtgttcttcaaagtgcccactcggcgaatatttgcggtggcattggaaacatccttatcgtgcttggagaaaagtccaatcaatggtccgaaagttttggtttcaatgcagttgtatatgtatgcagcaaacattccgactgcacattggagagcaaagtaacgaccttccaataataacctgaaacccaaaaaaacggcaggaagtagggaagctttgatagacatgaaatagaagctcacttgactattgtagttattgatggaccaagtataagtgagggccgaaagaagtggcagggacagaaacactccatcactaaatatcgaaaagaaccatatcaacgagaccacaatcaaatgataatagatgtaatctggaaggttgaactggaatttaccactttctatatctcgactataggtgtacatcaggtacgtttcgaataatccttgcattcgctcagggctcattaccaggaaccctgtgatgagtctataaaactcccatttttcgtatatattctgccaatagaacacgaacgagatagcattaactattcctagcgagtcgagacctgccaatgtcaacgtggaaagaactaaggctctagtaataggagggatatcacggataaacctgattgttagaaaaagttcattggcattaagttttgtggcgggatacttactgggttagttctgacatgtgtgacgtgtatagaggtaatggagggcgaagtaggggatcgcaaatctggatatcaggacgcgcggccatgacgtagcgcacacgatgaaatattatccaggataggactcaccgtttatttgccacaagcacacgaaacgagatgttgccagtgcaaatggccctacttttggagaattggactctacgtttcgttgactactgactggtaacactggttcaattttaggttatgcagttttttcaacaaaggtattctgttgtgtccaatcaatggatgggatatcaaaccaatttcgtctcagtcttgcttgtaaaatcacaaaggttaaagttttcagaataaaaagcttattattctagaaccaaatcagattaattttctgagtgactatatatgattaaaatccttaggcccttgacacgtcctctacgaactcgatgtctccggtatccttttcatcgcccgtttttagttgctggttcaaatgagcatgcttctgtacagtcttcccacgagtactaaaaacaccacccgtgaaaccacctcgtgcaaatattaagtcaatatcctccagctccagtccattagtctcagggaagaagcaatacacaatggggatccacatggcattcaagacagtaaagataataaacgtcttccaccctaagtttttcatggcaattggtgtaatcttcacaatggcgtaaacacacatccagttccagccagatgcgatggagcatgctctagccctaagcctggttatattcaactcagaacctaaaaaccatggcactggaagaaaacctactgctaaaaagatttgaaatatgaaaataaaagcaactgctgcatacgcagctgcttgtatctctgttgacaatagaatggataccatcatgaagcagaaacacagaccaccggcagagaccatcaacaaggttctccttccaaacctgtcaactaagaacacgggcaaaacagaaccaactaaatatgtaattgaagtgcaaccgccgaggatcatactcatttggttgtcaaatcccatcgttttctggtacactgttggcgcataatagttgatcatattagaaccagtaaactgctgcatgatattaacgccaatggtgatacatagtcttcgaaaattttgggttttacccatctggagaaattccttgaacttgaatggacctcctgcaaactcctcatccacggtagttttaatatcaaacaattggctttcaacttctgggtcgtcctccgatttgtccagcaaacaggcaataacatttctagcttcattcaatcgaccatgagctactagccaacgtggagtatcaggcagacctattgcctgaataaccaaacatacagcaaaaaaagcttggaagcttaccggaaatctccactgaaaatttgaatcaacaaaactagttccgaatccagcccagtaagcaatcaccaatcccaaaatggtaacagttccttgcagtgttaataaggcacctctgatatttgcaggagagcattctgcctgtaacgttggcacggtggaactattgataccgtttccaataccagtaataactcttccagctatgaaaattccaacaccattagcagctcccaagaacacagtaccaataaccataatggttccgccaagaatgagtgcctttcgacgacccaattgttcaccaaagaagtaacaaaatatagacccagctacgcatcccaaatcatatgtaccagtgatatcaccctgtaagtcttcattaggatacttaaaaaacttgttgaatgtaggatctgaaatcaaacatgacatgacaccctggtcatagccaagcaagagaaagccttggagggcacagagcgtgattgcccataaaaagcttttcccacggagaaaatcttgatactggaagagtttgagcatgatacgtctattgtagattaagtgggttcttacgggttgagaatagattgccatttatatgcaacatagtaccccaacccttgtagattgatcttacaattgatcacaggtttactagatcttttctccgaacggttctgcaatatggagcgttaatccggagtgtaagagtcggttgagatatctcggcggggaaacgatcttaccgggattttattcttgtcttttaagagaacgcgcagaaagatatgttacttgtacatcctccaaataattgaaagatatgaggggcggttggaatgtgttcatgacgtcacataatcggtgtccggcaaatgccctcttttcaagcttttctcaatgcaattatgtaccttgtcttgacataaacagttgacgaaatggcacaatagggtgattgaatgagtgctagcggctggttgatcgtaaccgtcgcctgtggtttacttccagggttagcaggtcacggtatgcaggaaaatttttatgaaccgcattttgatcaaagtcctgtagccaaaagacggttatttcaactcggtacatagatacatcgaggtctatgttttagttgcagaattgatgatgagcactgcatctgtttggttgatctgaggttgcttctgtcggctcatcttttgatatcttacattgccgtgggttgatcaatcgaactttctctgattctcatgtttcagaattttgtcttctggttaatcctttccaagtgggagtatcacatgccgacagataataaccgatggtatttgcacaattgagccaccatcaatactgtgaaccagccaacatacgcaggtttctcgttcatgtgctattcacacaatttggtatccagtgtaataattgctgtaccgatttggagactaactgatggagttttcaaatgcaaccattgacgaagttccaaaatagcagattgctaaacaactcaagaactttctaacccgcctaatcttcggtgccttacaatctgttaaactatagggtgacaatttcgatattcgtatcagatcagataggggcgcttcataatagaacagagtaccgtctgtctatttcacttattgacagataaagctgccaagtcccatgtccaaagataagcaggaaaaataccttgcggataaactatatgcttgccaagacttaactacgcaggtatattacgcacaagatattggctataaaaaatgagaatcacgtacaattgactgcaaggggcaactgctttccgtctttggctgttcaaaagaatctaccaaaagtagaaaagtagctcaagtaacggaggtagttttatgcattcttatctcgccgagaaatactacagccctaaaaacgctgatatcaataaattctcaaaaatcttgcttattgttctggaatcctgtcttccaagctgaactgtctcacatcatttgagttagtaatggaggcaatatttttaccttacaagtcctcctagagctactggtgatccccgaatgaagtaatcatctattcatatcttgaacacttctgagacgatcggatttctcagcacagtgcaacaaggtgtcaaatgaaggtgttacctatagtgcccctcccccccttcaaggcagttgatcacaaatttaccgtcagattttgagattcaattgagtagtcaaagacaccatttcatgccgttaaatatactgagaactctcgaatcagatcccgtttaccaaagtggcatctccatccttatctcttcaacacctccctcctcgtcgtcaagaatgagcataaaggtttctctacttctatattatggctattacagaagtggtttcgatcgttacagggacaatagggacgatattatggtgtatacagttaatccctcaaatcatttacaactatagaaataagaactgtgagggtttgcctccgcttatgatgttcctgtgggctgctagtggcatcccattcgcaatttatttcatagtcagggactcttatattccaatgcaggtccagcctgttctattttcggcattatgtgcaatatcatggattcaaacgttgtattatcctccttcacagctgaaaatagtcaaaattgtatcgttggtgtctgtgtttctcgttatcgctttaggtatgatgatgggttttataatgtggctaagacctttgtacattgatgagaacttggaatggccctccttgattttcggaattttggcctctataatgctactagctggacttgttcccccctatattgagttggccaaacggaaaggtcgagttttgggtattaactttgtgttcctttctatggatagtgcaggggctgcgttctctatgataagtgttcttgtggacaagattgatataatgggtgccattttatatgctgtagtgttgatcatggagttgggtatttttacgagtcacattatgtggtggttgcgtattggacaatatgttgagattgaaggcagtatatctaccgatgtggaaacgaatcacttggaagaaaataagttgttcgattcaagtgtcaaatgagtagtttccttttgaagttttcaacttgagatttggtgggccagggccatttcaccactagagaatcattatcaaattgcaattctggtttgcgtgataaatcatcagttctaattgctggaactttgttggtgatattcgccgttacatgccgtaacaaattgtctgaaatttcatccgggagatacccaaacacattcaatagtgttctttcattaggaatatgcctcagatttacccatttttccaataaatccatgagtagatctgtgtatccaaacattccaagcatctgggtgtaactgagccacaattgattcgttggattcaccaaattgggattatcacctttcgttgacttggcggtccatttttcaacttccatgatacattgttgaacggctgtcatcccattccacatcaaatgcttcccggatctttcatagaacgttatcacagagatggtcaacgaagtcaatattttctcgttgacagtttcaaactgtctattaaaatatactttccacactttctctggagctatacgtgcttcaccaaacatcatagtgcccactaatgataatggtcgctgctcaacattggcgtatacgaaccgagtgtaatctaaggtggacttgaactgtttatgctcaacaattctttgattcacaatttctggatattttaaataatgtggtgccttttctttaatgcactcttcaaaaagacactgacgataaaggtttttcaaataagtattcaacactaaatttccaagagtatgaccggcttttgagtaattggtaatgatcactttattcatctcaatatcggagatccctgtaagaaatacacttaaggcctcttgatcgaattgcgtgctcaagtaggggattaaagatttcaccagtttgatgtcggtaccagagtggagtctaaactgggctttcttagatagccaaagcccccataatgagaatcccaattggtgcagcaccgttggttccgtgctggctatcagcttttgatgtgctttgaacaaaatgggtttgtctatgtacaagatttcagtacccaatagcatggctttggtacgtgctacattgagcgacgatctttctaagtagtgagcaattgatggtgtttgagaaacaagaggactggcgtcttttctatttataagtgatcttgctgcttgtagaatttcctttcctttactatggttaatgtgatagagagtgttcgataatcctaataggatttcaacactaaccttggagttcaaatgccttattattttctgctggcattcaagaatattaaaatataagttatcgtcccttggaacttttgaggaaattttagaaatggaccaaactagatgattcaaaaatggttcgtttgaagtttgatctaatactttgttgataatttctagcaaccttgatgatgttctatagtggcaattttgaattagattgttcaaaactaacatactctttttatcagagtcattaatttggtaattagggtccaagtataaatcaatcaataagtcaaactcataattggatctgggtgttcttaataaaatgtctgtaaccaaaaactctggtaatgtctctccttctaaagcgaaacatgcttgcgttatgctttcactagcaaccgaaactagccaattgtgtaacgttgaagtattgataccatagtttttcagtaagtagatcgacttaccaatcatattcctcgtgtactcagagacatgaataggataaaaggaatttttaaaccagtaacaggccagtaatttatcagaatcttttttaattcctcatgattgtttaacattcctgtgttgcaagctctatccaacaatttacctaatgggatgcgccttgtagttctattctcatctgaggaccgacttagtgccaataaaagcaaattgaagcacccttccaaagagcttgggtgcagcagctttaacaaaagttttctgcctggaatttttacggcgcaatccaactttgtagtttcgtatcccattatcaaactgataagaacatcattgaaggaatccttcctaaactccagattgtagtgaccaggaccattcaatgagtatcgctggttggacttttcgtacgtgaacttcttagataaggagtctatgaaagctggaactagtgaagagctccttattcgtctccacatccaagtacttcttgtatggatggaaacagaaaaatgtctctactggacagccttagaagaaaggatggatctttcgagggtcataattgtgatgaggttcagagcaaaggaaagcaaaacgagtcataggggtattctaaagcaaggacacagtttctgatggccttacaaacatgatctcgtattaggcaatggctgaactagtgagagtttgcgagaaagctatctcacgactgacatcaaggggtactctggtccttcctcccatcttgccttgctgataaagacccctcgcgcaaagaatgaaagtactttatatattctttatgttgggtacagttccagctcaattcagggaactcgtacgagaggaggcaaggaatagccaacatcaagagagaaaaagaagaaggagaaataaccgtaaacaggcacggaaggaaaaacacaaagtttcgactaatacggaggtttctgaatccgatgagaggcaaaaagaaggtcaagaggtgattatcctggatgatgagcttgctcagcagttgatagaccaagaaaaaagcaaaagtagaattgaaaacgaagaagaagaggaagaagatattgacgatgagcaattcgaagaaattgacttaaattttcaagattttggtgacgaggttgacccggctgaagagatggttttaacttacgataaggaaccccaggaatctaaaagcaaaaagggtaaaacaagaagggtgaacatggtttctgcagaagagcggaagttccggagggactttcatctgctgtacctcatagtgatggcatgttatggtagattgagaaatgcttggtgcaatgacacttcattacaaagattcctgaggctctcccttccccagaagttgactgatgaatacaaaatagtgaagcagaattggtcggactcaaaggttactgtgtcactgaaaactaggaaatttctagactttctcagacacttaatgtggtattggaatagctcatacagaataactaacagtttcatgtaccaaaaaagaaactggggtgagctaagtaaagaattttcgcatgaagaagtcagcagagaaaagtttaagtacttgattagaagtcacatgggatcaagcgagatttgtttggaaggtttcgtaatgcttttgcgatctttggggctatatactaggttggtcatttctttgcagccacctgattttaccaatgttgctgcagtagatttttcagtatctgaagagaaaaaatcctcttcgccttcagtaccaaaaactaaaaaggtaactaaagatgattacctatctctagtccgaagtgggaaacctcgctcacaatcgaagtcaccaggtccaataaaccaagaggccccagaatatcccgtaatgtgggctgaagtatgggacaagtattctcaaaaatggatatccattgacccagtagttcagaaaacaatagacatagtcggaagaaaatctaaatttgaaccacccttaaacaataaaaagaacaattgcttttatgtgattggatatgatcaaagaaatgctgttcgtgatatcaccagacggtacgcttctaacttgaattctaaagtgcgaagaaaacgtgtaactagagacccacgctatgccttatggtgggaaagagttttgcgggagttgaatactccaagaacgcgccatgctagcaagatcgacgcactagaacgagttgaatttgaagagcgtgacctgagagaaggcatgcctgatagctttgaagattttagaaaccatccggtttactgtcttgagtcgcagctaaaacagaacgaaatcttgtacccaaaacaaagttgtggaactgtccgaaagaaaagtagtaacgaagtaactccagtctataagcgactgaacgtgcatactgtaagatctcccaaagcttggtaccttaaaggtcgaatgataaagttgggggagagatgcttggctacaaaagatgcgccgaaaactgctgatgatgacgaggatgagactcgtctatatgcagagtttcaaacggaattatacattcctcctcctatcgagaatggtattgtcccaaaaaatgcatatggtaacatagacgtttatgttaagaccatgctacccaaaaatggagctcacataactggtaaacgggctatcaaagcagctaaacttttgggcattgactttgctcctgctgttgtagggtttgactttgggggcaacaacaaaggagtggccaatgctcgtattgatggtatagtcgttgccaaagagttcgaagaggcaatgagtttaacatgtcagtgcttacaggaaatgcatgaagaggaagaacttatgcgaaagaatattagacttttaaagtgttggaagatctttttaaccaagctgcgcataaaagaccgtttgaataagacacatggaaaattagaggaaactgatgaaacttatgaacagggaggatttgtcgccagtgatcgtgtttttgatactgacaaacaagactccaagtccacgcaggattgggataattattcggatagtagtagtaattatgttccctcagaatcatcaggaaacgaaacggattatggtataggtggttttattccctccgatgacgttagtgatcttggcaatgttaatgaacgtgaaacaaagctaggtggttccaccagttacgaaaatgaatttgatgaaagcggacatagtgaggttgcacaagcgggactcacacccaggagcggtagtgaacttgtagacaagaaccaagactcactcgaaggaggatttgtaaaagaggatcaacagtctgccgaagagggaggatttttgttggaagatgcagaatcaggaggatttttgccagaggatgctgagcttgataaagcaatatctgaagaaatcaagaaggctaaattcccagtagagactgatacattgtctggccagtttgtaggagatgaggaaatcattaagcaaggtgaattttctggtgaacaagattttgatataggccactttcagaatctaagagatgaggagaggcagggccctcaaacgcatacatcggaagagttgtcaaacgatgaaatcatgcgctcagagggaaggtgtggtggaagttcggtttcatatgctactgaggttgcagaaagtcgagatggtgatggaaatcaggaaacaaacttgactgaagaggccatggtaaccaatatcgccaaatttcaagaagaacaacaacagaagccagttgaaaacaacagcactcctattgtgattgacagtgcagacgaaccagaaattgctacaggtcagcaccttgatgagtttgactttgagtacagtgattccgagtagtatgtttattatatgcattgattgtatattcataattcatttctttaactggtttaacctctgccatttttcctttttaaggcgctgttccctttctaattctctcttgtcttcaagtactgcagacttcaatgccattctttcctctctctcgatatcttccaagtttgcttccatatcgtcagactcatcatcgtcataatcgtacctcctctttccatttctactgaagaggctccagatttcatttctatcatatccttgatcattgtactggttttcatcatcttcatcatcatcaataaaaccatccaaatcagactccacatctgaatcgtatctctgagccttgctagcattcttttttctcctagcggctaattttgcagctaatttagcggaaggtttagctattggtgggggaaccatagccaccggaggttttgaacgtctagcatggttgtccttcaaagacttttgaatgtcccttgtagatgtctgtctaggtgcagttcgggaaatttgactgccgccctcttggtacagctgggctggctttttgcttgctctctgggatgcctccaaattatcttggggttgtgaacgcacgattctctttctgggtacttcgttagttttcttaggggtgactactactttattagctatagcaaactgagatgagtctatcgtttctgcctttttcattaaatcgccaaaattgagtggtttagtaggtttgcaggattttgtttcaactttttgtctagcggatggagggggagtaggtcttgatctggatgttgacaacgggggtctctgagaattgatcttgggagctttactggttggtctcaaacctatctgggtagcatgactaattcttcgcctttcccgagcttcctgggcttgctgagcctctttaagagcttgcttctctctttccatcttcctttctgctttcaatcttgcaacagcaggatccacagttctgggccgattctgaccagaagaaccaccaccgccttctcctttcagctgtgataagaggtttgataaggtgctcatatcagagtgtaaagaagacgggtaaacaagcctatgctcaaaacactacggaagaactgaaattggtatgcagcatacaacgaaactagaaacgtcaagactgatattgggtagtacacctccataagttgtcttctatttgaggtgcaacttgagaggatcacgatagagatgattaacgcacaacagggatagcaaaaatcaatgaaacgaagtgaatataattaagcatacacattgtattcaaacctaaacttttaaacaatcaaatatctgattggaatatgaatgagcttgacaacgtaaccaaccacgcccatcattaaaaacccaactccaacagctcttactatctttaagtactccttctgagagggtttagtacatttagagatgaatttggaaccttccttaacaaattccagagggacgtcggtgactttttgggacatttgtgtaggttatttaggagatccaaatgggagttaaagacactgtaggtaaagggtcgaactgaacacgtcggtcgaggtgttgggatgcaaaatagcgagaaattgttattgcctgatatggttttacatatgtattctagatagttccaaagccattccattcttcatcttcttcttcatcagagttatcagcttcactctccgagatgacctcgtcatcgtcatcttcgtcttcgtctttgagttcatcgtcgtcttcacctgtgactgctttaccctttttatatttgatctgttcgtataactgtttctgtagcacctgaagaggttttggttttggtttaggctttcggtacgatttaactttccatttgccgagtcttggatcagcaagaactgcttcttggattttcaattttaatggtttatttgaggtatctttcttcaatgagacaaaaggtgagagtaatttgtcgataggagtttcatggataatctccatctttgttttccacagagccgtttcttcttccgcagagagtttgatcggttcctcttctgactcgttttcagtattctcaccttcgtcttcttcgtcactcgtttctggatcggtatcagaggcctcatcgtctgaattatcagtatctctggtttttttttcgataggagccgagacttcatcttcttcctcgtaatcttcttcttcttcaaatccaggaagcccactaaacataaccttttccaactcatcagtataaatatcacacaagtggtacgtaatagttctagggacaataatatcgttaatatggagtgggtattctgacaaaacttgaatatatttttcaagtaaatccctatcgtagtcttcacttttcagttttgctaaagatttgttaaggatcttacgaattaacatcaagaatttgtccactctccacttgtctagatctttccattctctggttatgacaacccaaaaggccctgaaaaaagggatgaacttggtttcaggaatattatagtacaactcccccaattgtagagccaagtgttgttggggaattggtttatcacaatgccacatggcgtagaacaaacctttccaaagcttctggtattgcaactctggaagaacttttgagtgcttcaaaaaactgccaagtttttccaaagcatcatcacgagttggtttgtcatgtgtagccaactgtttgataaaggcactggtagacatctttgaatttcacctagcttttcaggttgaagaaaaaaaaattgaaatttgagaaaaaaaattcaggttttagcgataggaaattgagatctctaacccgatgacttgatggctatcattgattattaataattgaaataacatagtgacaagagtacgccagcaatctttaagaatttttatcaagcaaacagaaagctgaacatgtcaaaacaaccagataatacgtatgtaccaaagttcatcaaggatacgccgtggtatgctggggaacatcaacgtgaagaaacgaccgagaaaaacatcaaagaccggttcatcaagcataagggagtgggaaaggaatgcaaaaattgcggaatgcctcataatgagaaggactgttttgaaaaaccgaaaaggcggaaggtcaataaacagtcggatacgataatggtacgagataccgatgattgggacagtaaacgtgataaatggtttggatacaatgctgatgaagaataccaagaacagctagctaaatggaatgcaaatgaagccaagaagcaaagagcgaaattactgaaagacctgagtgcacaagtagatctactatacagttggatgatccaaggtggggaagtaaatttaacagaagctgagcaagttgagttggaaaaggagattttagatgaatattgtggagaaggggtcaagagatgtttgcaagacacaggtgatttggctaatgaagggtttgtaggtgaatccaaagtaaacgagtttgaaggtagtaaggtgtttgcatggggaagggagaaagggagtgataccactgtggctatgaaaggtcctggcggaagccatggttcagatgggcaaactaaaaaccaagataaatccgccattgaagagaaacgcagaaaattactagaaaagtacaaataaatcacgagccatgatcataatccgaatttcccttggttggatgcacttgatggatgcttactctctactctacttgagaagctgaaattttaacggttggaagtaacatacccgaatttgtgaaagtggatacgggttgcaacgtcaaatgctgtcgccgttcctgcatttttttcaatgcctacagctcaaaattttcatttcgtttttcatgcgttttttgcctctaacaggttttacgttgtctcccaagttatttaattccgatcggacgtttgaaacctattgtcaaggcgtttcttattttctttgtctatcggcagaaagtttgactcttcactgtcgtgtgacagattaatttgccttatgcgactcctaaattatcaattaatacgggattgcagccacgtgtaatcggaggtcgcgagttattgttacggaggtgcatcttccctcgactaagagtaaatgataagacctgtattatcccctttaaaaaaccgttagccaaagactacttctagtcgaaactcaacttcctgagtactcaaagtcgtgtgtcggtatctatttgtctactgactactacttttgggaaacaatgaaatttggagtcgaattcaacaaacgtacaattcagaagtggcgtctctataatattaattacaacgagctcaagaggttagtgaaagaaatcaccagcgtccaaaactcatatacagtagatactttaccagtgtctcagaaacggagattacaacgtctttataatgtgttcaaggagcaggttaactatgcctctctgtttgtcaacaataaggtctttgagttaacaaaaaggttggaaatactcacttctaacctcgagtcaatttcgaaactcctcccacctcgaggaaataccgtacctgagtcgacgcaaagactgatctcaaggaaaatgttggccatcagtcaaaggataaatgaattatctgctgatttattcaatctttccaggttcatcctgcttcaaaagattgcagttcaaaagctgttcaagaaatttttgaagcacagcaagttcgaattttcaaacgattatcttaataagctgtattatgactgtctcactaacgattctaaatctttcctcaatgttgatctttctaagatgaccaatcaagtggcccggttgttgagattgttcaatcaagatattgatctgaatgatttcgacacttattaccacatgcagtccctatttgacacacaaccggtaacacattcgctaaccaagaaaagttctatggtgtcactgtcagatgctgagttttcaagccaaacgcaactgtttgacctgttggcttatcaaaatagtcccttgcgttctcattactggatccataatgacaatttgaatgaggtcaggctagctctgtaccaaaacttctcttcgatacaggagccagattctgggaatgtcactgtgtaccttctcaataatatggagaaccctcaaatcgtcaatttcaattgcaaccattctccaaagataattgattatggtagagatctatccatcatccttcccggttgtggtttcaaactaatcagatttggaaagctgagttcttctcatttaccgcttcttctcaaaggtgatgttgacactgtcattaagtcattggactcgtcgagcaaactcaaccagcaaacaatagctatcttaaagaacataaaagaaaacaatctcaaaatttggagtaagtatgagtgtgacgcagtccgttttccaattcagttgaacggcaatgtgatttatctaattttgcttagcaatattgtttttgatagtttggaccctgaaaattccaacaaatttccgtacattgatttggtattgcattattctgatagcgcactcgtgtcagggtgtcaaacattacaatccattctcaattctcatttatgctacaagcttgtgggtaacaacaacaatttctccatttcaaactacattctctataagtttgaaagtgacagagtaatcaaaactctggacgaacaacagttgcaatctttgtttggtgcttgggttggcctattgaattcagttcaggacattagaaaactacctgttttcttagatatctatcaggacgacaaacccccaaagagtattttattaaacaagaacactgaacctgcagagagatattggaatgagttcgattatggctcagatgtggaagattcgtatccaaacgaacagtacagcaatggttatgaagatgctagaaattctcaaggtgtcttgttcaatttgaacgataagagagtgaacaagttcttgaaagtcagtcataaattcctttcttatcttggatttcaggaggcggatggaaatgaaaacttaacattgaaatcaccaaaacgaaaaaacaattactcgtccataaattcacatgcttcttcttccacactttattcctcttctgacgacgagtcgtctgaggaagcaacatatcctaactccagtagagttcaatttgtcaatcacaataatcacgatacagttgtcactttcctatatatggtgagccttttactttcatttttattgatttcaacagtagctggaatcatcacagcattattactctccaatgattctacgtcattcaaggatattttcattagtccagacaatgtacccatcactgtcatcatagttattggtctgtcatttggattactattgagtattctttcgataattctgttattatcgcggtacaactttcctcccatctcacatgtgatattaatttggtcatggtttaccatcttggttttactactagtaatttccatttgcctcatcatttagacatttacatactatgccgatcccttctaaacctcatttagtatattacataatatgatcgcgagtattttttagatttcctctaagatcatacatatatttcgatatatatgcagtagagatggatagtacgttgatcatagataatggatctaatacggtcaagatggggtacgcctctgacgagaatccattgatcgtacaaaattgtatttgtcggtcaagagaccgaaaattgcacctggcgaacgaacttaataggcttactgatgtctcgcaattgataatacgaagaccattagaacagggtcagttgacttcctggtacttacaaaagttaatatgggatgaaggatttaatgaactagtcaatggacacaatgatatcaactttaatgaaactgagctgctgtacacagagactccttttagttttcccgttttatcgagtaatacagatcaaattgtgttcgaagaatatggattcaaaagctattacagaaccacaaatgcggccctggtaccttggaataatgacgtgccaaataatgattacattccttttcaactggttgtggatagcgggtttgaatgcacctgggttatccctgtcatcaatggctgtgtctattggaaaggagttaagaagatgagcattggtggaaaatttttaaccggttatttgaaagaattgatttcttttaggtactacaatgtcatggatgaaacaattttggtcaacaatatcaaggaaaaaacgagttacgtagcaacggattatgaccagagtctgaagaaggttagtcaactgcgttcattagtcaaagatcccattaggagacacgattttgatgcccaaaacaaatcaatgggtaacgttgtactggattatgttctccctgattttaaaacaaccacaacaggctacgtgttacaggataccactgccaagttggactctgacgtccaactattacgattatatgatgaacggtttgccgttccagaaacttttttttaccctgagttagctaatatcaacaacaagtccggaataattaagacgattctggaatccttagctaattgtccaaaactggcaagaccactactaatggcaaacatcaaatgtgttggaggaaactttgacattccaggatttaagcaccgcctcttcatggaactgcgcaaggaaatccctgaaacatatgttttgaaactagatgatgaagatgacaagaataagtccctcacctacagctggaagtcggggcaaatatttgttaagaaaggagggttcgacaaggtgaaaatatcaaaacaggaatacttcgaaaagggactgaattacctacaagaacgatgcagtttcaaagcgtattaataatacaaactgtactataaaatactagacttttaaatactaataattcatttttcctgtcttacttttttccttcaattgctcgtacaactaagcagtagacatataagtagaagcatcaacaccctcagctggaaattcagcaatcttgacgtcgaatctgtcttgaatttgttccaaaatggtgttatcttcatcagaagagatgaaggaaatggcaagacccttggtaccgaatctaccagctctaccaactctgtgcagatactgagcagattcgtttggcagatcgtaattgatggccagattaattctctcaacatcgatacctctacccaagacgtcagtggcaacacaaatacgcttgttgaactctttgaacgacttgtaacgttcaatacgttcctgttgaggcaaaccagaatggatggagatagaagggaaattgttctcatttaacaaacggttcaagtattctgctctcttgacactcttaacaaagattatgacctggttgaagtccagagaatccaacagctcactcaattttctattcttatcagcctcggtcagcttgatatagtactgttgaagaccgtgcaaagttaacttggcttcgttgtcaacatagatttctagagggttctgcatgaactttttacagatctttctcatctcagttgaaagagtagcagaaaacatcataacttgcttctggaaaggagtctcacggaaaatagactgaacatctcttctcatgctcaggttctctagaaccttgtcacactcgtcgataacaaagtttttgacgttcttgacgttcatcaccttgtctcgaactaaggcgttcaatctaccaggagtagctactacaatgtgagggcaagtgtccttgtttttgagaatttcttcgtccttggcaatctgggttcctccgtaaaagacctcagttttgacctcaggcatatacttggagaaacgagcatattcattcttaatttggtaggccagttcccttgtgttacagataaccaaaacggatacttcgcctggagaagggtccaattgctgcaaagtcgataatacgaaaacagcagtcttacccaaaccagacttggcttgacatagaacgtcgttacccaggatggattgagggatacacacctgttggacttgaagtggtggttagtaaaaacgaatctttcatgactggaagggaatgaaatttcacaattttagaatgaattggcatggatttcttaagtctccaaaagcacagcttccaaaatattccattgatttttttttctagcaactatactaaccttcggaaggatgctcaaaaccacagtctctgatagctctggttaactctggtctcaacaagaagtcctggaatccggtggcgtgaactccaacgtaagaaccctttttgttggcttcttttccatcttctccagcttccttgtcagcagtggttgttccggatggagcaacggcgatttcttcggaatcggagtaatccaaaagctcttcttctccttcgtgggacatgtttgaggtgttggtgttgacgatgatatattccacgcgaatttaatttccaccagaggtggtcggactgaaaatgaggtcaacgtgttacccggcaagcaaacccccaacgaaaatgggttaccctgatgagatacaacacgcgtattgaaataatagctactcttaatcatcgtcatagtagtattgatatcgcttcacagctagagagcattccattcatgtccacagtagactttgacaccatctttcttaatcaatcaaaggctccgggtagatttagaatcaccagcagtggattgggctggaaaccaagctctcaggttccaactaagggcaagactgatccatttcttttgccatcgggtgatattctatccgtatcttggtcaagaggttacagaggctgggaattgcgtgtgtatactcgaaatgacaaagtgattatgctagatggatttgagcaacaagactttcagcaattgaaaaacgaaattcagaggacatttaacgtgaacttggagcacaaggaacactctttgagagggtggaactggggaaagactcagttgactcgtgcagagctggtattcaatgtcaataatagacctgcatgggaaattccttactcagagatcagtaactcaaatctgactggtagacatgaaatttctatggagttgaacccaaaaacggtagatgaaaatcactatgaaacgctaggcgacgagctggtagaggttcgtttatacgtacctggccaaattgacaaagatgaggacagcacggaaggtcaagacacgactgaagaagccaaatctaagtctcaattattctatgaacaattgaaagacaaggccgactttgatactacgtctgaggcaatcgtctcctttgaagatattttgttcctcactccaagaggtagatttgaaatctcgatgtatgctaataatttgcgtttgaggggccagtcttatgattacaagatccagaataagaacgttttgagaatattctctttgccacgtttggatgacagacaccatttggtcattctgcaagtggatccaccgctaagacaaggtcaaacacgttatccatttttggtcatgcaatttgaccgtaatgaggaattggaagttgagctcaatttatcagatgaagaatataaatccaaatatgaaggcaaattgaatcgaagctatggaaccgattctacatacaagattttgagtcactgccttcgaggacttactgaaagaagagtcatcactccaggctcattccaatctcaacacatgcaaccgggcgtcaactgttctcttaaggccagtgaaggccaaatttatctattagataaatgtcttttttttgctaccaagccatgtgtttatctgccctattctggtataatcagcgtggtaacatcgcgtggtactggacaatctacttcacgtacgtttgatattgaggttcaattctctggtggttcgcatacatttgctaatatcaataaggatgaacaaaagccgatcgaagactttttgaagggacaaggagttagagtcaaaaacgagaaaccagctgaattcttaggcaatgctttggtggacgatgacgatgacagtgatgatggtgatattgctatggggtccgctggtgaagatgatgaaagtgttgatgaagacttcaatgctggaagtgacagtgatgttgccgaagaatatgattctaatgctggctctgaggacgaagatagtgatgcatcatctggggaaccagagaaaaagaaacctaaacactaattatgacacaatgtctgatcagtcacattgccctattgatatcataagttatgaaagaatggtagaaagtcaacaggatcgtatcgaacatgtccgggaattgtttcaaggatacattgaacttttggaagaatgctgatagtaaatcaggaacagtggatgaagcggagacgacaatagaagagccaagaattgaagttgatgaaaatgactttccaggtgtcattattgaagattttattgaagagcctcttaaatttcaacggcctgtaaaagttgttgtttccaaagagggttgtattagtaaatcaggaacagatccacattgcgggcgtaaattaagaaataaacctcaatcgcccgatcttacagctttcacggaccattcagacgttcaacaatcttccgattcgccaaaagaatcagattctgaatcagatattgaactcatgaattcgcctgtaaaggtggttttcaagagagaacttgaaccaaactccacattttcaaactctgaagaggagtctttggagtatctttatcagaactttcccgacgtcctaacaccagagcatatcattttggtgaaaacagtaatcaaagaaatggacaatgcattacagccaataattgaggagatatcactctatgctacttattatctcgctcttagaaagaaaggattgaacagcactaggaaacagcagccagatgctcgaagaggaggcatttccaagaagacggagaatctccttcaattcatccaacaacagtcaacattatatgcgtttctatatggtacctgagttacaatgtggagcaatattacaactattacaatctcaaggatgggcgcattaattggcgttatgcatacatatatcatttaattacttattacatatctcttactggttaacccactttttcctcctctcacgtacatggatgtctgatggcaatagggctttgattagttacgtatgaagtcactgattttcagtaagaattcgttggtaccagttagagtttagttgtttggggctcaagtgattacagttgctccaggtcaacctggtaatcaactggctgcctggtttctagaatttaaagttcgaataatttagaacatcttgcgtagaatcacatcatcttgtctcctggtatccatggtcggggtttgtattttgagattttgcgcagtaagtagcacccgcttgacgtgcggctccgcctagacgtccctttgaatttactcaaaagactaaataaacctgggccttctcacctgtttttataccagaacctccaaacgacccgtggatggaccatggacaatacaagaaagaaactaaagcatgttagtaaagcatgtctgaggtgtcgtggaaggcacatgaagtgtgatggtcaacaacctgtttgcggaagatgtgtggatgaggaagccgaatgcatctatgttaaaagtaacagaggtggaagccgtaaaaagggagtcagcagattcaacaaagacgattcagattcttcccatcgactgcctgatctggagaaacagcaattggatgatttgatgcgtcttccttgcacaaaaaacccagatggctcgttgaattttggtaaagcggctagcctaacttgtgataaggactgtttgaaccactcaactgacgaaataccatcgtgtatgagtcaatcagatacgctacatcccactttcaatggtaaacaagctatagacgtcaatcaggtgttgttcacagataagccccccagacacaaaagatcttttacggagccaataacgattccttctagcatgattgaggatctggatctagagaaaattatcgacaactattacactttattccatgatgttcatccattcttacctcatcgcgttgagatcacggattatctcaatagtatacccaacaattatgatttgatattagccatgaaattgatcggagatggtcaagctactaccatatacgccaaagactctgagagtgtcaattttactgtgttgagaattttgaactacgtgaaacaaattgggaaagatttcgtaactctacaaacgttgttattgttgtcaatggttgcccacatttcaagcttgcacgacttgagtgctatgttgagaaaaaatctcgttgacctttgcttggaacttcaacttaactatctagatgattcaaacttgataggctcaatgaaggtggatatcaatgaattcccggtgaacccagaagatggaaatcaccaagttgtggagactattgtttcaactccacggacctcacatatcaataaagatgttctcattgaaacgataaggcggacattctgggaatgttatttctttgataccatcagtggcacagctaatggggtttctatctccaggttaaccatgattcacgcattgatacaatggcctacgcagcctcgtcttgagcaatttgactataagtcacgttcaagagcctgtaaacttgtcaacgatgcaatcaggctgaacgtggctttgcaagaagataaagagatagattctcatctcactaaaatgaaagctgctattggcaattgggagatgcagctggagaacccagaactatttgaaactccgtacctgataaacagatctggatttgttaatgagggtattcatcaggccatgatgttgttcaattatgccagaattttcactcacagaccattttcatatctttggcgaccagaagttgaacttaactgcgacacacgatcaagctacaaagatggtaaaaagtttgcacggaaactggaatttgactctaggaaaatcattgaaaccagaaaaaccatagagagcgcaaattctattgctaagacactactggacacttccccatctaatatccgcaagagaacaccattttatgcctgttcattagcattcgcatgcttgattcatttgagtgcttacgcttgggttgagtcaagtatcaaatattttgaggaaaatgaagattttgatctagaggatattgtcaagagttttgatgtatctgagctttctatttacgtggaatatatcaagttggaattaggtggtatatactcaatttcgacacactggtcactgtcatcgaagttggctaatcacatcaaggaaacgattgcaaaggtttctcctgcattatctgccaccatcgacccaacattcatcaagcttaatagaacgtcaaaccgacaacttccagtttcattggagaatagtatatcgactggaagcagttcacaattattggacagtagcaggccaagaactgctatgacaacaaattcaatccctcaatctacctcattaacttcaaactcgataagcgctagccactttcagtcacaaatggtgcagcctgttcaggattcagaattccatcaagaaatgacctcagggttcgaccgactaatcagccccatatattttccctcgccagattcggcctattcagatacgggttgcgattggattgataagaattttcttgaacttgacaactttcaggtatgatgttttatatttattactatttgatttttatagtatcaattttagaagaatcaaagcccaatttcatttagaacctcataactttcttggttgcgagaatggggccactaaagtcattcctcttctaacaatgctttgaatcctattcttcagaacattggatgtgctttctactgtccaatcggttagcttgatagtggcttccatttttcctatcactaccttccaatcttcttctccttcgtctatttcaaactttagcgcatctccaaaatgtgatcttaagagagtacgcaggttttgcacacgggatgccgatgagtacttctcttgtatttcaaccattaattttactttgtcttctgaagcatctggcttgggagaagaaggtgaagctaggtcaggtactgcttcttcaacgtgattcttctcctccttaatgctaatagcaggtgattcatttggcttatttggttcatttggttcattcaattcacttactttgcctggttcatggttattggcgggacttgcggttttctccggttcccttatttcttgcttttcttcactagtcctgctgtggctatgattacatgatttgctggtcaacttgacactcagaggagatgactccgctgtcaatacaatggctatcacagaatcagctatggtatcgttaatcacaccagagccccattctactgtgacaattcctctcttatccatattcagtagcacactatccatgattttaacttcgtactcttcagcatcatcaatcaagatatctagataaccaaacatttgtaataagtggtagtgaactaatgatgatgtagcatgagacctcaacgtttgacgttgttttatcattgttgttgtcaatcctgtatattcacgaagatcctgaatcttcagtagactaaggtcaaaattcttttgtaccaacaccccgttaatctcactcttagcactcttcacgtcctgcttcaaaaccttgttgacatcttcagtgatagttcccatcgcttttgctatctttatcctttgaattctactaacaagtcctcacaattccttggattgtacactttaacttcatctggcgtgtttttatacttagagtactttgacaaaagggcagatttcagacgacccattggattagattcaccatgaactaaaacgattgtcttaggattcaccagctcaataaactttgaattctgttcataatcaacatgagccgcaaaactgatttcttcgacggtcattcgacgaggaatcaaaacgtctggattctgttgtgaaggtatctcggtcggttctagtaagatctcttttgccattgttccctccacagaataaccggtcattataagtgtatttcttgggtctggtgcccatttttctaatagagctcttgaaactccattctgaagcatacctggagatgcgaccacaactgaaggctggaaatcatcaaatttactaaggttttttatgttcttgatgtattgaaattggaatggatttttatttgtgtctctgaacttttttctaatgttttcgttcatcatattgatgtaagtttggtacacagccagacattttcttgccaaatcggaagcataataaactttaatattctctaggtcctgatgttgtgaccagtattcatctaaaataagaagtaattcttgagcccttcctagtgcaaaaaccggcattagcactcttccaccattcgccagagtgctgtggatcatggttgtaagctttttttccttctcttcacgaggctcatgggtagctgttccaaaagtcgattcggtaatcaaaacatcaggtcgaactggtggaacttcagccacactcaaatgtctatcttcttctctactaaaatcacctgtaaatagtaccttgatgcctgcaatttcaatgaaaaacatggcagctcctagaacatggccggcttggtaagccgtgaatctaataccatcaatttcaatagtggaatgaaagtcaattgtttctatcctgtcaaatgagtctttcaaatccttgtcgctgtaaagttggttagagtcatcatcgatagctgtaactcgaacaaagtcattcaatagccatcgataaatggccttcgtcgggtgcgtcataaacactctacctttgaagtttgtcttttgcattacataaggcagggaagctgcgtggtccaaatggaaatggcttatcaataggacatccacagtgcctagatcaaactcatcgtagaaaggaagagatgccattccctgaaaagcaggatgaacacccgcatccaacatcacagtcttgcctttgaattggatgatgtgagaagatctaccaacctcattacccccaccaaggcaaaaaaatctgaattggtccatggtttgaaggggaatggaaagttgatttttcgtcatgtttgtaggacaagctttcagacgaaagacgtggcgcgaaacggtagaagccttccattggaaggtccttccacaaagaaaatcattcctacgagtgctcctgcgaactcgcgcgaaaattcgtcaacatcaaactgcttgattcttcctttctcttgcctcattacttccttcactcatcattttcaccggtcaacagctatgtcggtatccgagccactcaatatgatcaagctttgccttgacgaaaaggtctacgttaaattacgaggagcacgtgagattgttggaaaactacatgcatatgacaatcattgtaatttggtgttgggagacgccgtagagactatatctacagtagatgaaaacaacgagctaaagacacagacaaaagacagaccaatggtttatctaagaggtgattcagtaattttagtggcaaatgccagccaatagtaaagatgagaataatataaaaagaaagctatgtttatatttcatgcagagtataaatatgatgaacaggaataaatggaagaacactaactcaacccttaatgctaacagattcaaccttggcttcataaagatttttgcctgtggtattctccaaatgtatactatgaagacaatcatttagaataacgacctggctggcaacatcagccatcttattgaccacttttccgtttccgtccacaaatccatagatggagtaatgtagtcctgtattcttgcaaaactcaatcaccaatggttggactttgcgaaagttgtgtcttggtaatcttgggaaaagatggtgtatggcctggaactgtagtcccccgtgaaaaaaatcaaaccattcagggcaatccacatccatagtagttcgtagttgtctagatacaaatgactctgtagaacccaggtcagaagtcgacatagcaaaatgtgatagcacaatctgaacgtgcacaatcatagttgtccaatggctgatgagcaagaaccaaaatcttagagtctttgttggtatatatgacatggtcttgtaaaaaaaccagtaagaaaaaaagcagagtcctatcagttccaaatatctgaaccaggctgctttaccctttctgggtcccagtcccattatcaaatggctccacgataatctgtaaagattgaatcttccaaagctaagaattgggtaatacaacttgtgttggatttgcagcattttctgggctattttatcaaaccacaaatatttctcgtagtatgtgctgaatacgtttcctagcagccttgaacttactgcaaaaaatgggaggtgttgaatgtccggatcatgaactggatcgttggtaacaagatgatgtacgttatgatttcgtttccaccatccaagtgataggcctccaataaagttagcaataataattccaataatgttgtctatctggtagttatgcgtgatgctaatatggcccgcatcgtgggcaataaatacgagttgttgccacatgaggccaatgctgatggcagaaagagtgtaccattttgatcgtagaaaaagaacaaacaaaagaaataacgaactgattcggcaaaactctttaaagtactgccaatagtcacactgatagtatcctcgattgataatagtttgatgcaactcgttgtactgcaggcttaaatttctttgcgtctcgtgatccaaagaaggtatctgttttatgtcctcgtagaccaatttattgtcaaagtcctctattattgtttttggatctcttactcctcccactggcagtagtttggaggcagatttttctgttagaacgatattctcttgaacttttggctctatctttactccaggaaagatgcctaacttcttgtagatgacacgttggtcaactttgtcgaatgagtagttaccaccttgaatcgggggcacaaggttgtcccatggaagctttacacgaccgatggaccaccttttgaaggttttcacggtttcaggatcatggtaggcattcatttcatcactagcatctcttccaatcatgtgatgaatggctttttcaccaccggggtgacgttccaaccagccattcaagtttagtaaatgatcctcatagattacaatagcgtttcctcgaccaataatctccctcacttcttctcttgagacaaccatgatcggaaagaagtgataagtttggctactcgtatggaattcttagccccctttcgagatttcccagagataaaagatcaggcgaggattgaaaccgggtgaggaaaggcacatggagctagaagcagaccttgtatcgatactgcggaacggccgtcagaatctaaaagacgtgttccagtttgttgattattttcaaaataaaggcgcttttcgttgctaacccacttagatacgcgtacgagtagtttcttcacagggaccttccagacttcccttgcatcgtatccctcgaaactcatatattctttccaaaccatatcaacctctctctccctcgtgtcagcaaatgtctaggaaaccagaaagaaggaggcaacccaggctgttctccaatgacatgcgtactctattgtttgcttatggagatgtgcagcagccgcaattggaaacaatccaagctttagaggatgttatgattgtatttatgaccgatctttgtcatgaagcaatgacttatgcaacctatcaaggccgtaagcacaaacttaagatggaagatttcaagtttgccttacgaaaggataggcttaagctaggtcgtgtagaagaattaatgaataaacaaaaggaaattcaggaggcccgaaagcttttcgatagcaatgagaaagagacaaaagacgatgatatcgaaaagaaaaggaggaaggaagccaaaagggcaataaaagaggccaagaagttgaagctatccaaaggagactaaaatatgtgaaggtaaaaaaaggcacggattcatttattatataatctttttacaagtctactctatatgtggtatctcggtgcctttgagtgccaatgaaaatgtcccataattcagatgatttaacgaggaaaagtgtgtacaacagcttgggcaaagtcctgtaagagttcaatataaatccaattgcatcaataaatgcgtgaagttcttcatggaatgcttctttgatagattttgaacccaatgatggacaactgttttgtttatatgcggcttttccaacaggtttgcttttgatttcttctggtgcctctttcgatgaaatgactgcctgatcaaccgaaaacgagttgaggagattttgttcatcttcgttatcgaaaaggcctaaggattcggacgacgctgatgcacgatcctgcgttggcggttgaatcttatatagtttttcaaagttttcaatgctttcaacagatttggacaatctatggaatgtgttgactagagcaactaactcaactctctttaaattgatggagtcattaggattcttcaaatcaaatagaatcttcaatgcagtcccgtaccctgtagtttgcaattttccccataatttgcatctctcgcaatggacacaatccattaatctagtcacgttgcggaatttgtcacggaattcatttttcaaatcatcattttggtcattttggaaaagaaccttctcgttaaatagataatcatcagagctctggttaataccctgtgctccttgagatattaaaccgctaagaccagctttcaaagagtcatcgagaggtagattgtcgataacattgtattcttgtagctttattagtgacttcaatacaaggacataattgagatgtaagttttgaattctttcagtaaaatacccaactttgatcatgaactgtttcaaatttggttcgtatgctccatttttcaaattcagatattcgtttgtgaggtgggtggagatactagaatgcaaaccagaaaccaatcggtaaaagatctgtttctccaaacagaggtcttcaacttgacccaattgtgatccttcattcggctggaaacagttctcatcatagaccgcagtccaaatagattcagattgctgaccaccataaccggtgaatctttcagggttatcaatcaaattgacatatactaaatcttcatcgtcgtctttatccaaagcgcaataatcatttgaggacagctcattttcatcttggcccttatccttatgtaccgtgttatctccaagcttacccaattggtctggttgccagatatcaggcacctgagaccaatcagtgataaagtcgacagagcaatccttatacttgcagaatccctcatcaccattccaaaacggacatggtttccataggtttaatttgtaatatttgaagaagtctgtgttgaccagttccaccagtttgggttttatttcgtggttaatatctacaatctgtccgatgttaacttcggtatctggcacgatgatctcggtgtagttgccgtcaaaagggatttgagggtttgctaacgctgttatacaatgacaggctattgcgatagctacgctccttactatcctcattgcttggtgtgtgtgtagttgagttgtagcagggatactgagatatttcacggatacaagagaaagaaaagaaaagaaagatagggaaaaggaaagggatagatcgtttcgaggatcagctgactaagacgagaaatgaacagagtggccctaacttacggtctagattgttccatatagcaatagctagcgtttcgtaggggggcgagagaacccagtgatggcttgtgacgtaggaatgatacaggacattgcgactcgagtccacgtttcaagatgagggtggttcttgagatcgtctggcttatctagaggcgatgattagaagtatactggaatgaggtagtggaacagcaagatggataaggccttctgctgattgtactggagagaataagatctttttggatgtgctcaatacggtcaccatgaactcaccaggcatagtttctgtgctctgaagtcttccagatattagtacgtcgtcaagatgctttaactaggctagcgattatatgcgcacgagaaaaaaactcctctcaccgccctagctacttctttgggactcccagctatacctcgctaaaaacattaaggtcatctttatcttttgtaggtagaacattacttgatctttaattattccccctctctcttaagacgaagggaactctacagaactcacgatcggcgtcaatggccagaggatcagtgaaatccctgggttcgaagaaaatgggttccctttcacggtttcaaagactacctaagaactcgttgactcaaagtgatagtttgaatacaacagctgatcttcaaagccacatcatagacaaaataagcgctcccatcgttaaaagatcgaagaatggaattgaagacaaaaatgcgtttgaaaagaaaaaagaggttctcaggattcacttgcaccacatctccatcatcaataaaaacatatccttacctgttccttttttaagcatatggcctaacagcctgtacctcatagttgaccttccgtctaaaaccaggtttcagattcccttcaaatctctgagccagatatacatgtctgaagatgaaaagaattttgtgattctgtttcgtaagactgaagtgctcagcaaacagatcttcggggaattactagacgaggacacgaaaacaaatcgaatatggcttttcctagatcccgagactgacgttcaagacgtggcaaaactgaaacagttatttcgccaattgtgcaagatatatctggttaaattgcatctaatgaactttgctgacttgcagcagtattttaagaacgaagtgaacgaaccaaaagtccccaaaatatccacaacaaatttttattctaacctggctgatgaggatagtaggatcactcgagctaggcggaagaagattaacgaagagcaacccacggaaattgacttagccactgaagacggtgaagacctggatacaaaactctcctccaaattgacacaccaaccaacgaaagaatctaaaagtaaaacccctcttcccgttgttgccgatgaagaaataggagaaggcaaacaattggtattgacccatcagttatgttaccagttcaaggattctcgcaagattgtcataaacaattctgatttcaaatgtctttacaacaataattggattaacgacaacgtaattgatttttttctcaagtattacgtccaggatttcaatgaagctcgcgtggaactgttttcctgttttctatattcaaaactgattacgcccaatcattcggttttatcagtgtatgacaatgtgaaaaactggtttcgaaacaacgatacactttttgaaaatgattttgttattattcctatcaatcacaattatcactggttttgtattataatccaaaacctgaagaatatagtcaacgggaaatacctatcaaaggatattcataattttgagagaccatacttgtacgttttggattctctgaagcaatctcatggacctgcaacgaaagcaattaggctttttcttgcgggttatgcaaaagaaaaactgcatttggatattaatacccaactgataaagaccagaacattgaatgtattattgcagaacaatttcaatgactgtggtttacatctcatattcaacatctgtaagtttacaaccaagcatacacttttcatggatctgatcaagtccagattatctggaagctcagatacgaacagaataaccaccgagttatttccagtttccgggatgcgcactatcagaaaggacctgagagatatcatactatcattattaaagcaaaatcttcatgataggaactttcctcaagaagacgtcgaaaaagttgggcaagtcatgaatggtgatttgaaaaatggttgcattgattcggaaggggctgcgtctttcagtgaaagagtagtggatcaaactgatgatttggaaatcttagatggtgatcctgccatgattgaatctcaaataccgtttttgttacaaaaagaggctgaacttaagaacacagagcattaatcatcctcgacaattgttatcaaattaattgaaaaattaaacagccaaagtataggccatttcatactgaagttgagctgggatttctcgctaaagttaagccattgaattagttagacccagactgtagataactacctatactttcatgttttattcatctgttcaatacgcttctagctatgaattacccaccctttttgggcctgttcgatggtgttgaattctcgtaaacgaaagctatcttcaaattgaagcattcgtatgttgataaatacattaggaacgaactttttcagtgaaaccttgagccatcagtgtcctcttttcaccaagtctaattaccacatagtatggtcaaataagataagcaactgttgaattttggtctccttcttgagattctaacaagaagtagaaaaagtaggattgctgtagttgctctactgtggcctatcatttctagtattcggttaaaaaactggaacatcgttctatcgtgcatgtactctggaacccgcatgtatatgcagagtcaacattacgattacttaaagatcaaataaatgatgattcgtatctgtacaagtagtctatcagacaatgttttgattttctagctgcttttttgtatcaggacgaatagttcaatcttatcaacttaactaccgtcttcaagcttctttgtgggacatcgaaaggatgaagtgggttccgaagagaagatatgaaatatccaattcataggaggcaaggtaccagacacattttaaattttccagaacaaaacacaaggcactagtacggctacatacgtaaaagaattgagaattcaacaaacagtaaacgaaattttgccgtagtcagcttctcagttgacttccctctcttttaatagtggatgatttgcgagaaagaaaaaagattgcagcacctgagtttcgcgtatggtctcccactacactactcggtcaggctcttagcagcttaactacggttgatcggacgggaaacggtgctttctgctagatatggccgcaaccgaaagacttttctagaagtgttacataaagagtataaaatataccagtttttccaaacaccaactgtccaccttaaagcaaacacatagctaaaaaagagaaccaagtacaagtgatataatatatgcattgtattttgataccagcattcgagtatatatctattttctaattctaaattgagtttcttcgatcaatgttgatcttatgtgtttgtttttttcttgacttcaaaacctctggtagctcgttatcctcttctaactctttcagttgggaagaaccataagcattaccaacattagaaatctcttcaaactttccaaaatctaaagttccatacatttcgattggtggtcgtaagtatacaactgcatcttgagactttgcctgttctaaagcattaacagaagccacatatgcaagtctcagctgaatttctgcaatacttggaacgttcggatgttttgaaaacggattccaacggttgaggacaacccaaaatcccgataaagaatctccgtagtccatgggacttcgatcatccaccgaaccaacgtcaatagcaaatatcacactagcaccttggtttttcatttcttccactggcaaattatcaacatagcctccgtctagcaacattgagccattatcggtgataggaggcagcagaccagcaagggtcatggaagctcggatgtacctccaagcataacctgacgaatggatctcttgcacactgttagtgatgttcgtagaattacagtagtacttgacccaaaagtcttctattcgatagtctccaaatgccttccagattccacgattgaactcgtgtcctgtcatataggacgttacaggatacgtcaaatcggtaataattctccaaagactggacattcgtccagcaaagcttttggtcctaccataagttgagactaagttataatcctttgcataaagtcctccgacaaaagcaccgatcgaagttcctcctaccagatcaacaggaatcccatactcttcaagggccttaagaacaccaatatgggcgcatccacgagctccacctccaccaaaaactaatccaatggcctgtcctgacaaaattcttgcaagtcgcatgaaatcatttttatgttcttgagtaggttgatagtatccagtgcgtccgatattgggtaccttcttgaagacatcgtagctgaccagtaaagtctccaaacggtgtctcatcttgtctaagtgggccttatttttcagctgggaataactttctttgaccagttgagcaatcgatgatagttcggttgctttggcaacaaaatggcctctattcacgttcatttgtacatggtgatgtgaatgaacccaaattctattcttcaggaatttgcttgttgatccagcttcgacatatcgttctgggtgcaacaaaataagttctgttctcgcagtggtcttttttctcaccagaagtctctcatactctccaatatccgtcgaagactgagcatctgctagcaaaagaataatgtcaccttgagaaatgcaagtacttgtccaagttgagtttaccggagtgtctgtgacatatataacattctggtattgttcctccaaatcggcaaagtagcccgattgtttcatcttggctagtttatcaaaagcatgttttcctaggtgagtcaaaatgcttgcctgattcaaagaaataacagatctatctagctgttcaaacgaagaaactaatttctgagcaaactcttccaccggaagacccttggtaattggcaagatggtaatagtccggtaactgtagttacagaaactggaattttttggcttaatgactggatttttgaagctgttggcacctatcactaagtttgcttctgttgattgagatcgttctgcaactaatctagaaaccttaatcatgatagatggatttgtaagacatagcatctcaaacagacttctaggaattctagctgtctcagagtctcgcacagctaccaaagttgtgggtctctttgaagcagtaagtacttctatttctcccaaagattcacctcttccatgctctgatataacagatatgctgtcattttcaccactataagcatccttccggtgaatcactggcgaagattgtttgtcattgaccgcacctttgggattctcgacaatggaccgaaatctaccattcagaacgatataaataccatttgcagggtctccctgattgtacagtctctgtcctgcagatgtttgtacccagtccatagcaaaatccatcaaaaggatattatcgtccaaaactctgatcaaggtcttggctagcgccaattgaatgacagaatacttatcacataaggaatcaatcactttctttggaagaaatccaacatagcaattcgatttagcccttaccgtaataaatgatttgaagctagctacaacgcccaggtaaccagcaattccacctggttttatatggttaagcattttttcttctccattctctgccgtgaaaactgactctaagagtccactaacaaggtagtagataccaggagttggctgattttcttcaattataacatggccagctttgatgaacataaactgaatttgttcgctggccgattttcgaatcgaaaccagatcaaggacaggttcacttgacttgtgtgaacctgctccaggagtttcacttttactactgcagctagaatcatcatcatctccaacatccaagctgaaccatttcaaattctgtgacgatgggtaacttttctgaagcccaaaattagggctgtttagcggatcgttaagtgaaagatatgaagcgaacagattggcgctattatgaacgatggagttgtcaataccaatcaacttgaatatgctttcaaccaatgctgttcttagtgccgtatctgcagtttcttcttcagccgaaaaagttcttgctcggatctcttgttcgtccttggattggtcactatttcgaagagaattgtaggatgagttctttctggataaaggcacatttgaaagcaaatcaccgggattagtattggtgattcgggtatcgagaacaacatggtgagagctgtttctcttagataaaacgggtctctttgatggttttgaagagacggatttggagattcttccagcgggattatagtagaagaatcttttatcatgacttgtccgttcaggatgatgctgcagtagaccgttgtttttcttgaaattggaggtgctcttgctaacactaatggtttcgatattatcttcttcttccgcagccttaaactgctcatctagtctgtcaataatcccatcgtgaagatagacggggatatcgtattgagctaacatgttcagttctagctcagctttcataattttgtgagtcaatcccaggtacgaatgtgcagtttgaagcgttactctgtacaagcgggtaagaaccatttggacaatatgcgatgccgactgaggatacttcacaaccaatcttcgaaatgattcaggtggaatagtagaaatagaagcatgcccttgggccttggcaattagttctggtgcaaactcgtcggggtctgcctgctcttccggcgagctggatgttggctcctccctgaacggggagttcgcttcataaacagcattcaagtttaaagccgaagaggttctgttgtcctgtaaaagtttctcctcgttctctgtgaaaagttttagtatactaatcaaagatgaaagtggactaccacttttagcatcggtcaacagttgatacttatagccattgaagatgaacgacttctcatcggaatttgcagattcatattcggcagccagtgtatcatcggacaccattttcctaccaacccttgcgtacactgacatcctgccctctacaacaatagagaaccctttagacgcatcaattaccaacgactcattgagctccaatttttgggttgtcatactctttgtcagttcatgaaaaacggttttctctaaataaccaaacaccttgatagcggacaaaaactgatctaagtagctgggaaatctcacttcagaattgtcatcagtagattcgataaatacatccataggagggtcctgacgttttggttcttgaggaagtcgggagtacaaattaaggtatctgtacctgatgaatgcatacactataacaacggtggatgaaacaatcatcaataaagacgaaaaattcaaagttacactgtaattaaacccaaggatgcggacaataaacgagggcaataccaccagaacagaccgtattaccttgaaaaaacaccatgaaatgaaccagatagtcgctgtgacaaatgaaatggagctggtggagtctctaggtgaggggagaccgttatctgccagttgatcctttgaaaaagtgcccacatctggagataaaggagaaggggaaacggagatcagacccaaatcaggattgctactttccacagatagcacgggtaactcatcagtaagcatccaagcaccctgaatcaacgcaatgagcagaaaaatcaaaagtctgttggacatagttcactagcgatattttttgcgaaacaggaactagttgatgggatatccattaaatcttctaagggtatctttggaaacacttagaatcagtgcgaagagcacaacgtaaacgtttgttgtatttagtcacctgatcagggtagtttattttcatgggtgcctgatttcacttacctttctgccatccagcatcaagtttttagattagagttgtggaggatcctgccgtccagatttcatgctgtcagacccaccaacgtgcactacccatttttggccttcgcgaaacccaacaagacgttttttgtttgtttcgctggccttcacaggcaggtgccctaaaactctaaaccagcgacgcgtctctctctcctaagcctctacaaagctgagatttatcttgtaacttggcagcactattcagtaattccagaacattttactatcagcggtgccaaatggtcaccttccaccacgtaagcacatacaacaacattcccacctttccgcccttttatctggcacttttagcctcttgcactggtatatagaactattttccttatcaaaactctgttggtctcagtcaacggttgcgcatagtgcacccccagccaatactcctaccagaagtcccgacgtactgcgcccaaattgcaagatggcttctccgaggtgccttcttgcggcgcggaaaaaaaggaccaccataccttaacacacgttgaatgtcatacatattccatcgcgtgttcccaacaaaaaaaatcccatcaagttgagcgttcttcccctataataaccaaccacaatcctcgttatcacgtcgttcttctctactacttcaagggcgaatatttgatatgagtgctacatccggagttgtcaacaggccattggtgttaaaccatggctcaatcgagtcaaccatcttaatcccaaccacagaatatcatttctaccaaacgttactggaagggttcaggaagtcattgccacaagttaccgagggatttgctgacgacgacgagccgagctccaaggcagaacttctgatgaagtttttgggttacattgtccaatctggagtctccaatcagcaagagcaattagctgctgcaaagttggttttgaatgagttcgagtcccgtttccttcaaggattgaacttgcactcttatgctgccattttgcttaagagcgagacctttcccacaacattattgaaaatcaaagaaaacttaatcaagaactactacctgggaagagcccttgtctacctgccaggtcagcgtggccttgtataccctccctcggcattacttaatgctggaaagtccggctccgctcagatctacgccatatttggaggtcaaggtaacaccgatgactatttcgaagaacttagagatatttaccacatctaccaaggtctcgtgtcagacttcgttaccaaggcccagttgaagttacaagagctcatcagaaccacccctgaaactgacagaatatatacacagggtctagacctgatcaattggctggaaaacaaggacaagactcctgaccaacaacaattgctatccattccaatgtcatgtcctctaatttgtgttatccaactgtgtcattacattgtcacttgccgcatcttaggtattacacctggtcaactcagagattccttgaaaggtactacaggtcactcccaaggtctggtcaccgctgtggtcgtttcttctgctgattcctgggaatcctttgagaaattggcgcttcaggcagttgaattcatgttctacattggtgttagaggactacaaacctatccaaacacctctttacctccatccatcgtccaagattccgaagaaaatgccgagggaactccttctcccatgctttcagttagagacctttcctatgaccaattggtcaagtttgtcaacgaaacgaaccagcacttgcctgaggccaaacatatcgacatctctttaataaatgggcccagaaatgtcgtcttgacaggccctcctcaatcactttacggtttgaatctgaacttgagaaaagctaaagcaccttcaggcttagaccaagccagaattccattcagtgaaaggaagttgcgtttctctaacagattccttccgatcatgtctcctttccattctcatttgctttccccatctactgagaagattgtagctgacttgaagaaggctggtgttgagttttctcaatccagcatgaagcttccagtttttgatacctatgatggtaaggatctaagatcatattcaggatccattgccgctagattggtggaatgtatcaccaaattacgcgtcaactgggaactgtctacggagtttaattcaacacatgttctggactttggtcctggtggagcttccgggttgggtgttttgacccacagaaacaaggaggggacgggctctagggttatcgttgccggtgtcttagatgctgagtccgaggactctgagtttggctataaacaggaaatttttgagtctaatgaaaaggcaatcaagtacgctccaaactggttgaaagaatataaaccaaagttggtgaaaacttccgctggcaaaatattcgttgacactaagttttctagacttcttggaagagctccgttaatggttccaggtatgactcctactactgtgtctcctgactttgttgctgctactttgaatgctggttttcatactgagattgcaggtggtgggtactttgctccttctattatgaaagctgcattgcaacgggttattgaccaggtcactcccggtaccggtgttggtatcaacctgatttacgttaatccaagaatgttgcaatggggtatccccatgatcaaggagctaagagagcaagggttcccaatccaatctttgtccattggtgctggtgttccctcccttgaggttgcaactgagtacattgagacactagggttggctcatctcggtcttaagccaggttctatcgatgccgtcaatcaagtaatcactatcgctaaagctcatcctaacttcccaattgttcttcagtggactggtggtagaggtggaggtcaccattcttttgaagattttcaccaacctattcttcaaatgtactccaagatcagaaagtgcaaaaacattattcttattgccggatctggttttggttctgcggaggatacttacccttacttgactgggtcttggtcccatcagttcagttatccatcgatgccattcgatggtgtcttatttggttccagggtcatgaccgccaaggaagctaagacatcaccagccgcaaaacaggccattgccgattgtactggtgttgacaattctcaatgggagaacacttacaagaagcctacaggaggtatcatcactgttagatccgaaatgggtgagccaatccacaagattgctactcgtggtgttatgttgtggaaggagcttgatgatacaatctttaccttgccaaagaacaaaatgctagaggctattgctaaaaagaaggattacatcatcaagaagctaaatgccgactatcagaagccttggtttgctaagaatgagaagggtacttgtgacctcgaggatatgacttacaagcaaatcgcagaaagattggttgagctaatgtatgttagaaaatctcaaagatggattgatgttactcttagaaatttcactggtaaattcctcagacgaattgaagagagatttgccactaaagttggaaccatctccttaattcagaacttttctcaactagaagaacctgagaaagccattgactctgttttcaaggcttaccctgaagctgctagccaactgatcaatgaggaggattgtgactggtttttattggaagctcaatctcctacgcagaagcctgtcccatttattccagtgcttgatgagaggttcgagttcttcttcaagaaggactctctatggcaatccgaagatttggaagctgtcgttggcgaggatgtccaaagaacttgtatcttacatggtccagtcgctgctcaattctctaataaagttgatgagccaatcaaggacattttggagaacattcataagggtcacatcaagtctttggtcaaagaagtttacaacggtgatgaaagcaagattcctgttgttgaatatttctcctctgtggactcattttccgataccgctattgagggtgtgaaaattgaacgttcccgcaatacagagacatttactgtgacttctggcaatgtcgataaccagcaatggtttgatttgttagctggcaaagagttatcctggagacgtgctttcatcaccgctgctaggttggtccaaggtaccaactttgtttccaatcctgcccatagcgttcttgccccaagcaaagacttggtggttaagattgagaatggctctgatgccaaaaagactgtcttgaccgccttccagcgtgtgcgcggtaaatacgtccctgctgtgtctctgaaaagtattggtgacttgaaaatcaaattagagcttatcgagactagaactgccgacaagtctgctgttgccttggagctgttctacaattacaaacctactgatggttttgctccaatcttagaggttatggagggtcgtaacacttctatcaagaacttctattggaagctatggtttggttcttccgttccagttgatttggacttcgatgctaataaaccaattagtggtggcgaggcttctgtctcttctcaagctattgctgagtttacacacgctgttggaaactcatgcgaggactttgtgcccagagctggtagacctcaacttgctccaatggactttgctatagttttaggctggaaggccatcatgaaggccatcttccctaagactgttgatggcgatatcttgaagttggttcacctgtccaacggttataaaatgttcccaggagctgatcctttgaagaaaggggatgtcgtttccactgttgctcacatcaggagtgttgttaatggtgaaactggaaagactgttgaagttgttggtgtcatctcaagagatggaaagcctgttttggaagttaactcccagtttttctacagaggaaagtatcaagattttggaaactctttcaagaagaccactgaaactcctgttcaagtagctttcaaatctgccaaagatattgctgttttgaaatctaaggaatggttccatctggagaaggacattgacctgctgaaccaaacattgactttccgttgtgagtcatatgtgaagttcaagtctagtactgtgtttgcctctgtgaagactaccggtcaagctttattggaacttcctagtaaggagatcattcaggtagctgaaattaattatgagtctggctcctcttacggaaacccagttcttgattacttaactcgtcatggctcaactattgaacagccaattatgtttgagaatgctattccattagcacagggaacagaactaacttcaaaagctcctggtacaaatgagacatatgcagcagtttctggtgattacaaccctattcatgtcaacaaagtttttgcttcctatgctaacctaccaggtaccataactcatggaatgtactcttctgctgctgtgagggcactcgttgaacaatgggcagctcaaaatgttgccactagagttagagcgttcaaggctgattttgtgggaatggtgctgccaaatgacgagttagttactcacttagagcacgtcggtatgatcaacggtcgtaagattatcaaggtggaaactaagaaggtcgagaccgaagaggttgttctgattggtgaagctgagattgaacaaccagtctccacttttgtattcactggacaaggctctcaagagcaaggcatgggtatggacctttacaactcgtccgaggttgctaagtctgtatgggatagagctgacgtacatttcattaacaactatggattttcaattttggacattgttaaaaacaaccccaccgagcttactgtccactttggtggagccaagggtagaagtattagaaacaactatatcagtatgatgtttgagactgttgccgctgatggtcaactaaagtcagagaaaatcttcaaagaaatcaatgaagatactatttccttcactttcaaatctcctaccgggcttttgtctgctactcaatttacccaaccggctttgacattgatggaaaaggcctctttcgaggacatgaaatctaagggattggttccatctgaatcaatgtttgctggtcactcattgggtgagtattctgctctgacctctctgggtgatgttatgccaattgagtcattggtggatgtggtgttctatagaggtatgaccatgcaagttgctgtccctagagacgagcaaggtagatcaaattacggtatgattgctgtcaacccatctagagtctcatctacattcaacgattctgctttgagatttgttgtcgaacacatcgctcaacaaactggatggttgttggagattgttaactacaatgttgagaatactcagtacgttgctgccggtgacttgagaggacttgacacattgtcgaacgtcttgaatgtattcaagatccagaaaattgacattgtcaaactacaagaaactatttctctggatgaagttaaggtccatctttctgagattgtggatgaagtttccaagaaatcgtcttccaaaccacagccaattgacttggaaaggggctttgcttgcattccgttgaagggtatttctgtgcccttccactcctcatacttacgttctggtgtcaaaccattccaaaccttcttgtgtaagaagatcccaaagtctgctgttaaaccagccaacttgattggcaagtatattccaaacttgaccgccaagcctttccaattgaccaaggagtacttcgaggatgtgtatgagctcacaaagtctgaaaagatcaaacacattcttgaccattgggaagagtatgagtcttcctgatcgttttatttaattacatttgcttaatcagtttgggtacatgagataagtggtaatatcttatgtgcacaaatcaataatatatcgtatctatgaaaagaatatttatatgattctattctctagtggcattcttgctatgtttcttgaatttaagtgagtttgtatattgccaagtcactaaaagcagctccccattcttgggacaggtcttgcccaatcagtagcctggtaaagtgtaagtgttcagcgtaccaagagtagtcaaaaggctcagaactgtcagtggatggtaagctcgggtggaagttgccattttttttctttttgattatgaatccgtcatcaggcagtacaaaagacgagtccttgaccaggttactcaatcttgtaatattggggtatttttctttcatctctgcatttttcattttaagtgtgtataaggttacatcattagtgagtaacatgcgaggcttcacagtttctaaagttcgttccaagatcccaacaggcaaatgtggcatgtagtaaatagtaggagtagtttcgtctttgtcaaattcgtacgtctcttccacttcaatggacaacttggcaaagagatctacatctttaggttcaaatactgggtcaaacgcagatataagttcaatgcccaaagagtctttgatctccaacaagaatgctagttgatacaaagcagctgtggagttggtgggagaacccagtccaacacaccttagttttttggcactatcaagtacaatgatgttgtccttgaaacccaccaattgtctcctaaacttctccaaaatttccaaaaaatcatctactgatttctctgctgcttgaaagcgtattctatttgctgctcccttaacagcttttccccgtttacttctctgtacttcccactccatgaccaagctcaattctgctatctatcaattctcctgcgaaataccccggcgagtttttttttttttttagcgggagatgagataacagcgtgaaccaaccagaatttgcagaatgaaagtgcaggaaaaaattatataacttttccttcagaaacaagtacgtcagtcagtgccagaacgcttctccttgctatctctctgaaaaggtgatagcattcccgtcaatacaatcaagctgccttcatcaactagatatcatccaagaaccacccaagaaatgagaaaatgtaaagtatttgtgggtaactctcatcctgagttgggaaaactggtgtgtgagagacttggtatggaacccgccccagtcacattgaagaagtttgcaaacggtgaaacaagtgtccaaattggagtgtccgtcagagacgaggacgtgtatataattcaaagtggaagtccaaacataaatgatgacatcatggagctgttgattctgatctctgcttgcaaaggtggctcggctgccaacattacggctgtgattccacaattcccttactccaaacaatccaaaatgaaaaaacacagaggagccataacagcaagaatgcttgctaacttgctgatcatggccggtgctgatcatgtggtgtctatggatcttcatgcttcacaaatgcaaggttttttctccaagccagtggataacctatttggagggccaaccttagctaaatggattagacataacgtgcctgactacaaggacgctgtcgtggtttcaaagaacccaggtggaacgaaacgagtcactgcattggcggattctttaaaaattaacttcgcaatgatccatactgatagaaggagagctaaagatggattcgaagataagaaaaaaaagaagaagatacagaagaaagtttccactcttaagctcaaccacaacaacgaagacgccgaagaggaaaatatcattctctctggagaatctcaaaccgcaagagtggtccaaggtcacgttgttgatgacgcgtatcagtctgctgatgaggcagccaagccagggatggaatcggttaattctatagccaatggtactgcccatttcgatcaatatgcccttggaggatcttacgatgctgacaattctgacgatgatgacgaacccgaggctattgcccaagagaaattgatcaccttagtgggtgacgttcaaaatagaccggcaatcattgtcgatgatatgattgacaaacctaactccttcattgcagctgcggaacatttaaggcttaattgtggggctaattcctgttatttggtggccactcatggtatcttctccgataactgtttggaaattctcaacgactgtgcctacatcgacaaaattattgttactaatacctaccctatagacatcaaaaagagagaagcctgcaagaaactggtctatatcgatgtttcgacaatttttgcagagtgtatcagaagagatcattttggtgagagtatttctgttttgtttgataatttgtcttcttttgcttgagttagccaattcaataatgttcatacataagaatataaatttcgaagtaagttatcagctccgagcaactgtcagtggactggagatattcacaggtgtaaatctcttgggtagtctaactctagagaatctactctttaatctttgagtaaccaagtccatatccaaatgtcttgtcagagatattcttctaatgcaactaatgtaatgtttggcgtccagttgaacatccaaaggatcctgagtgtgacacccaggagacaacgataatctgatggcgtgtttcttgttaccgtccttatcctcactttcgtacagttcgaatacaatttgagaaaggtaatctaattcggggagagcgtttctggctatcttcattggcaactgagattcgtaaattacgttcaacaaggtgtagatatgactttccttagtgaagtagattacacttcctgccgttcctgaatctcgcatttctgaaatgtcggacaaaatttgtttggcaagtggcaatgatgtcaaaaggccaatatccaatttctcgttatcctcaattccgtactcttgagggcagataaagtcaaagagcactttagctagacggtataactctcgcagcatagcaaatttagggtcatcaaatggagaacccggagagctgccagaaaccttggacttgctatgcttgtcactttcaagaatccatccgattgatcccacagtatttggagaattactagtgtccaaggatgaactatctgtgatccggaaattgttcatggcaagtatgttgattggatattctctaaccaggcatggtgattgttcaagatcaacttcatggactgcatcatcaggtaaaaatatttcttgcaagaaacttctattatgtagcgcatcgtatttcatagtatcatacaattcacttatctttgaagggtgtactttctccacggatatgaactcctgaaataacttgtcccatctttccttaaacaagaatgcatcttccccacaacaccatcttgtttgcagttttgcaacatctttagtagcaaaattgtgctccatcagcttatgatgatagttcatcaattcaacaacacgtttgatgacaacgaatggttcgggcatctttggtggccatgcaaactgaggaggagcatcctttccttgtcttaacaaaggtttcaatttcttcttcaccttatccatcaagtctttggctgcgtttgaatcatctagtaaatctttacgaacctccaaataatcatcaggtagctcttgttcaccaaggaaagaggaagaaaacaatttggcagaggcaacaactcttctttcagaagatgtaaaaactttcacgttcttcaagcaatctttattcaaaagacgaacatcttgtcttagctgttcaccgacgtcagtagcctgatattgagcagaatgagttggttcaccaccccatttaatgatcaactgaactttctccacgttattatctgcatctaacgagggtttcaattgaaccttggtaccgggaaaagtcattttcttctctaatgccccggctagctgtgcaagctttgcaggatcttcggccttttcacgttgggcaaccaagactgtttcatgaacgatcttgaggtcttcgacctgcctaataattatctcttccttgtggcccttcaacaaggacacaaacaggggagatctgaaagagtacttgaacttttgtttaggggttctatcagcgtgtctgataactgatacaatacccttaaagacccacttttgggttttttcctcttgcacaaccgggaaaggaagacgaactttcagcgaatctcttctggtcttctctttcaagaacagttctctcaagatacttgagcaagaatcgtaataagcatcgttatccttgacgaatgagaatccgttgacgtcaatgacataagatttaccactcactcgtaacaggtcaaatccacaaatggtttgatcaaaagcagtgcagaccttgcttgccattagcttttcctcggttgataagttagtaatgaatcttatttccttaccatgtgtgtttcttctgacaattccatcaacaacaggtgactttctagtctcagcgtgacagaaattagggcccacggtgtaggctttgacgtcctcaaagtgatcggtatccatgaacttttcgtatatgtaagaacctttagtcctaatcatggttaaatccttatcaaactcagaagatttgttgccaattttacgaaaaagccttcttccaccgcccccatttttactggaataatagatgtagacgttgtgatcttcaccatcgacgggcttctcaacaaacggtttcttcaaaacttttccatctacgcaaagtgtgtcctcatcaatcatttcccaatttggttctttaacctcttcgacacaaacaccgtgtttttccaattccgctttcagttctttgtccactataggtcctccatctcttgaaatcactaggcgttcaggactaggaacaccagacgtatttaaaagttccaacaccagtcttctatcccacagtgctttctgcatgactaaattattaatgaaatagggttttctgagctttacgtattcaatcgctttgtcaaggggaaaaccggtggagaaaaagctgatcaaaaaatcgcatgtaggccagttttcaacactttcatccaaaataaccttgtctccaaaaataacagtttcaaattctccgttagcaatcaatctgttcaaaatctgtctgcatggtttactgagaactttggcatccattgcacaaacgccgatcttcccgatcttgggtaactcaggtccactaacttcagaaactgagactgccctatttttaggcgtatgtgtgcccgttgttgtcccagattgcgaaccagttgcagagttcgaagcattagggcctgccccgttgaagttggctccaatactgagagaacttacattggaagtagttttctccaatttatgactgctcgaggaaacagtgttctcatccacagaacgttttggggtaaatgactcgagaatcggagcaatcgaagccatagccttcctatggctctcaagagcttccttagataatggggtagggttctcgccaactgtattatccttccactccaaatcgacctgtgaatccaaagagctcattgatccagatttagaatgcgatcctgaataactgtcgttggccattaacaaatttgaatttcaagcgttttttgacaaaagagtgacagaagatctcagaagctttggcctccttttgatctccccacgttggtgaactcttttgatattgagtaccgcacgataatagattctcgttcacaggaggataattcttctttcctcatcgttgagccgcattggaaaatcaaattttttttagtagcacccgtagctaacaaatattgacttttctcttctcaacttcactggtaagaaactaacaagacatacagcttttaaaaatgcctgtacctgtgaattcatcattgaagaaaagaaaatcggagaggaaagctgaggctgtgcggccatctaagattttctctccctttcgtgtcttgggaaaggtttccaatgagattcctttcgccataggtaccttgggccataccttttacattgttaccagtgtggacagggctttccagatctacgatgcgaacactctgcatcttctgtttgtttcaaacacccaaactccttccaaaatcaacgccttagcggcacatttccactacgtttatgctgcatgggataacaaaattggtatttatagacgaggaatcctagaacatgttctttcttgtgaaacagaaaattttattcagcagattcttgtgtttggtgactttgttatctgtaccacttttactagcaacgaaatatttgtatttaagaagaaggattccaaagattcttatgctactgaattctacactagattgagtgtaaactctttacagggaaaaatagttggaatagttcatccggctacttatttgaacaaaatcgtcgtggctactaccaacagtttattggttttcaatatcaaaacaggaaagttacttttcacttccagtgatttcaatgagttcaacatcaccagtattgaaacggttccagtgttagatttgatagcctttggtacaagcgatggacaggttgttttatataacatcaaaaagggaaagagattcagaaagattagaacaggcattatctccaaagttacatctgtatcttttaggacagatggtgctcctcattttgtagccagttttgtcaatggagaccttttcttctatgacttggagcacaaagctagagtacacatccttcaaactgttcataaagaagaccatggaggtgtatcaaaagcggcttttctgaacggacaaccaatatttgtgacaaacggtggagacaacatgttgaaagaatacgcatttgatcctaatctatctactaccaactctagtatagttcctgctccgcattatttgagatctagaggtggacattctgctccccccacaacagttcaatttgcagacccaaactctcattttatgttgtctgcatcaaaagaccgttcactgtggatgttctccctaagaaaagatgctcaagctcaggaaatgtcccaaagacccccaaagaaatccgcaaataataaaagaattggtgttataccctctatgaaagataagctgcccgagattgtgtgtctagcacaatccaatagcaaggagggtgactgggaaaataccatcacaggacatgctggtgagaccatagctagaacttgggacacttacaataggagacttggaaggtgggatttgccgactactgatggtggtcaagtgaagagtgtagccatttcagcttgtggaaactttggatttgttgggtccagttctggtggcattggtgtttacaacatgcagagtggaattcaaagaaaactttaccgtctccataagaaggcagttaccggtgttgctgttgattcgatgaacagaaaaatggtaagttgcggcttagatggtattgttggtttttatgactttaacgaatcaaaatatttgggaaaactgcaacttgatgcgccaattacccaattagtttaccatcatagctcagatctggtggcattagtattagacgatttatccattgttgtcgttgactcggttacccaaaaagttgttcgtgttcttcttggacatacaaacagaatcaccgcattggactttacaccaaacggcaggtggataatcagttctgctttagacaacaccatcaggacatgggatcttccaactggatcttgtattgatggtatttttgtgccatctacagtgacatccttgaaaatgtctcccacaggagacacacttgcaaccactcatgtcaatagtgtaggtatcgctttgtggaccaacagagccatgttccatgctgtatctagtagacacgttgaagaaagcgagttctctaaaatcatgctgcccaacacgaccaatgatacacagaccaccatcattgaaggtgcatttgatgagaacaccgttgatgataatgaaatcactggtgtctataatacagtggaccaaattaatgaaaaactggtgacccttggtatcggtccccgttcaaagttcaacactctgttgcatttggatgttatcaaacagagaaataagccaactgaagctccaaaaaaacctgagaatgttccattctttttagagttaaagggtgaaaaagtgggtgacagagcaattgaatcagaaggtaaattggatcctaatggcactgcaactcaagaatcgggcactgaagcacagtcccaactgaattcccttagaggtgataacagaatgacttttgagaatgaatttaccaagaatttgagattgagttcggaaaccaaagaatacgcggagttcctcaagtatgttcacagcttatcccctagtcaagtcgatctagaaattcggtcattggacatcacagaatcagttaaagaggtatcgtgcttcatagaagctctgactcaaggattagagaataatgataattttgacttaattcaagcctatatgtctatgttgatgaagtgccacggagatattatatttgatagttctgacgaggagctgaaaactgccctgagaggttgggagagtatcaacgaatctaaaaaggccaatatggatagcttggtcaaatactgttcaggagtgataaatttttttcatactgtttagaacatccgtaatgaataagatcgttattctgcacgtagtaattcaccaccgagaattttatgttcttatggcatacgatacatttggtttccctggagacaactacatgtttggtgagaacatcatgccaaagagtatactccgatttattctttaagctggtcaacaaattcattttcaaagtcgtgtcttcggctttattcgttagattcaccaattgagtggatatgaacctgttcaattcttgaattgggaattcatcaggaagcagctccaagacatccaaaaatagagatgtatctccactagtagagtttaataattgtagcagcagcgtctgagaatcttgttccagaaatatccgtaaaagcttgagaatcagattttgatgtccatgcagtttaagaacatactctactgcttcttctggctcttttatggagattagtatatccacaactttttcatgttcttgtagttttgccaagggtagtgtttctaacttgaacaattgataacttggtttcttgtcaagtcgtgactttatctccaacacaatagtacttggattgtaaaacttattggctgcaacaaattcgtagattttttcaaaattctcctcatttaggtctaaaatgtagttactgattagaatagtatgcaatttttctgaatctttgggttttaaatttttcatccctatgagatactcaaggtatttggttaccaactgcggcttagaagattttaagagatctaaaactctaaaaaaatcatacgaatcacactgagtgctgtcaaccataaaaacttttggaaaatcttcgtcagagagatagtcggtgaaacagtgaagtatagttgaaagttcgtcgttgcccagttttgtgagatatcgtatcaatctttccttattattgtggataagagctatcgacttggcatgagatcctttgttgaaatagaattccaccagtgtatcagtgttccctgccagtctcttctcaactttttctatggtacaatgattcggtcgccttaaaaacgattccagtaggtacatgttgtttgtcgccaaataagcatcgaccagcgtatcatcaacgagagtaagcagttcttggacattctttgcaaaagttggagcttcaggtgggaggaacgattggatatcttcgtcctctatagacagaaaattatcagtagtgagcacaatatcactgtccaaattcaattggccagttctttcaaggaacgttaattttcgatggatatctgtgaggtagggtatcaaatactctaaagacttggggttatctttggacaatactgttggaatgactattagtggagatacaaaaaagccgataaacttggaaattacagaagggatatcttgatccaactgaatcagaccttgacaagtggttaacttctgaagagattcaaattttgactggaagctggcatctatggaagaattgagaatgagatttatggctgtttgcaatgaatgttcgttgtggtgattcaactgtgacagcgcttcctgaagttggctgtccggagattttaaatgaaacgaaagggaaaattccttactgaacaggattagtgtgtttttgtaaagtgttgcagaaatgaaatatgaggcatctatttcctggaccagagaaccattaaaaatgtcgtaacactgaatagtgctattattgagtattaataagtgagtgtaccatacgagcaactttgtagagggtattgttttcagtttgtggagtaagttaactttgttattggcaaaatggaatatgtaaacctgatcattaacttttacgagaaaatgctcatcattaactgagaccatgtgaatagttgggctgaatattttggatggcttcaaattgatgtgtatgaagtgcttgaaactagtgttaaggttgagcaagtacaattgggaggaagttctagctaatatatgggactccttaacaataatcgcatctttaatttggagttgcaattcatgtgtcaccttcaatgataccaaatctaatagagaaattgaatttgaatttctcaaaagtaacaggtgaacatcggctgagctttgtgaggtaatgccttctagaatatctctgataactttatagttggtggaacaatgccaataatcaaatgtctctataggtgtttcgaactcgaaagtcgtgctggatttctttgtgtcaacaagagtcactagagacttggtaacaaccaaagtaagatcgccaattgagaacacatccaacacgggacttgaataattgagctgtagctgttctttcacttggatgttatcttggacaattctatggaacgaaacagaatttgagtttatcagtggtatgagaccttctgaaaccacagttgacccaaccgacgtgatagctctactaagagggcggcgctggccatcctgaatgagagacattgattgaggagagttcaaagtgaagtaaactcggttgataaaactaggcgaggataattgctgagcacccttccaattttccctctaacagcgaactgtccctgccaacctttcctacgataacactaattgagtctaaatggaaaaataccagaaccatttcagcaaatgtgtacaacaaatactttttaacaaagacaaagagcttcgtgagactttagaaacattggaacaaacatcgaaaatgattgtgaaacagggcaataatttgcaagctgatcaccaaaagctaaacgaggcttcacaaagacttgagaggcaagtacgaaagagccaaaaactggtaagcaattcattacaggaagactgcgagactatggatcgggatttacgtatactagagcagacagtcaatcttatcgattgagcagcgcagctggagaataaggatatgacattattaattagtattggagtatcatttcacaatagatttatcggaagtggagcagaaacagccgaagtaactccacgttcccaagttttgtcggctacccatccactatgcaagatttcaatgacgtttgataagctgattgctcgtttcaaagcactgctctgaacgaccaaagtttgataaacgatccagtggtcctttggagaaacgatgtgtttaatatccccctcatgcatgcgtttttgaagctggagtcttccatgaagtgtttgatattcaggcaacggtgtcagccactcagcgtgttgtttttcccacaactcgtcaaaatttaagtcatcatttttttgcggttgttctgcggagatgccgctgacgcttgcctcgttgtctgtgcgggtctccttaggagaactctgctctatttgagagcccaaggggaccttgtccgacgacatgttattgctcatgaaaagctcttcgagaatttcgtcggatgagatgtattgcggactatatttgcccaacttggagaagaaagagtccagtttgacagtagtacgtatgagtagctgtttcactttcgttccaacgccttctcgtttggacgtacacaacacctgccggtttcgttcggccaaggtggtcatggccgctgttcaagaaagaaagcgaggatcaagggaccagaaaatcggaataagggatacaatctgggagataaaatgtggagtggccagctggcaagcctcctttcaagagtgggatagaaatctaaaattgtctgttattcgcgatctccttatgaccctaaggacaaacttacttcttacaaaactagatattgaaagaggaacaggactacaaataccagtagaagggcgaccgcagccaaggtagcaacaccaaacttgtagatgtacagctccttcagttggagcagatattgaacgattaccttgttgctcaacttggactcaccttcctctctcaaaccgaaggagaatggcacatctttaattccatgtggaagcttagccttgactagcaattccaaggcaattttgaaaccttgaacatccagatcgttggtattgatgctttcgaaaacttttttctgcaaaccgaagaatccactcattgggtctgaagccggggtaaggggcagagccaaaagacgtgcgaaccaggatgtaaatctcctgaaagcaccccactctttgtcgatttcgactcctggtgcatatctggtacccaaagcaaatgaggcatctttcaaagcgttcaggacatcaggtacagattcagggggatgttggaggtcagcatccatgcagactaacctttcacctttggcttcctggaaacctctaataacggctgatgaaagacctctctcggtggtacgtaccacaattctaacattgtaaccctccttgacgagagcatctacttcttcaactgatccgtcctttgagttgtcatccacaataatcacctcagtgtcctttgaaaactcgttgccaagccctgcaaaaatacgggtgaccagtggtctaatattattcttttctttataggcaggaactatgatactgttgttgattgccattttcagttgagtctatggtacaattcaaagttaattaattaatgtacgtgtcacggatgtttcaagcaaggtgattgcgatgcccaaatggtgttaagatgaatacgtaatcatttttggctaggggtatatatgtatatagatggtcaaaaatgcaatgacaatgtaatgattggccgcttctagcggagaatgtgatcacttgggtgatttctcaaggctaatgcaagctctgaacttttgcaagaatcatttttctgttcgaactgtgctgctatatccccgtcaacatctgagttgtagataatgattccattgtcagcactttgtctcttctcatccctcttgtagaagtataggactacgaaggacatcaatgccaagctggtagctgatgctgctgtaaaactaaaacctttgaggaatcgtggagcttcgaccgttttccaaacgagaagcggaatgaaaattgttgttatttgagcaattgcattcatggctaccaaagtaatagcgcgttgttgagggtctcttcgacagatatcgttaacccatgagtataaaacaggtgccatagcccaaccaaaatactgcatacagaacgcaaaccatttagcacgttcgttcacatgccaaacagctaggatggtgttaccggtgatgttaaagacttgggagaacacaatggctccccatctagagtgcagcaagtcggcaaaacaacctgtcaataaaacccatattaaacctaatgcaggagttaaagctgacatctgttgcttcttgccagggctgtatcgacgacttccatctgagttcttcaaggaatcgagccacaaaacataagtccctgaattaccattattgttgttccacatgaaagcatcccatatggtcaggacgtagatatgccacgacgacaggatacgcttccaaagactccatttgaataatgacctaagcagcgttttgtgatcaacaggggcagttgggccggtagtatttctcttcattcttctccgggcaatttgtatgtcttcatcggataggaaaattgagtagcaattatcaggggttccaggaatcatgtaaaatccaattacgcctactgctagggatataagaccatcgacgatgaagatccatcgccaagagttcaatccactttttccgtccattccttccacaatggcacccgataaaaggcctgaagttaacaatcccaggaattgaccaagatacataacagtctgccgcctagcgacttcatccactgtgtaccaggaccccattaaataggtgaaccctataaatgctggagcttcgaaggcgcctataaaaaagcgcatgatcttcaattgagtgacattttctacccggtaacttcctaatgtgaaaatcgaccaccctatatctaacaatggcattgcgtaactcaatggaaatccgtttagcacatacatgaatggtatttggaacacaatattgccaattgtgaacatgacctgagtattcactaggtcatttcctttcattccaattccttctctcagtcctccgacataggcattgttgatatttgtctggtccaagaatttaatccaatatgccatggtagcataaagagttaggagaatatcaactttaatcacgactctcctttcttctggggtatcagatgggttaaaccacttataccatttgtgctttgatcgtttatatttgttttgcctgtattcataatcatcaaagaacctccaccacttacggtctttttcatcacggtattcaatcggtaattcctcttctttagcttcaatattaacccctccttcaagttcagtctcatcctcaacaatacgtctcacaggcaagaatccccatttcaaccgtttgaagggcgccaagagccaatgtggctccaaccactgcgacaaatcggaggaggtatcactcacatcaattgtggcaatatcagatagcttatcagacatggccagaattctgtttaaagtgagtccacctttttttttttcagaccttttgatgtagggggtatagacctccggaatcacgttcactgtgcatgcaaatatgtcacatcgatcatcggtgaccgacagatgatgtccttgcagtcagacgggtaatgagaacgcacggtacatatgatagtcccgcatgaccaaccgataaggtgtacaggagtcgcgtctccattttaaaaatacacgccgcctcctcattcttgtcctctgtatataaacatcgccctcctctaacagccatgaacagctaaactaaacgcgtggatacgacccacaatttaaaagttaaaacaaacaagtcattgattaccaattaactattaaaaatctagatagactgacatactttacgaatcacaactcagatgtatcacacaaacaaacccaataaaaaacaagaatcatagtctggatggttatcactctcacatgaagcctgggaacaaacttagactcttaatacaaaagataacttggtttaaatggtaacaaatatagtttgatttgggaaaaaagacatcggtcaaataacacgaaaagcatggcaaacttggaaaaattgcggtaatacaacaacagtcagctcaacagggaaagggttaacggtatataaaggggggataaactggaacacaaatcgtgaagcttaaccagacttctcgtgctgagtggagactctttgcatagcaacaatgaagtcctccatggatctttgaggtggtggttcctttcttggcttaccgttcatcaatctatcgaatccttcagactcggacatcaagtagtaagcaccacccatgacacagaaaacaccgaaagagaaaatccagactctgacaacagtaacgatgtcggtccagttttgagaccaccatccgaacaaggtgaacatagtggcgataatgtcgacaataatgacggcaccggccaactcccaagatgggcaagaagaccagaatggaccagcggcacgagtaataaaaatcaaccagttctcagttaaggaaatctccaagaataaaacaccatcaacggaaccgaagttctggatgataccaccccttggcaacaacattgtagtcaaggtaatccaggtaccgatagccaatatgatacccaaaatgatggacattccccaaagtcttggaaggttccacttagttggctttggagagtatggagcattatcgtaagcaatggccagggtagcgacatcggcaaaaatagcaatgaaaacaaccaagtcaatgttcaaagatctgttcataatagcaatccacagacccaagaacagctccaaatgcaaagacaaagcaatacggtaaacaacgtacgagtacattctgtggaaaatttgtctagaagtcttcaaagcatcaatgatagcagacaaaccaggagcaaggaaaacaatatcagcggcagaacgagcggcatcggaagcaccttcgacggcaataccagtgtcagctttcttcaaagaaggagcatcgttaacaccgtcaccagtcatggcaaccaggtaaccacgttgttgcaaaatctcgacgacattgtacttgtgttgagggaaaacttcggcaaaaccgtcagcattttcaacgaagtcagcaatttcggaacctggcatgtcaccagctccacccaaaccaagtctctcagcgttgtaaatgttggtaccaagtcctaattgacgacaagtttccttagcaataccaacggcatcaccagtcaacatcttgactctaagacccaagtgagtagcttcgttaacggtttgagcggtgtcatcacgaggtgggtccatacatggcataatacccaaaatttcccagtgaccttgacctctctttctagcaacaccaagagatctgaaacctctggaagcaaattcagcgactttgttctcatagttgtcatggacatcttcagggattgggtggtcttcctcgacagtcttcaggacgaatagaggagcacccttaacacagataattctttcaccttctggggattcaacataagcagtaaccttcttagaaactgggtcaaaaggctggaattcaataaccttgtatttggtcagagcagccttggctcttgggtaactgatcaaagacttcaaaaaggccttgtcaatagcatccaaacccttcttctttctagaagcagccaaacaagcagtcaacatcagatcatcagcctcaacaccctcaacggtgtatggttcatgcaaggacaatttgtttttagtcaaagtaccggtcttgtcggaacacaagatctcgacaccagctaaggactcaatggcagacaatttttgaacgatggcttgcttcttggctaagtaagaagcaccgacagccatggtggtggtaacgacagctggaagaccgactgggacaccaacaatggtaatagccaaagtgaaacgcagaattctaacaataggagaggttctgtagaaacaagcaacccaaaccaccagcaaagtagcgataaccaaaaccaacaaaatggttccgataccattcaagacttcagtgaagtgaccttgaccagcggaagccttgttgaccaaagcagcagctctaccaacaaaggtagagtcaccagttgcggtgacaaccatgtaagcttcacctctcttaacagtggaagaagagtaggtagagtcaccagtcttcttgtcgacggctaaagactcaccagtaatagcagattggtcgacttgcaagaaacattcctcagaaaccagacgaccatcggctggaatgacaacaccgtcttccaactttaggatatcacctggaacaacttcgtcagccaaaatatcgacaacttgaccgtctctaataacagtagcagagttagccaaagtctttttcaattcgtcgacaatagaaccagcttggtattcttggatgaaaccaactgaagcattcaggaacagcaaagccaaaatcacaccgaaatcgacccagtcctccagaccagcggccagaatggcagcagcctccatgacgaactgaattgggccgacgaagaacatacagaacttgacaagaaggttctctttctcctcagccatcttgttttcaccaaatctctttcttctcttgtggacctcatcagtggttaaaccgtaagctgggtccgtttgcaagagttcttctggaacgggcttggcggttgcaccctcatggtgctcttcctcctcttcatcgtcgaaaccgtggaccgactgcaggtcctcgattaactgatcgatgtcctcatcttcatcgtcagaatggttgataggaatcttctccttagttggctcttcagcggacatcctttaaggtaaagaagtttttaaaggaaagagataaaaaatcaaaaagcggaagagaaaagaaacttatatctggtgggaaaacagcactgataatttgggttgttttgtttatataagagattaggaatgtggtgctgcttttacaacaagcggacgacgctaagctgtattttcgagaaaacgacgcgatccgattatatcccgaatgggacacttcatcgaagtgaaaagagctcaaaaagttactaatacccccaaaaatggccatctcagctctgctggaagtcgtactggactcttcgccattacccaataaaaaacatcagcttttagaccatagctatctgaattcattggactattcgaccatggctagtgggcgtttcatttctggctggtgtttatgccttacctaaaatgtaatctgcgttgttgtcatattatctgcagtcccgatagagtaatccatattccaaatttggatattcatcgggctgtaaaaaagaaacgcggaagtgattttttcaaaactgagcttcggattgggctatttcttagataataaacagtcttgacaatagagaaatttgaaaaattcctcattttgcgatacccgcccatggaagaacgggagaatcatcgaggtttcctgagggattaaataattcctttctgctagtgggaatgaatttgggtgggagctgagtggtttatcgtttgtgacttcggtttaaagttgtaaccctgctttctatttgctagggtttgttgatcgaaaatctttcttataattccgaccggttaactacatacaggttgggctgcgatcttcatcgtttagaagatgaaaattacgatttcttgtgccgccgaaaataccaagacacaggctttactttgaatggaaacctccaccccattcaaggtcaaaacgcaacggttttttttttcaactcctttcattctttctgatcttgcatattacattattctcattcgcttgaatctcgtagaagaggtacgctatgacataatcactggcaattaacagtctccccgcacccaatcttagagggcaaaaccatggcttgtatccgaggcattatgcgtttcaatttaaagtttggccatttcgcccgatagacgaactccggtcctagcaaaagtctacaaggttcaaggagttaggagagatgaacaattggatccacgatctttcgtatctatgcatttgatctgatagccttgttgtaaagatggcatgccgaaggagccgccagcacttattcccatgcatcagagcatgtttgttctttgagagattcgtaaactattacttaatatccatcggaccttcccttttgggaacccccaatgaaattacctgtaccgatccgacaccgagatgtacctattttcccgaaactgagaaacctagtgaaaattacatcaccagtagcgacacttaggctggagagtaactggctttactgcaaacgtttaacgtcgataggctagttacccgttcttccgctctcatatataaataagtacgttgtttcaaagagggagctgaacaactgcaagccgaggttggtgtcggcatgtctttgggtctggtatcgggccgtaggccgaagtgtagatgtgatagtattcatcagagccgatatatgttgccagcctcggcccagccacacacacacacacacacacttattgcttgcgaccttacgccacacaccgttagaccccttccgcccaccatcagccgtgtacagatatcagatatttcgccttttcttgttctggtctgcgctgggctcacttggtaacttttctgcttatgtaatttgtgggtttttttttagtcttcttcctcccctcaccctgaggcgcgcactctatttgctttatctgttgcacacctcatacaaactatacaagcctcaacgtatataaactccctatctcccattgacaaatgacagagtctttattccagcatgaagtgggaccagctattcaagctgctattgagcaacaaaagtttcttttgatatattctaccacggatggtgaggataaatggggagacgagcttatcctgaataacccgaagtttccagatctagtcaaggggaaagctataacattcaaattggtacagggttctcgggattttgacaattttaagcaagtgtttccaggagttactgttccaagcgtaatagtgataaacgctggtcaagttgttgatttactgcagggacctctaacgcgagacgaatttaacaataggataaccaagatacttagcacacaggtaaagactagttccaatcccctgccgaaaaaagaaaaagagtctaagtcatctcttagaaaagactcgaggtacttggctgccgaaatttacaagaaagagcaacggaaacgacagcaacaggaaaaagaagaacgagagcgtatattggaattggttcgtctggatcaacgcgagcgaaagagaaggcaatcttccagctccaacgataaggatatagtatctgaaccattggtggagaatgttcatagtactcatgacaatgatgagatgtatattattcagctaaggctatttgatggtaccgcaattagacatgcgttcaatagtcgggacactttggagaatgtccgtcattttatcacagaatcttatccagaatatcagcaaaaaacttactacttttacaaaccattgcaaagaattactttctccgacacagatgaattcaaatctctatttgatttgaaattgaatagagcttcactgatcctcaaaccacgggaattttatggtacaggcaacaatacaaattcaagcttcactccagctggttcgagtatattcggccgtattcaaggattcattggatccgtaatggggcataatcaaaccacagcttcgtcaactcaagagtcaacaaaggaagagtcttcagaagatcatgttgaagacgaggagtttatgtcatgtaacggatcgatgaaatcgccacagcatagtccacttctcagatcagagggaaatgcaccctttttgtcacatgccaatcaatcaagtttgaacctcaattcatcagcgtcaaatttcagtgtcacagaaccccatagaactgaagaagcgttatccagacccgaatctcgtaattccaacagtatattgagcagtcgcataaatagcagtacgcgtattaggactttgaatcatcaaggtgaagatcctgataagagacaagttttcaatggaaacaatttggacttggtcgatgataaaaataaataaatgaggttaagtttcgataattggttgcataaatgttattataatgttattatttgataattagtagttatctaattgagaatcttttggttgtatctctctggctggtctaccggctgtttcgttttctctttctcttgactctctgaagtttttaggttcttcaatctttcagtcaaacgctcgtcctcaaggttatccttttctgtctgttctttcagtagtttctcatattcgtcatcaatgtcaacatcattagaagcctctcccaaaagttcagatacttgatcaaccttggctgtctcgttgctaatagcctccatcaactcatgaacgtggttcaattcaccgacttctccgttgagctgtttcaatatataatggcttgactctaaggtattgacaacagccaagttattcttcgcatgattaatactattgagtagttcggaaactttgtagaaattgctactagttcgttctatgttcaactccaccagttttttgattttcaagcaagatttggccatgattttgttaccatttttcaaatatgttttcgcattagtagttgtgacttccaatctttcattaagatagtttaattcagtttccatttgatcagcactttttttcagagacactatagctatatcagattcatcaattggagtatctccaaactttaccacctcaccttcaatttgcagaagtttcttttctttgctcaaaaaaagaagtatcaattcgaaatcttctttacaaaatttatggctgaatctctggactagcgagtccttgtgaaccactctatcggtatagtgatctctgtgtttctctagtaagcttgctacgttttcagtatacttttttaactgctcgaagtccaagtagtcaatatccttaagcctatgatttgaatctccactgttaaaactccggttactgatccactggaaaataggtagaaacaagctaccaccgttaagtgagttcttgaagtcatccaatcttactagttctccatccttgtacagttcgttgattaccagatcaaggcgtggcttgagatatcctggaatggtcactttttcttccaattttttgccgttaatcacaattttttggtcaaaatagccattatccatcaagtgtataattaagcgtttccaagctttgaggttgaactcatatccaatttcattctgctcccttaagagtccaagatcagagtacagagagtcaagtctctgctctgtgaatccaacatcaaggtttattatctcattcttgctgagagacatagcctgattcaggattgtgaagtgttctggctctccctttgtctccgttccgcgaaactaatatctagatattttcctatcttgattcactatcagactctatcgactcctatcaatgacgcctgaatcttcagagctactatcaaagttactcaaaactttagaagacagaacatttgattcagcaataattgcggattcgattgcaagtttgagtggagatacatctttgcatgaggatacggacggctctgggctttccccaaccttgaaactactggccccaaagctactcgatgttacgaaagatacaagcgtcactattgaccaacacaaatctactttgaatctatgggaagcactatttagcaatctgactttcaactgtattatagaagaaatccctttggtgttcattttggattctatcaacagtggcaattctgatctggtgcttctggcgatcaaagtggttctgaaagccgatcctattgactccattgcaaacacttcgataataaaacatttaatcagtttgttgggtgttgaggatactccagtttctgtcgttaatggaatagaaaatttcatcaacatagccctgttaactggtggagacttaatcaagagacgatttacatccacagaaatcatttccattcttctacaaatgaagcgtaacgagtctgaaaccatccaggctagactttatgaggtagtgtttgttttactgacctacaccaagcaggaagagatcccccaagacctgtatttgataacagaaaatcaatttaattcacttaatgatattctccttaaaagtctgattattcaattttatacccgtcttttgaaacttgcacataattcagatcactcaaaggattggttattgcgaaaaattagaccgcaataccagtacattttgaaattattctttgacccagaataccatggtgaagaaaagtttctgctagtacctgaagctgtaaagaccattgccactttgtcttacataaacgatggcgaagtattcaacaatcttgaggaaaagcactcaattctttcaacagccactgactcgttctacggcgacggttccgttctattactatctgatattaaccccactgtactaattccaaaatatcaaacattcatttcaagtttgcctctcagggcttcattaattccaatcatcaaaaacttgattaccacaccagaaactttcagtttcctttcattgcctaccacctcccttcggaatttgcccatgttggaattgtttgatattctagcctcagtatctgcgttcgaatatagttcgcaagttctacttcacgaatggccctctatcatgaggaatttgctggacgagaatgtcagcattactgaacctgaagtgaggtttttgaaacgtcaaatacttgaaaacttgctccaatataatgcctctgttcttggtatttggagtactcaaatcaaacgggtccaccgagaactcatatccgggaaaaggttagaggctcaaccggttctaggcgactctgtttcctgattcttcacagatttattgattgatgaaatctagaaaatatttggtacgtccttcaagttatgatgtgctcgattgtaccagtacttattgttaaatacccaatattgttctccagtcacagggtgcgttcctagtgtgaaccacttgggtttgtattcctggttagcagcctctcgtttacgtcttgctgctctttgtttttcttccactttattcttttcaacagatgcgtcatcgtaacgaccttcttccattgctctttgatctggtcgcaatcgagtgtcagtttgtggtagccagtccaatagcttcttctgaggagcattcaatgatgcggcaaatgtggtcaggttgaaagccatatcttttggcctagggttggctcgccaaataacaaatttttcttttccagagcctgcatgctttccatataaaacgctattccagtgacctccaatcgtatagcgaacaactcccttgccatcaacaacttctcctttaacctcataggcactgttagaccgccagcctctaggcttgaaattgagaacaacagagtccttagtagtatggttaacaattttcatttcaccatagttatcaactgtagggctaccagtaataattccaacaacagaactagtaactttcttccacgtgtataattcctccttgatcccgtgatccggtcttaaattcaaataccaagtacccaatggcttaatatcaaacgaacgaccataaaacttggatttcactgcgctctctccaaaataatcccacttgggagattctgcaatggcagcaccaatgggaggatggtgggaaacctgttccacaaagaatctgtaatttctatcaggtcttgcatattcatatgtttcgcctagtagggggttaaaaggtttggcaattcgatcaatagtagatgcatactcagaggcagcaaacgcggcaacataaaccagtcttaatgcagagtcttcgaaagtagcagcgctatccaaaaggtcaacatactccatatcctcggcaactctttgaagcagagaagtgcattcattgaacgaaacaggaagtgtcatctttgtcatgtcttttccaatcatagactttaaaattccccataaggagattttaggtctgtcgtcggatagggaaagacgagttctaattccatcttcataccccaaaaacgaaccttctttctccaggattaaagatttttctctttgaagtaaagtcaccaaggggtgaactccaccctcagcatctccttcttcgacaagagtagctgcgcgactctttctcctctcggtaaccggttctttctcactgattgtttcgtcaggagcgatgccactctgaatactactagagtcatcctcagcgtcaaaaaactgatcatcgtcgtcatcgctttcgtcctttagcatatcaataatttctgcttcaccttccattgcagcttctgtaatgggggacgatccggtaacggtcacctgcgtaacttcgggtttggaactttcgccagaaagtgaaaatctgttctttaggactttcctcaaacttttttgtttattttccaaagtggcaagcctttcttcacgatctctaatctccgaatctaggttttgaatttccttttcccacaaacttgagatctttatttgacgttccaaagttcttgtcaacttctcggttcttaaagcaaccagtttggtatacttctgaaatatccgttcaatattcagcacgctattagatgatatctctgcaaacgtatagtccttcggtaaagagttcaataggtctttgaaagttgacaactccatcgtcagattattttgcaatactttcaactcggatgaataaacagataaagctctgaattgatcctgatacccttcaccaatgtctgaagagttttcaacgtcttcagcctctggatcatattcttcaagatcaccgtgtactaattcggagttttcatcgtcgtagtccgaggcaaaactttggttagaggcgtttacaattgcctttctcgatgaatccatggaaacagaatctgcaattgtaaggttcttgtctgtgttcaaaggatgcgcttctgatatatcaggcaagccctgacctgacttttccaacctctttgatggttttctactgatttcggatactggagctgaatcaggctcattatcatagtagcttgagttcgaaatagatgaagcagctgagcttgttctaaaatggcccattgcatttttggaattgatgttataagtgtgagaatttcttgagctgtcaaagctttctctggcacgtgaaaccgctgatgatttggaacttgactccttttctaatagttttctttttttctctatatctttggcgtatctgatagcattttgtaatgcccaaacccatctattcgtttcaatatagtggtttgctttcaaatgccatttactaactgatccggctccaacaatgataatttcaaatttagacttttcagagctatccattttcaatgaggcatggcagagattaatcgagcctctgcaggaattgtttatatcattgggggatttgaagtatgaaagtctaccatggtcatccaaaatgaaccaacgtaacttgtaaccgcctgcgaagttagtccatttctttaaaaaacctttaaaagtgggaggtccaaccgatgttgcaccctggtcaataatgttctgttccttagagctttcttttaatatcttttttacttcagaagaaacagccgtgtcaatgggtaatttccccttcacattcctcttaaatggatcgccaccatgagagacaataaacttgaccatctgtggatcatttctctttacgtactcgtggagaacagtatcgccagttacagggtctgttccgttgatatcaagcagttctttagtacgggggtcggttaataattcatctaatttttcaaaattccgactttcgaagttctttctcaattcggcagcacttttctccacaaactttgtacgtaaatctgaaaagagttgaccagtttcaatatcgcctgctaattcaattggttgctgcttatttttgttcaggatgcagtcgttaattgtatctagggacatcaaaaagctaacgatgtcatccctagtattctgggccgctaaatgcaagggagtgttaccatcaccatcttgaatattgacatcagacactagacccttctccacaatgtattgcactatgctcaaaggtgcaacttgcacagcataatgaagtaaatacttggctactttgctaacttctgagtttggaggataattgctattcttgatttcatccatttgtttttgaagcttctgcttatcaccatttctaaggcaatctaggaacttaagtcgcagcaaagaagcattcaactttgagcttgagtccagagcagttctaaagttagatgttagttacaattttgtagtgcattcatagcattgctaatacttactgagatttttctgacattgctctttggttgaattgatttcttctatagttgagttgataaggaggtttgtttgaataaaataacagtcgcttgcctgaccgttttgatggagggtgcggtgcgggaggagcaggtacgatcgcgagcaatgttaatttattggctgggcgtcaaaaagatggcatagaaattacctgaatgcttaaattttccgaaaaagttctgtcccacaccatcgagagagccattgaaggactgccagatatacacctgcgattcctaattaaacagtatacctcacgtcccaaatgagtctctaaatttgcctttccgtataaatgttactaatttcgacctgtaatctctcgactaatgagtaatgatgcagctagaccctattgttttaaagttttaatctacaatcaaaaaaagtctagaagaaaatgacacagccctgtcggtgggtgataaataatgcatgccaaaagtcaaattttaggtctcctggtacaagaatatttgtagtcagcaagacatttagatctggatgcttacaaatttaatgactattcactatgaacatgatatacatatttacattcaaatttgttaaaggcactatggccgagcggttaaggcgaaagacttgaatctttaagaaatcttttgggctctgcccgcgcaggttcgagtcctgctggtgtcgatattttttgtttttgttgttatttcatgtttgagtattacccgtttgggcatgatgtaaacaagtttagtgtattataccctgcaccgacagtactaacggtaccaactacagtgctcaaagggacacgcaaaggttagaaggaaatcacactcaatcttgatcttactgttttcctctcagtttttgattcagggaggaagcacataatgaagattcgtgtaccatttctcatactgagctgtctcagcacggcgatttgcatagttaactcatccttagcaatttacctttgcaaaaaagtatcctttgagccaacactcgttgctctcgcagtaggcgaattaataccactggctggtattgttgtcgttggaacttctcaaggaggagtcctattcatgggctgtctactagtaagttgtgtggcatctctagctagcggaatcacttggttggctagaattgtgaagaacgtcgagagaatggcaaaatacttggaatcgtactataacttaaccatttgtctgatatccctgttcattttgtcgcaggtgttcaagattgttcttactcacttcatcccccattccacgccgaagatagaatttcccaaagatgaagaaagttttgccttggaaaccatcctcaactataaggcttcagcccagaccttggtgcaagaaacaaatatacccacacaccttccaaatgagggacaggccacctggtgcaacgataataatgattctgttaaaatccatgaaccagcccaatactcccaggatatcaagagcagtatgcaacttgggtccgagagatcgtcccaacagtgttttgaccctgaagaatacaaagtgcataatcacaaagaatccctaaaatctaagagatcattggagtttgagaaaaatatcataaggaatatatccaattcgttgctaccacctgttctccaacaaggtaagagtgatatttcgtatttgcgaaatgaaatgatggggactccggaaaaatctcatcaagataacgagaaccatgatagtgaggggaagttgtttatcgacgacctgagcgatatcccagagagctatcctcaaaaagatctttggaactctaatagaacagggaatattagtcacgtttccttaagaaactggaacgaaaattatactgactggaatcaaaggcaagaaagaaaaggggtcacaacagagctgtatcaattgaaccctgaattccgaaacacggaacagttgttccacaataatgatgcaagcagtgtagagcatatggaacaggaaacgtcatttggagctccttcattgtactcgtttagtaacaacaaactaaggcaagctgaaagtcaagactcctccacagttgaggcaaatgtggggttaacactaatgacaaatgtaggttcaaagcaaacactcatacaggaagaagaaggcttagacatacaatctaagggaaagcagcgaagatcttccattgcaacgttcaaaaataccagtccaatcaagaaactaagagaactaaagaatgaaattcgaagcaaaaactccgttcaccataaatcaaactcgtcgttgactagcagcatccatgttgggatgacttttgcatctgcaccaacttcacctgtgaaaaggaagacccacagtctttccaaatctatgtcctgttttcatgtttcgtcgcagagcattcataggggtgatcgttctctaagaacggtccatggctctcctgaaaaacctaatctatcaactttaagacattatcctccactgagcgataatccaagttctagggagagtagccaaggatcatcttgtccttccatgtttgtggggcagtatgatcgtgaaaaatggaccaaactcaagtccaaagaggaagtaattgtataatcaatattttaatgtaacatcatgatgatcgcctttggcatcttaagtttcaggatcacactgatcaagcggtcagtcttgtcaccttctcaaaagcagaagtgggaagaattggtgtcctgcggactagtgaccagaaagggtcactgcgttaaatatcataactcatgacagtatcagagtaaactttctgaacgggaacatggaaaaaagagacggcaacaaaaaacgccctgcgattgtttttgaacacttgtaccggtaaaattggccctagagattgtgtttgctttctggtattattggggttctgcagtgaacataggcaaaacatacgttattgtaacataaatctctaacagtaatggtagtgggtgggaactgacaacattctcattgtctccaattagttgttgatggcgcaaactaccatagtagtaataaaatgcccaaagtaattgtgttctaacaacagtggcataataaaaaggcttggtgattggtacgcttgcacaacaccagagggtaacaatggcagggttgtgtaattgtttctactggctaacagtactaggtggtgttagcagtattatttcacagtaaacagtctccctggtaatttcaggtaagaccttaattggtcaatattagcgatggtcgatatggtggttagaacatcaatgtagttctaactcacccttcaggtttgtgaagttggctgatccccgcctcaggtcagtttatttccgcaacagaaagaacattttcttgccattcgaaaaagagccctttattttgatatctcgtcctgcctcattcaagccatagccacaactcctagaacacctaacattgtatcacaactgatattggaggctccagtcacatcggtcatccagaatctggagcggatacaactgcatgaaaccttttgaattcttgatatgatttccgagttattgttcatttgagcgggcgtcaatatcgtatgttggaggtcaaagaataatcagctagagaaaagacagtaagaccaaaaatccaaattcggccaaattgtttagctttaaggaaacttgcaagggagagaacactatacgtattatctgttcccctagcagcactgatagtttgaattttggagggaggacaattgactaccaggcaagtacgacctcagaagtgggtcaagttattggagaacttagcgtttttcttaaaccttgaacttgaaaacaaggccagcatgactcagagtaaacatagtaaacaaggatgaattgagcaagctggtggtactttgtagttcgattatcgggaaggaaaatgaagcagtatctacacaaaatctcttgactaatactgatgcaagagtgcattgaattttatttctgaaacagaaattttgtgcataaaagtacatgcatgcataaccgagtaggcatatctaaataaggtgttttctgaaattctatgtctcaaaatgacctccactactagtgacacgtatattttgtgaactgtccaacaaacgccaagactaactgcttgaaattagaatcagttaaagaatgaactttaagtggttcacagtttgtggaggtccaaatgtaaaaaataagatagctcttaagctgccggactcaacacttcgaattccaaaaactgttatacttttagtttcaagtcaacttggaagatagacagtgtcggaaacagtttgatcttttaggaattagagagctcctgcgtttggtccacaaaactaggcatcttaagctcaagctagcgaaggactgaaaacaacttgccatagcaaagtgactgattcacaattttaacgccttaaatgtgtttccttaacacataagaatattcaaggatatactagataaattttaatccaataaaactactactgatagatattgacttgaaaatacttctggctgaagaaccttttcgtatcaaaatagtctggctccatgaaaagttagctgcaggctttgttcaagaacatttccttatgttcgttaccgtccgattacgatattgcgctatggctattgcgataaagctaccgatattagcgaagcattccaagttaagtcaaaactacatcaaaatcgtcaagactacgaccatattttcgaggttgaggcatacgtctgcaacatcatctgtacagtatgattgcttgaccgttgttgtgatttcctgaacatcttgtcaacccaaagaagatctggctttcgttcgtggtgtgagttcggattgaacctaaatttggagatataggcaaatagatatctcaaatttatgtgccaagaagatcttcacgatgagagccacaaaatgcgagcgaacgacctggagattcactgatttactaaaagagtgtcctcaagattattcggctgcatgggaaggcatcgcaaatcaataccaaataatatcacttgcatgtagctgcatattgctgccgacaacaaaaatatttctcttgtgcggtgccccaagtcaaaaccatagatacgtatcaatcttgcatcagtttcaagtcttacacgaattgtctgcttttttattgatcgcttacttttacgctgtgagttgccataacagttttctttttgttttgttggtggacttgctctctatcatacgaacgagcaaatgtcgcctgctttatctgcgtgggagtcaattgagttccgcacatcaaccactttctgcatatgagtctattgacacaaaataacgtcttgtttcggatatgatttccagaggcacttgcatgtgctttcttggtcggggacagaactcgattctccttcatctcatgagaactccatttttttggtaaatgtgaatggttttatgtattgttggtgtgggctctgttctaataggtgctagaaccatagatacttgtcagttgtgatccctagttcgtgggtgtccgttttgatgttcaatttctgatgttcggcaattagcagccaaagaactgtctccatttgccatgctgaaaaataaacttgggcatctcaaaatctttacccgtgaaactctacagtcagaagacttcacaattccacaccgcttcacctttatgtatgctacttcagagcgcggtcgatcctgaacacacatagggcctgctaaatcttcaatcaaaaagcaaagcattaccgaattatcaccctaaagatagtgtggctatctcatctccaagattgtagacaatcatgttaatcgaacaagtaaaccctcataatgacagtaaaaaaaatatcgacaccagcaggactcgaacctgcgcgggcagagcccaaaagatttcttaaagattcaagtctttcgccttaaccgctcggccatagtgccttctctaagtctcaaaattctcgttgcctatatctttataagatcctcttacggaaaaatctgccagtgcacgaccaaataaactcacctcaaattttatcgaaaagttttatccatcataatctacaaggatgagaccaattttactgaagggacatgagcgtcctctgtctcaggtcaaattcaacagagatggagacttgctattttcggtctccaaggattcggtagcaagtatttggtactctagtaatggtgaaagattgggtactttgaatggccactcaggtgctatttctgcaatcgatatagatccgacgacgacctttgccatcacaggaagcgccgacttctctgcaaaattgtggagagtggaaaccggagaatgcatattcacttggaacacggtcactcctgtcagaggagtagagttcaacaaagatgcatcaaaggttttggtcttaactgcagaggtcatgggacaccctggtactatttccatttacccagtggatttcacaaaagaagaacagtctactgaaccattattagtgatcaagagacagccagaacttggtgttttcactgttgccggttggtcatatggagacaaatatatcattgctggacacaacgatgggtctatttctaagattgatgctgaaaccggagagttcttagagactgccaaataccatgagggtattgtgaccgacttacaattttctcctgacagaacatatttcatcacttcttcaaaagaccaatctgctgtattggtcgatgtgttggagttcaaactactaaaacaatatcaagccaaggctcctgtcaactcagctgtaatcacccctgtaaaggattacattatcctcggaggtggtcaagatgccaaagatgtcactaccactaaatctgctgatggtaagtttgagagtaaaatattccacaagattttcaaagatgaaatagggcgtattaaaggtcacttcggtcctattaacacgatcgccatccaccccaaaggtactgggtttgcctctgggggagaagatggttatgtcagattacatcatttcgaccaaccatactttgacttccaatacgacgtggagaagactgctgctgctaccaacaaggcttctttacagactgcctcttagaagcgattacataattctaaacgtgataaaacttgatacatttctattaattgagctatttcttcttggccttttcagctgcctcagctgcctttcttgcatccgctaacctcgttaatacactagaaaacatttcagatcatcctcaatcacttaccttttgcctgtttctctcgcaaaatagcagcgtcgttctccttattcttcactgggtctccgtccctcttactcttctgttgctgctgcttcttgagatttttctgtctcgcaagctctctttgatttcctctggccatttgaagtccactactgtgccacaactgggctgctggtaagcagaaaagataattttgtattgtatgaacaagttgatcagcgtagatgactccactagttccgcgatctagggatgttggatgtccaagttcatgcaccaagaacgaaaaaaaacccatagtatttacctttagacgttaacagatatacatactctattcaaaggaccaagtaacttggatcactccaagttctgggtcagccaacttttggaaagctgaaggcgaaaaatcaagatcattctcggaacaggaggcgcatgcgtcgactacttggactctcacactttttccaccgtagctagcattgatgtatcttccgcaagctgtacttacgtactcattgctgactccaagggactcatataagctttgagcaatggcgacaacatcatccgcattggtatgggaagttccacacgcatcagcactgacgttatagaatgttcctcttcctgtagtttcagaaccactagacgattcaactggagtttgctctgatgaagatgctgaggtttccacagtgacagtagttgatggctcagtgggctctaagctgcttgagttaaaccgagtagaagtagagttggtaatgaaagtagtgttcagggtgtggtagaagcttgaatcagtgcactgtttggagtcgttaccaaattttctaataggtcctcccacagcagacgagacaagagtggaaatgatagccaaagaaattgtctttaagaattgcataatgagtgtaaggagagtttcgatagtttcttatcatttccaattaactttcaactttcttttatagtggaatataatgttcatcccccatagcgaaacacatctaatcggtactaacaaccagagatcggaacgtctcagttgttagtagtaattcgttatgtcacaactagtaacgcgcagaatgattacatacggtaacggccgcccgaagccacgtgaattgtgaacgataaagcttgatttatgcgtaacctgtaacgaactaaggacggtaagttctagatttttgagatttttccaacaccgccttcctgtagtttctagatttcggtaatctcgtttcttattcaatgttatgtctagactacgtcgactcaacagaaagcttggttaccccggagatgatggaaatggtgatgatgttgaatatttcagctacgccacgttgaaagaacaggtcgaaataatcaatgaattcaagaattcgactcaggataaccactttctaggttccaaattcgttagagtttccttgatgggctttcaaagcttgatcatattggtatgtacgtttttgattacattaccagcctatcgtcataatggcaactcattgtacagtttcattgctgttacttcatcattcctgtcatttgttttgttgcaatcatacggaatcaaactgttgaatggggatcaaagccgaaggctactggatacgttagctgcgagttatgatattagcaagttcagtttagcaactttcaacctagtgtattctttagtgttggtagcattcaaatggaagcatttgaacggaacagacataatctacatctatcctttattaatgagcatcattgtggagactatagtatatgaccaaagaactatccaagaccaaattgatgaactggagaatttgaagactgattaagcgaaaaagcttgcaaagttgtaaaagtgcctattctctttaaagaaatgagttgtgaagttttcactttggatcatattgttgttcaacagtttgatcatgtttaatgacatcaaagaacgggtactagttgtcgataaagcatcgcaaagagtctcccaatatttaatagtttcaagaaatgagtctattccatagaaagagaatacaatggggactgtagtctccaattgaaacatgtttgaagtcatcaagaagttgagatgctctaccagttcttcatacaggattggccttgttgagataagctccagtgaaaagttcagctcttgcaattcatcgatacagttcttcaatatagcgctatgttgaagctgagttctgaacttttcagtcagcttctcgttaaacgacctgcaataacattgtactaccaaagtatgatctgtttccgaataataaggtaccatgtccaagttgatttgtttccagaaagaaccttttgagaacgattcggacagtttactacagattcgttgattcacttttctagtcactctgctgtggttcaatatgagatcaactgtaatctttcatgttagagggttacaaggctctttgttgattgggggttgacttacaaggaaagatgggaacatcgggaaaattacggtatcagctggcgaatttgacttggcagaaactagtttgcgagtgaatcccgccgacaggatgatatcttcgtacttgtagtgtattttgttggccatggatgggttttgtcatgtgtagaaacagttgtattgctgagaacgcgatacggaactaggttttaatgttcaacacaaagactgtaaactcagtacaaaatgtcaactatttacaatttagcttttaatgaaggtcaattgaatataatgtaatatcagcccccaacgtctgttactgctctgaaaattaagcttaaatttgagcctagccttctgttcgaaagagtgtgaaacttcgagaaatttactgtgccttttggtaactcaaatcgatgtctaatggaccagccaaatataccataataaatcgcctggtacagcctattctcccaataaagaagcaactacttgaagaaaatccaaaccattccctacgtcttttgtctctttatcgtcgacatttaagattgagaccgttcatctcccctagagcagatattaaacagttctacacagatttggtcagattgcgatttaaagaagatatagaactgcgaagaaagcattttacaactccatatacccctctggacaaagattccattatagaaagggtgattcgaaccctagagatcgtaaataatggttgtgtggactcccccaattctattgaacgtcagataatacggaacatcctggatgtggagtacgccaacaaaaacatcaaaatggttccattaatgtcggttgaatacttcaaagaagaattatggaaaggaagagaacttgacgttgtttctgaaccaaagctctatgattgggtaaacaagatagatatctctaacaaatcaaaaaaaaagaatgaacaactaaacctacttacagccctgagaaatcattatagatcggtggcttcattcaacgaagtacaaaagacactgttgtagttttagtagtatagttagatagatactttacaatacaggatgacggggtatttattattacataaggacgagtgtttaccagcccaaagagttgtaagtactcactggtccactgatcttgggaaggttgctatgagtgctatcccctctaatagtagagctggtcacttcagggctagaattgctgccaatatggctattcgtgctgccaacaactattgcaccgggagaagagtaagatacattggagatttgagttgtctctggcgactcggatgaaccgacagctgcttcatcactagctagcttggatttgttttttctgtacctgtagaagagagcgatggaacccaagtaaagggtgaaccccattacggaccccactgcaattccggctaccttacctgtgtttgatgacccctgagattccgtggagtccagcccatcaccatcggaattggaagaattgtcagagttaccagaaccatttcctgaagtctgcgaagaggtggagccgaggttgagccccgtgattggaactctgggatctataaggtttgccagtgctctctccgacggatcggggttgctgtaaagggaactagacgtatcatggatttctgattgcagatccccaatgagagatgacttgaagtacacttctgccacagtgatgatatacgagacatcaggactggtataagggaccagttgtaaaactgtaatcttgctggcatccagttcactttcataaggatagcatagaacacctggtagatattcgaatatttgtactggagacatggagttaccaacaacaaatgcataattcaaaggttctttgaagccaacagtaatcagctcatatccctcttctggctcgcctgttgggttcagggagatcgccttgggcaaggtcgacgttggttcatctctagaaccgctagcagtctgagttgaacgagcagtgcctgagggctgagtacttgtggcaattatcaagcttgttggaatccaagtctgtgtgcgagtggttgaagtggatcccacggctggataaggaacttgactaggtgcagttcccacaactgaatcagtgcccacaattggagtggtgacggtagaagaagacgcttgttgagtgggagttgctggtgacggcacttcgagggtagttgaagtttcaatcgtttcgcttgtttcttgtgaagatactgaaggtgtcaaatatggcagcggactaatagttggagtagctgtgtctgacgatgtgaaggtttctctaggtgaggaaaccacggatgttggaggaacctcaactgaagtatcttcagttgacggcagttcagaaggtgtttctgctgaagtggtcacaggagatggagcttctgaaataacagtgctttccacagactcaattgaacttgaaactgttgtttcgacgatcggtggaacaattgctggctcagagcttgttacagttgtcggttcagctggcggtattgacgactcaattggtgggatagagctgaccacgcctggagtctcaactgatgactcagtggacaaggtagggggaacttcagatggcgtgatggttgttggttcagagattgttacgactggagtctctgaggatgtaacgaccagaggggaactctgtgttacaaaagttgactctgctggcggttcatctggtgaaggggttgaataactggtttcgtcactagaaacgtcggaagtttcatttggagggacagtaactgttataactggaggctcagaggatgaggtgacaggtggcaaaaccagtgttggagcatctgatgactctactggcgattcatctggtgaaggggtcgaataactggtttcgtcactagacacgacggaacctccagttggaagatcagacggggatacgggaaatgttagatcagaggacgtgataatcgatgggcgaatgaaaccagttgactcccctgacgattctgccggtgaaggtgtagaactactggtcgcatcgccagtttcagagtcagaattggagggaggctcaaaaggccaggtaaatataggtaccgagctcgacgttgtgctagtatcctcagtttgagtcgagcttgagagagacgattcatctccatacgaagttgtataagtgggaggctcaaaggtgaaagtgaaaacaggtgccggtgaagttgttgtactagtttcactaccacctgttggtgccacttgggtcggcgtcgatgcaggtgattcatcttcagaactgctcagagtgacggcaacttctgtagtgagtagtgaatctgttgcatcggcaacctgggtcgtatcatcagaatttgtagaaactgtttccacattagcgttagtactttcttgtgaggtagtcacggctggatcatcaaacaaaaaacttgatgttaaaaatgaagggatactgatactggggacatcaatagtagagacgtcaaaactgatgggaatgtcaagcgttcctgatgttatgtttgtatacactgctcttttagcaaggtcgtcttttgcttgttgttcttcaagaacattctttggaagtgccaaagctggagataacagtgttactgtaagtataagaaaggagtttaaattaatcatggttagtgccctttagtgtccttttcaataagtgagtgaaagtgagtgaatgaatattgttgattgaaatttaaaggaacaaaaagtaggctctccaaaaattagatgatgttatcactaattgggaggtgttattttctttttctttggagatacagggctctttgggaaagaaagcaagtgatgtgtgaaggattctttgactggagaaggagaagcaacagtaaatgcttttaagctgttagatcttagttgtttagggaagaagggagtgttgtaaaaacctggaacaacagagtgaagtaattgaatcacctatggggctcaaggagaattcgtcataagtacactactatttatttatagaggcacagtgcatgaaattagcgtgaaaagggatgcgaaagggatacaaaagtttacattacgagctctgacatggttgcaatagcaaccgcgatccagacctgcggggattatattgtctgtagatctctgttgctgaggagatcgtgatctatatcagataatagcgttttatgccataacgtgtttgtacattcgccataactaacggtatgtaacctatggttttgaaacctggacctgaataaactgttcgatttcatccgaggcttttcttgcgtcttcgtccagggtttcttccagctcctttatgaacgctagatattccacattggaatggtccaattgaaaaaaattgtccctgaaaaagttgaaaatgaatcgagtcagggactcctctgtcattcccagtagatcattgataacttgattgattttttcaatgattggttgatgaagagagtccggaatttgttgtggttgactcttcttgcctagcgattgtagaaattgatctgattcctgaactgctttagcttcaaagttttcttcttctctatcttgtgcatccatcgcttcttctttaagctttactttttctctaaaattaacataattgacgtgtttcttgtaatactgtatgtttttgtctatgctgtttgtactctctttgatgtggagaacgtattcttccaagaacttttcccttctagaaggaaccagtttcgattcatatgacgaatgtttgatattattctcaaagttgtgaatattgttgatccttgcaatatcattcttgtgaacagaggactcgtagagttcgaattttttcttatggtttagctgcacattttccatgcgacgcctttcatattcttcatctgtcatttcattgaactgtttttcgttttcatcttcgtattcatcttcatcttcatcttcgtcctcgtttctgctattacccaaattcccggacacattattcagttgcaacattcggcgcaatctcatacgagcctttctcttatcatttagcatctgtgtttctcgtttacttttctctaacttcaatacattcaacctaaattccacaatttcctttttcactgtgtctactagttcattcggaacatcaaccagttccttagggtcgattcgatacctattgtagtactttgacaaattatctagcttctctacaacatcaccgtgacttttataggaatgaagtttcctggatgatagtttagaaataagctcgatgtactcttttactttttcggcatcttcatctcgttcaaaggtttcaacttgttctaagaccttcttacagccctctgaaatatgcatcttcaaattcatcttttcgaatatctggattaccattcgtagcagctcaaaacttcgaaactgtataaatactactttgaactcgacaacatcattatccacaaaactccaaaagtacttgctgtttccatcatttggcaaaaaatcaaccagataatcgtctataacactttccaaaaatccagccaccaggccagcagatctcgtgaccccagtaggaagattattcactcctatggtgagcaactgcaactcctttcgtcctaaaagcttttcttgaaacaatgacaaagaaatgaaatgatcttccaaagacttttccgtttgcgtttcttcaatcatatcttgatctccatcaactgacacttgatcattatcctcttcctgagaaccatcactattcgccgttatatcaagtatagaacctttttttcctttgatgaaagagctgagttcctgaaacccttcaaactttagcccttggagctcttttacagagctgaataaaggcagacttccattgctcaaatctaaatttccgccattttccttgccctttacagagcgcttggtgtgaacaacatcaccattgagatatggatgatgatacgtcaagggcatttaaggctataaagaatagaccgtagtctctccatgtgcgcgcccccatgtccttgataaaaactacactattcaaagcgatgagagccgattacctaatcaacactaactatctattggaaaaagttgaaccagtctgatctggcaaagttgccagagtgaaagtcgaatccctccatgttaggtccatagacggtctcaggattaaggatattaccgttggctaagttgaacacggagggatcaagtagggttgctgataagggctcagatggatgggcatcttcaacactgcttccacttcctgtgttcgtagctgacgaaacgtgttgtgcgtcattgtcagtagtttcagcattggcaggaacatcaaacatcggcatccagttgtcattgatgatcttttcaatgacgaactcattaccactgctcacactgtcctcagttttaggagattcattgctatgcgacttggtaatttggaacttatgattgttcttactcttattcaatctgttcaaattctcacggtcaagtggtggatgtgagtcaccattatcgtaggatgggaataatttattcggtttgaataaatctaggttgtgctgtaaattgttaaaatcttgagaagtttgtgctggaaacgaatctggatttgtattaccatccatcggaatgagattgtcttcattagtgaaaccaggaaatgactgtgtcattatattaattaaattggggttttgagatagaccgttattaaaaatggccgctggtgggcgtttctcgttcaatggcatactcagatcatttcctgagttctcctttggttttggatcttcggataaaagcgcatccccgtattcagcggtctgtacgttttggcttttactgtgtactttgttcttttttccgacgtcaacagacacacaaattacgttctggacaaactctaaacgttttgcttcatccttcagtaaaatgtccagtatttttgaacacaaaagggcaattttccacactttggacagttcgtttagacaactgcaaagagtatctatggattgttttgcaatagcagcagcctttcggtttttattatacaagtgatatatcatcataaccgtagcaatatagaatgagaacactaaggagttcgacacatactgtaattgtccactagtttgtaggtatttgccaatctgtgaaatcatgtgtgcagcttgaaaagtcacaccccaagaagggtaataatcgtctttgtttggaaggggatgtttgaccctcttgaggatgttccgtctgtgaatcaaacacaatacggcgtagtaattgcagttaataatggccctgggaagtgactgttgagctggatctgatgcatgatagcataatgtggatggtaagttatgaagccagtttcccatgatcatatcacagtgcttgacaatgttgatgtgatacacagactctaaattttcagccttcacagtgtactgttgtttcagcacaattcccatgatttctgccaatttgaggctatgcatcacaaaatcgacatgctctgctgcaagtgttaatggtgatatggctttattgtcctcgtcgatttcaataaaatctcgagtagatagaaggggaacatcacaatcatccaagtcgatagtcaatggtcttccaaaagctaccgaaataccacgatccctaatgaaaagacaccaaaatatacgtcgaattagcttcagatcctcagctgacgtttttgatgagggctgtaaacatctgtggaaaccatatgattgagctaaagtgatggccaatctgctccaatagaaaatattcttaacaacactttcagcactttcccaaaaatgtcccaacaaagagattgattggaccaaagaaatcgggtctgtttccaagttactgtcatatatagccttcgcacgatagtagaagataaagctacaagtgtccacagagccagtctctgggtccataagctgcggatgtttgcagacacgagagcctgctaaaagaacacattgtaaaagaaggatactcggtgggttccgcaaatttggaagatagtgcttttcaaagtgtgtcctgtttattatgggagaccatggatgaacgtgctgaaagtagcacgaaataagaatcttgcatagttcttctgttggtatcaaaaaagcaccctttatttttagagcttccatctccatctcgtgaaacgctttcacttcaggagaacgataatactctgaaccgctcaattctttggtggagactgtagccatcacttgattcaaacatgaggtgcttccagaaaaatcccaggtctgattcttataggaagatcctacgctcttgtctgcaccagtcccaggggtcactgtagcagctattgtttcagtggcagatacagctagattgatccgccccttaccgggcagttcgggcttaattttagtagtagacgatgaggaagcaggggaagatgaattcagactgaggtcaccatttttctcttcatgtatcttgcgagctcgtctcttacgaacctctgggatcacacactcattgccaaacgttttgcaattagtacatggaaaaatatccactgcatcgcaacgaactttccgagcgtgacagacttcacatgctctcgccgatcttgatctcttgtacctgattttacttttatccatcactgatgattgagttcaagaatccggtccgatcaaattgtcgattggttttcagctgtattgccgaattaatctcagagttttggccggttgaaaataagactgtcaaaatataactagcagactttggcttaaggtctcatgttccagttggtcgcgccttcgctctattttttagtttaggcggagagatggggaaaggaaaacaatcgctagagggggaatcctgttgctccgcgccatgcatgtgatttaaagttttttcacattagcgcgattgtttagtctgtcaccttatctgaaggctctacctatcaagcgattgggttgaagaatcaatgcctcgtttagatcacagcttgactattgctgtattggcggcctcagtatgtttagcggcttttgggttgcgtcggaggaaggtctcaggtgtggttgccgatggtattgatcaatgcatcggcaatacccccctggtgaaggtccattctctatctagggcgacaggttgtgaaatatatgccaaattggagctagccaatccaggtggctctgcaaaggatagagttgctttggctatcattaggaagaacgaaaaaatggcgtcatcaaacctggacgaggagacacaattttcgaaggaacctctggctctactggtatatcattcgccatgttatgtgatagcctgggttataaagcccatatttgcttaccaagcgacacttcagaggaaaagttgcaactcttggaatcttttggtgctatcattgaaaaggttaagcctgcatccattgtggatccgaaccaatatgtaaatgcggcacgtcgtggtgctgaagtgatgagtcaagacccttcttccacatcagttggtgtatttgcggatcagtttgaaaacgatagtaactggagaattcattatactacaacaggtccagagatctggaatcaattacagggaaaattagactattttgtcacaggctctggaaccggtggaaccatcgccggttgtgctagatttttcaaagaacagaagaggaaagtacaagtttttttagctgacccacaaggctcaggcctttacaatagaattaaacatggcgtcatgtttgacaccgttgaaaaagagggtaccagaagacgccatcaagtcgatacagtgatagaggggattggcctcaatagagtgactcacaattttcatatgggggaatctttcatagacgattcagtaagagtcttggatgaagaggcaatgaaaatggcttcatatctttgcagaaacgacggattatttttgggatcaagcagttgcataaatgccgtcggtgtactgaaacttatcaaagagggagtgataccagagagctcaactgtttgctttatagcgtgcgactcaggcaacagacatctatccaagttttggctcgaagccaggctctacaaggacattgaattagatgatatcatcacaagcgcagtacataagttgtaattacatcatcacaggaaccagtacaaaatttacactatagatcatcaaaagaaccctgcaccgcagtggatgttgttttccgacgtttctgctccctaatcgcatccttccaatcaacttcattctcttcatcgtcagaattgtagtttgcaattcgttctcgttctttagccaattgccgctgttcagtgatagatctccgttcctgttttatttctttctgcttagtttgaagactccaagaggcattctttgccttctgctctcttctcttagcagcccttaacttactttctttgagcttcttatgcgttctcagctcttctaaacgtttctcttctttatcaggatgagaatacttataactatccatatcaactttgattatccacccctcttcatcaacattttcctcctcatatttctccttcgttatgaactttgtttcaggcatcttggggactcgaaatagtccatacatcctgcaaagtttgatgtaatcaagcccttgtaacctgaatattgaacttgctgtgtgttttgaataggactttacgaaggccaccattgctcgtactgctagatcgtatctagctctatcatcgagcaaccaactgtgcatggcttgagatatttcatctagctctagatcgccattgaatttaagctcactaatatggacatttcttaccttcataaaatcgatatagtccaattctcttccctcgttaagcataactatggctttaccaaccttgtttgcccttccagtacgaccagaacgatgaagaaacatgtcaggatccgttggaggatctaactggatcaccaaatctacttcaggaatgtcaaggcctctagctgcaacgtctgtagtcagtaatacagatttggaggcaaaactgtcagcgaacccatttaaggccttcaatctagctgcagtttctaacttaccatgaatggaaaacaaattcaaatcttcggacgagattggtaagtctaaattatttatcaaagcttgcagtagtaagtaaaaatattgaactccaacacaagttggtagataaacaattgcctttttgtagtgatatttgaatagcaactccaatagagtttttatttttttgtctgttgttagagaaatgtaggaaatacccaatgagtctggaacagcattctttgaaccatcactgttattattcttcacaacaattcttacaggattggccaatcctgtcttgaaaatatcggagccagcactgctgattgtagcagaaaataaccctgttcttctttgtcttggaagcttttcgataatagttaggacgtcgtgtgaaaaacccaagtccagtagcctgtcggcttcatccaagactaacacttgcaaagattttggtttaacattggacgagcctaggaactccaacatcctgcccacagttccaattaatatctgtggcctattctgtaaaaagctatagacatcttctctcacagaaccaacggcaccgaccaatagttgagttgtgatcttattgtcgtccggctgaaatttcaagagttggtcaaaatttcgctgaacttgactggccagctctcttgttggtagtaagatcatagccagcacatcacctctaagtaaaggaaggtcctgagcataatattgggcaattttttccaaaactggaatgatataagccatcgtttttcctgaccccgtaactgcttctactacaacatctttgtgtttgcaaaaaagagggatagtcgaagcttggacaggtgtcatgctatcataacccaaggatgaaatgccttccagtatccaaggttggagtttgtaggacaagctatcccaatctagagacgaagttgtcatttcttagatggtgaaagaggaacagaaaagaaaaaattatagcgataactgatgcgaagctacaacaaaaagtcctgttgtgcgtgcagtagatgttttcataccagatcacaatactggcgctttttatcgcctagagtattccacacctcccagttcaagtagttgcatagaagtaagactagcgtactgcttgcgatatcgaggtagaatatctccatggatggtacaaatttcacagcaggaaaattgagaagtgccagatgtaccagaaggcaggcggaagatgtgacaaaataggccatatccaggctaatgttgaacagacagcctgtgttgagtgacctcaagaataatgagtctatccagatgtccgaaaaagaatcctcgtgatcgagtgcttcacacagaaggtagctatcgtagacactaggcgattgccacagctgaatgatcgatcccagcgaaatgtcagctgtgctgttacgatccgaaatgtattccaagttcaaaagagcactggagtcgatattgtactcctccatcagctgttcagtgaaggttatgtattcctcgaggaagatgctactaaaatagttgaagttgtggtaaatcttttcctgatacttgatggatgccgagaagatgatacaggttatagtgagagacataaagcatctaaaaagggccagaaaggctgtcatttggtagaatgacaagtacatgatgcaatgggttagaagagcaagaaggaagcccaacagggtcatcaaagagtggtatttcttggctggttgaaccattttacgatggtagatttgttgccatttggatccaaacttggaagtatcccattcttttaaggtatactctttcatgtagggattgaatgaggatggcttatagagatcaggtttcatattgtttaaggaaggcagtagtggggaagaaaagaagggtttaggaatcagctatttatctcctggttacaaacgcgaattgaataaattttcagtcaatgaggcctttcccgtctctgttaaagaatcaccatttaaggcttctcatgtcggacacagactacagaaaatggtccaagccgcagttgatcagtagaatactacaactggaaggaaaaagcggagaattagctttgatggagtctaaaccgagaaagaacgaagtagacttctctaccgctactatacgacagatagcactgaagttttcctacttgggatggaactaccagggattggcagttcagagagaagctactgatttaccaaccattgagtttaagattttggaggctttgagacaatgtagaatgataccatctctgaaccctatagattgtgcgtttagcagatgtggtagaacagataagggggttagtgccatgaaccaggtaatcgggctgaacgtaaggtcaagattgaccccagaggagctagagtctccagagaatgatatcaaagaactggattatatcaatattctcaatcaacttcttcccagtgatattcgtattcatggtgtatgtctacgtcctcccaaaggatttgacgcaagattcagttgcaggggaaggcattacaagtacgtttttcaagatgaaggtttagaccttgaaagcatgaagaaagcagcaccgatgtttgaaggtgtgcacgatttccggaatttctgcaaggttgatggtgctaaacagatgacaaattatactagagccgtgagatcctctcaaatactacccctagaaggtcaccctggatattacgtgtttgacttgaaaggaacggcgtttttatggcatcaagttagatgtatggtagcaattttgttaatgattggtcaaggattcgagtctccagacatagtatcaaagctattagatatacaaagtcatccgcaaaagcctgtttatgttatggcccatgatattcctctggttttgtacgattgtatatatgatgacgatgtcaactttcaaccagctaccaacgccaacaaaatattaaaatcgcaccaagaatttcggggtgtttactacgactaccacctcaaatacatcatttccaacttcatgcggaacatagtaatgcctggtccaatacaaattactgctgggaagcaactgcataatacaggagatggaaagggaaagtttgctaacaaacatgtcaaactacttaatagacccaccgtcgaagaacctgaagtcttgaacgaaaagtggcgaaagaagaggaaattaattgctgaacaggagagcaaagaagagttacaggaaaccaacgggatctcaaatggtgacgtaccgtctatataggttccaaggtatagtgatgagatgagcgctcgaatagacttagaatagaaacttaatattgcagctttcattcactctttccacaattgtaccttacaaatctacacttagtcaactaacactcaatggatcaactactggccaaggtgggtaatttttcttctgttgcttgaacatgtgcctttactaacattgtaggccggaaatcaagttgtcacatttgccatccgttctggtatcactattgcttcaggttatgccataaaaactatcgggaaatatgttgacaagatcccagctaaggatcgtaagtctgttgagtttctgaagagaaaactgcaattaagaattgaaattgtcactggcgccatcgatctaatcaaattggtcgcagctagagggaactcgaacttacaaagcacacttgaactgacctcagatctaaccaacgatatttatgagttcgatgactttctggcagaactaactgataaacttgaaaagggaaaaagttcggaatctttgaaagaagttcaagactacatgaagtttttactcaccaaaattgaagaagcaatacctctgattaatttagccctaacaacctcaggagctaatcttaccggcggacttccttcaactgtgtcaccaggcaggctattgcaggcttccaattatgtgacacttgcagattcgaagtttacggatagcgaacaacaagttggtccctctttcgatctgactttattccaaatattctctggatcttcgaatgtctcttggaaagaggagatggctcgttgtattgtcaaagttgtgagagttccttccaaaagtcaggagtattcatacaagttgataattactgagagttttgacgatgaccgataccatgaatcttcagaacccaatgtaaaggagcttgatgtggctcacgttattagacttttctttagtgcgtcctctaagctgctcagattggaagaccgcaattgtccagttcttattctcaaaactaaaaagggatcggagaaagaggaagcaatagaatggacagcattcagcgagtattccaaagcgcccggttctgattctgaagatgaggaagaggatttttcagaagaagataatgatagggttaccagaaaagtaaacgcagctagaaacctattgtatgctaataatactccagcagttggaaaggaaccccccaaattgtccgaaagcattgagaatgcaaacacatccctcagtctgttggagtacattcttcgtttgtgcgccttacagggtaatgatcaacaatccatactaaaggtaacagatgagagacttgcaatctaccttgcagatgaaagttcggaatctcaagaaaaaagatccaaacgggagggcagtggtagtaaggactggaggaaatcaattactcccccaccagcagaaattacctcaaaattagataatttgactttaaatgaaacagggttggaaaagtaagagcccatgtcgcttggggttactttttcgagttatgatcatcaacaggttatacgcatctgctatggaacagataagtttttaacgggaaacggttgccatgcttccaaaacaagacaaatgagcagctaccatcaaagagagcacagagttaaagcataaaaatcgattggcttcaataggatgtcaacggggaacatccatcttatcaagattgagttctgaaaaaggactctattagcgaataattgatttcaaatgtggattgcgatttaacgtaccacttgtgttcatggaggtgttttctccatcagttacacaattacagagctgggaaatggggcgcaccgcaaattgagtagatatccccaaaagccgatgaattttgtattttttacaaacccaccaacaacactctaaaggatgtattatttctcaagtttagtatagctcaatttagcgttccgtatgaaaaggcgagacgagctgagtctctaggaaggaatataagccacaatctagggcttacactataaaaatctgaagaatgctaatcatcagaaacgtgtggtgatctacttttacgcgatgcagttttgtgatgtactgtcctgctaaaacgtcaaggaattcgatgtacgtaaatcgggccgtattgagggatgggatggataagcgagtattgacattagtattttggcatgcgttggcgttattgatagataattccgatgggtggtcacctaatctgccgccggtgcaagttgggtaagattttgcgaaatgatagtgcaaggttgctggtgggatagtgagaagcgagggcaatcgttagcgatacctttgctaagtcttggaaagataccataagcgagcgctattaatacttggtgcaaatgtaagcgattgctctcgcccatttaacccatttactgataaggatctatcaatattcgcttcggttttcctcatgggcttatctctaggagggataaaaaggtcacaaggatcccatttttttattactcagtaatacagtcataaatgttatacagaagagctttacttggatctcgagtattggcaagaacaatcaagacctccactagtgctgccactactggggctaccaactttgagttgccccaacggttggaacagcatggcatggcaatcgatatgccacataaggatgcttcgcaagcctcaaaatacgaccacttaaaaggtttgagtgcatcagaacttatcaattacggtgtaattggtatggccaccattaacaagccaattcttgatttggtgatcaagattttcccatacgtacccatggtctttgtcaagatgttcgtgtacaacttgtactgtggaggacaaacagtggaggatgtgcgcaaaacaggccaaagattgaagagcagaggaattcagaacatgatggcttcgttgaccatcgagggatgtaatggaaacgacaacattgatatcccattcattctcaaagagactaataaatccgttgacaagatgattgtcccacacactttagagatgatcaaacaagcagaaaacataaacgacgtcgctcctggatacgtcgctcttaagccaactggtatggccgaagatgcggccaatgtgctgaagaactataacaagccagaatacagggagaggtttgagaaactggtagacaactgccgtaatgtgacttccaacatttacaaaactaacatagacttacttaagaaatacccagatcgagttgctccttttgttgtggcagtcattgatgctgagaagcatcagctacaacagggtgtctacgaattgcaaagaagattattcaaggaattcaaccctaagggaaaacccgttagtgttgctggaacaattcaaatgtacctaaaagagggattaccattgattgagcttgaaaagaaactcgcatcagagggaaactacagagttggactgaagttagtaagaggagcttacattcattctgaacctgatcgaaatgttatacacgacaccaagcagaacactgattatgcatatgattctggagttgcaagatgcatccaggaaattgtgaacagcaacagtctcaacggctctgacatcggtcacttagttgtcgcttcacacagtagagagtcacaaatgcaagctaccactttgctagatgctttaacacatgaagacatgagcaaatatttgcagagatccaatgttgttttgggtcaattattaggaatggcagacgatgttacacacactttaattaccaagtatggagtcaagaaccttattaaatacgttccttggggtccatctaaggagaccaaagattacttgcttagaagattggaggagaacggtgatgctgtcagagccgacaatggatggccattggtaatgggagtcgtaaagacattgttccaaagaataattcgcatttagagagagtagattatattataaattaattaacatgaaataatgatcactgctgtgttacttgataaacttgtccatgaatttctggtgatagtctgtctttagggtatcgttagtgtaagacgatttcttatctgtggtggtcttctttgagttggtattcctgaatgttgaatttctccatgatcgcttttgaggaatggtcctcatttctgtttcaatttcttccatttttttctcctttctttcttgtttgattttctcaagttctcttaacaaagtttcttcatcttctgactcggactcatactcagaagaagattctgagttgttaacttcggtttgtgaggaaccgagatttgattgattcacttgctcttgggagtagaaatgcccgtcatcgttgtccccgctgtttttgtgctctttataaggtccatcttcgaccaatgtaaatttagaataggacagcattccatcttcgttctcatcgtcattctcattgtcgttcttctttgcctcagcgttcttgccttctagatcctcagttcttgtagctcgacggtacttcatttttgtatgagacggcaaactccgtgcatgagtgaccgccgatcgcatctgttcagcctttcccttgacggggtcaaaagttggtctgtgggctgaagtcatggttgcgtaaaggaaaaacacccttgatcaatttgattaaaagtcttatcaaatttactcggcacggtgagcttcgcgagatatttccattacttggaaggtgaacggcccctacctgattattctctcatcactatagaatccaaaaagtaaagaaacaatacatagtatccagtcttggaaagcttcgtgaaaagtagaaggcatgtttgaatacacctctgtaatagattttggctatgatgacgatgatccaaactattttggttgctacgataaaaagttatttaaagcacacgagttggatacagacgtagaacgagattattcggaggaacctacagacaattatgagccacagccatctgaaataaaagctatagcgttgtatgctttcactccagaaaacgataacgagctggctctacaggaagatcagttggtaataatcagctacgaatatggtcaaggatggctcgtagcacaagatccacgcacaggtgaaactggacttgttccagaagagtatgtgcacttcgttgacgatgaacaacagatagctacaaattacggcgaagaatcccaagatgatgtcgaggaaaacatactggtctccccaatagagaccaaggctgggacgaaacaagatgaatgggtggatgttgcttctgatgactgacaagaaagggaagggaaactcaacgagaaaaagagcataacaagaaattaacccacagcaaccttgtacatttattaaacttaatttttcacacaaatctatatatcttgctctatttcgttctcccaattggtctcatcgattcctgtcgtgtctttttcttttagtaagaaccctccaacttggtttagtagctggttgattttttccaccaattcttcgtctgtttcttcggcaatagagtcaacttgcaatagcttgaatgcgctactcagggcaactcgagcatcttgaactgtctgctgtgtccttggatctttcaggtcgagctccagatcttcattctcaataagctgaccaatgtcttcgatgttgagctgctgctttttagccaacaacgagtgagcaaacccctccaaatagaaactgtccacgttttgctcatttatgtcttgaatacttgaggcaatagatatggcgagttccaatagacctaactctatgctgtatctggtcaaagtaatcaatggctgaataagttcaatgtactctacagttgcttcgttcacagccttgtcatcggtgtcgggatcgctggatatgctttccaattgggactttttctgattgaataactcccaagctttgttaactgcctgacgtgcatcgtcagggcgttgttgactaatacggatatttgccaaagtggaccagacttcagggttacggtcttcaggacgagattgcgcaatttcatcatcaaatcgaattgctttggttatcaattcttcacacttggattctgcttctggctccatgcacagatcggtcatccatatttctatcagtacaaacaaggcttgatctagttttgtaaccaaatactttgcaactttgtacttatcaccatggagtttcaatagttcttcaatttttgagtctgtattggcgtcattagacaacgtttctagttggttcgttagcctgttaataccaatgtttaacaattcttcaccatctttacctccaatcatttgccctaaatacaaaaacttttcaacattttcctcagcatttggatctaactgacaagctttctttagcaaatcgtacgcttggtctaaatcagaaatctctaggtaagtttcacccaaaactgacaggaacttggaattctgctcatttccctgggcatgagattcaagaaactccaaagcctcgtcaggtcgttgggtttcaatgaaatttcgggccttgacaataatttcatctagagtggccatggtagggaagatccaatggaagagagagcttttataaaagtgtctcttcgcaggaggaataaaaaaaaaatttactaagtcacctgtgcagttatcttgttcgtgtgcgtctaggcggacagttagaaggagaacatacccttggtcgcgcccaattagattccctccgactatctctgtctttgtttgcctatatagtcaaatcttcatttgccatggattacaaagaagagcagacccaagagatagaaatcctggaatctatatatccagatgaactagaacggatttctgatacagaattcacgattagtctccttttagaaactgcaagtgaaagaaagcatcgtttaagtttgcatgttacataccctgaaacgtatccagaagtaacacctgatctgaaggtttctgtcgatgattcttttgacgccgaagaaggtggtgagtcagacgacgaggaatcttctagtgaggaacaagttgttcgtctagaaaacgagatttttttcacttctgacgacctcaagaaactcgagtttagactaattgatgaggcttacgacaatatcggaataccttccattttcagtctaacctccacgttaaaggatgcagcagagacattatttcaagaaaagttgaataaagcgacaaaagagcacgaagaagagttattgaaaatagaacgtgaagaacagaagaaattcagaggtaccccagttactgtagaaagtttcaacgcctggaggttacgattcagaaaagagttaggtttggacgagaaacaaaagaaaagattggaaaaattgcacaacggtaaactgactggcaaggaaatttttgaacgaggtttggcaggtggtgacgatgtggacgaagtaacagagagcgtcgctcagttaacgacagaggattcatgaagaagaatgttatttctgtatactatttctttgtcggtcttttaagaaggctttcaaacacatccttcttgggctgctgtttatccgcctggctcttctcttgaacctgtggctgaataacggtaatattcgattgcaaggaggtcgttggattttggtcactgggaaacaaatctatcaaatcctgaaagttattttctacaggtttggtattaacaaatgtggctgtggctggagttataggagtttcctgttgattcattattggcgttactggaggttgttggtattctccgaattcatcaccatcggtagctgagtcgtttgattcatcgcctagtatctctgtatcataattataagatgagtttcctctcgatgagctattgacaattttctgattggccttatgtagcagttggcgatgcctggcgagtagtcttttatctttgatcaattgaactacccttccagccttttctcgtacaatctctgtgtgtttatcggggtgtccatccttagaggatacgcattgataaacattgtgtaactctttcaggtaatcaacatgcttagcaacatgtggcaaaatatctagtggcggttgataacaattgatgaccaagtactccaacaaactcaaacatttagatacaatccgatgttcgtttccattggtgatgtaattcttcttgagtttccctacaaatccctcccttgaaaagcgattcgaatattccactattctagtaatgacaaaagatattgcatctgatgcgggattaccatactccacgccataatcctcatcgtagtagctaccgtacctctcatctgaggcagtcaattgcgccgtgttcaatatttccaatagatgatttcggatctcttcacattgctttgatgtaggtccccatggatccgtggttgtcgcatttctaatcaggttctccaattcggtatagtttgataaggctattcaaagatgttagtaattttccttggatgaagacggactaaaaaaggaaagcttacagttctgaatctttctagaagcctttctgatatcgtacaaagataaattggatagcttgctactaatagtactcattggatgttctttgatagataaccgaatgttccgtggagaagaagagaataaatggtgcagctaatgcaaagcgcgaaagttaaaataacctttccaagacatgacgcgtaggcaacaagaaatacaggcaagaactataacttaataaagccaaaaataaattggaagaaaaaaaacaatcggtcaataaaattctcattacatgagacagtagatcgatttaacatttttaactgtaatcaattgaattacaactcaccggagttggtgatcttcaactgggtcttggtagcaccagaagatgatcccaaggtctcgatcttggagacaacgtccagcccgtcgacgacctcaccaaatacaacgtgcttaccatctaaccaaggacatggaacagtggtaatgaaaaattgggaaccattggtgtttggaccggcgttagccattgacagcaaacctggcttggtgtgcttgtggatgaagttctcgtcagcgaacttctcaccatagattgatttgccaccagttccgttgaacttggtgaaatcaccaccttgcaacatgaattgagggatgactctgtgaaaaatggagtctttgtacccgtaacccttctctccagtacacagagctctgaagttctcaatggtctttggaacatcatcgtataactcgaagacaatacggcccaatggttggtctatcatggtgttagggttgctgctgcgcaatgcggttaattccatttcaatacataccgttggaagaaacgtcgaagaatgttttggtcattttagaagattctgtagtagttaactggtaaagaaacgaacagggaaaaaaatgttctttccctcactataaatattatttcacttggtgaagatggtcgaaactcatcgagggttctttgagcggtacactctgcatctaggtggaggagcattttttttccggaatgtaaaagttggggttttgtgcaaatgggctaaaatgaagacgagaggaactgtgttttacaacggtgaatatttgatctaagttttgtccagttttaagcactgttggctcatcattgccaaattgaacaatcagccttgcctcttttcacgaatagatgactacgaaattgaaatggtctaggcatcaatactttatgacgtaactatacatcaggaggacacatatccgccctcgtaagtgcggtcgatactacctcggaaatctccatttggtgtttctttgccattcaggtttattcagtctagattacagtattgatagatctagtcttaactgggcccctgttcttatattcactctatgtacaacttagtatacgaacaagatccagaacgtccttggaaaacttggcaaatgactctgtagttgcaggggcttcagccatatttaccagattgacttctgttcttttcccacccagtagtcctccttccactgctgaatattgaagaaggtgttgtctgtaattcagttctaattgtctcctctgttcgatttctgtgaaggtataattcactgtctccccatgtatctcaatatttacattgcttaagagattgagtctagatccaagtgcgatggtcgaattttgtaaaaactctctgattcctggctggtctttgagccagattgaaaagtcttgactggtttcatttggtctgactatgggtgtagtttcgttgctactgaatctcacatcacagacttctgaaggtaatggaatggagacatttttttcttggttgactcgaacaacctgtagcccttcgatctgaactgtttttttttcatgatggttttggattggaaaccagaattccactggtggtttcttcaacgagtctttgtctacggattcgatgatctgggtgctatcacctttctcaaaaagagagggtaaaaatttgatgcgaagataatggtcatagctatcttgcgtctctgagaaactagggtcatgttgagagaagagtggtaaggaatttaccaactgtttgattgaaggaacatgcccttgaaaataatgatcatcaccaacgttttggttagggaataatactttgcctaatgaagcaacgtactccacatcatttttggtcccattgatgccagaaagagctgaaaacactctagctggatcaatggtcaaatccgaaacggtgctatcaattttatttgagagaccattctcctggaactctgtcaaaatttgatccgtttcattattcaattcagtattggtatccttgtatgctatttcttccagctcgtcaaacgagagatctgggttattttcatgaggaatttgctcctgttcttgcaagccttcaatttttgtaatttcctgttcaacttgatcgatttgctccagaatgcccttcagattttctaccagatcctctccgacgggctcaaattgaactttcgaatcttgcgaaactcgtttgtgcggtgttctcaatcgatacagaccatgggcatgataattccatggcaatgtggtcgattcgttgtaagggaagaagatggtactcgacttatcagtaagctgaataacactctctgttgtatttggtctataattcaaagcagccactaataatcttttagcaagttctatcttattagaccctagagagcacattgaaaatagttcatcagaatcatctatttttttaaaatgaacgttgctgacagtcattaactggtttaaagggaaatcgctgaggtgtacatcattcattatctctttaattatgctcatattgattaattgtgtttctttcttctcaagaatctttgctaacattacttcgataaaatcaacagtggcttttgtagctctgacagtcaactgggagtcctcagtggaaacagcaatggtagcgccagttttggcccaatgttgaagaataataccgtcagaagacaggagtaaaaataaatctcgagtccctgacaactgaataactttttcagttataacatccctcaatggatcaatactggatgtcttctgtaagttccagtgtttactcaaaattatatcagttatgagttttttctttgaaatcttatgcggtatttgatcattatagtatgtctggcagtacaatcttaactggttcaaggtataagaacttgccaagtcttgagctatctgctcaaatctatttacactgacattgacatcgcttggtttcatcgtgtgaattgagtcgataagaactttctctgtaactttggtctgaaaaactaataactgtttcttttgtgactcaaaatctagcaggttcataattggctcaatttcgggttgtaactgtttttcaaaaatacgtctatttcttgataaagaatcctcagccttcaaaatgatgatcttgtgggctttaggaggtttcttgacgtttccgttagctactgcctgcatttctgaagactcttggggcacatgatgcactttttcttgggattctgtcaattcctcgatggagttccctattatactttgaaacttttgttcctcattgttggagagcctcgacgtgtgaagcaattgatacccaagctttgtatttacaagttttttataactgaccaggcgccacctcttcgtcccaaacgtcttggaagatctccaaacttgtagcatcttacaaggatcctggagagtaggagaaggacattataaaaactttcaagatatttatttaacaaccgaacaccatcattactgttgtcgctcctcagcttgcaggagcacaatgctacctggggtagtaaaccattagaccccctcaacaatcgtgaacataaagcaaagcttccagatgacctgccaaagtgtagaagagctggatgctattgttgaatcaaagcttagggaggttgataataaagtttcgaacggaaatgttgacttcatcaaacaatatctgattcaggcgatgaactattatgacaagtatagatctgaaatcaaaaaaattggacccacagaaaagaaccctaaatactattgttttcaagaggcagcgtatgttaactacaaagcttcccaagctttactaagagagagaatacccaagctgcctggctttggaggatataaatctgcgtattcaaaaatctatcgtgaactgatagaaatggtagaggggcaagaacatgagattgcccagataaaaagcggcttaaggaaaaacttttgtgatgatacattagttcttcgactgagaagtttaaaatcaccatctgctactcagcccaaaagtttaccggattctacacccacttcacaatttaaaccaaaaccttcaaagccttttagtatcacaatcaatgaggaatacatttcggttgaccaattgtcacgccttcttaaaacgaacccgaatgacatactcctcattgatctacggtctcgtcaagagtacgacgtgtatcacattgaagatggctccggggtggacatgtcaatatgtatagaaccaatgagtatcagaaacggatacacagcagaggatctttatcaactttcaatggccgtcaatccagattatgaaaggagattgttcaagaatcggtctcagtatgaactgttggtatgttatggtaattatgacaacgaggctactgttcaaatgttcatgactatcatgaataaagatacttccctcaagaggcggagcgtctatttgaaatccggaattaagggctggaatcaggatctgagttttcaagattcgaaaccgaatgggtacttaactagtacgactgactacttcagtaacactccgaaacacacaattacgcccaaatcatcaaaatcaagttcaaaacctactttaaaaactactgtcaactctgggcctgcccacactgttgggatcaataatctaggaaatacatgttacatgaattgcatacttcaatgcctattagaaagtgataagtttgtttcattttttttacaaggcgattataagaaacatatcaatattaatagccgattaggctcgagaggtatattggctacaggatttcatttgttagtgctattaatatccagatcatctggtaaaacagtgactccttcttcatttgccaaagatgtttcaacagtgaataagaattttaagttaggagagcaacaggattgttttgaatttttagattttctcctggatagtttacatgaagacctgaatgaatgtgggaatgaaccaccaatcgcagaactcacacctgaagaggaaaagcttagggaagctttacctatcaggattgcttcgaccattgaatgggaaaggtatttaaaaaacaattttagcatagtagaagatgtgtttcaagggcagtacttctccagattggaatgtacagtctgtaaaagcacttcaactacttataactcattcagttcactgtccttgccaatcccattagatcgacaaaatgtcacactagatgactgtttccaggctttttgttctgtagaagaattgaacggagatgacagatggcattgtccaagctgtaaaaaaaagcaggtcgcttttaagaaacttggtatctctagactaccaagtgttctgatcgttcactttaaaaggtttcaggtcaagtgggaaacaggtcatataatcaagatagacaagtttatcagttatccgttcaagctatcaatggacaaatattggcccaaagctcaatcagaagaagaactaagaaacttggagaagctaccatcgagaaatcagaatccccctttcaattatcgattgacaggggtggctaatcattttgggaccagaacatcatctggtcactacacatcatatgttcaaaaaggtggccaatggtattactttgacgatagtgctgtgactagcaatgttgatcgtcataaaatcgtaaatgggaacgcctatgttttattttatcgacgtagttagatattgcaaaataaataaccaatataatcactcccagtcgtcatcatcatcttcttcaacgtttttagctccagattttgtttcagttttagcagtttcgttagttgtgggcttacgtgtatcaggaagcgtttcaatatccgttccagcatcctgcacagtttttgtcgttgccttcccgatatctttcttctccggatcagcctctgtctcatcttccttcagcacttcgccttcctccgtcagttcaacattgggcttttgaacaatggcaaactcactttcttcatctgagtcatcccaattaaagtcttcaacttcctcttttttcggttgtgatggtgaactctttttttcgtctttaccattctgcttgcctatcttttgtctcatataaaaatacttcgcccaaaaagcctcctccgacattttcccaggaaccaattctttgattaattcaacgagaggttgatcgccgtcttgtagatacagcttctttgtgttttgaacattcaaaccatcgtacttgaaagatttttcaaactctagaaactgtttatctgttgaagaatcaataagatacaaatctctagaagtgttgagagtttttagttgggcctctgatttactgtttgaatcgacaggttcacttttagtttctggttcgctttggtcccaaaatgagccgattttcttcaggtaactggttgtggtattttgtatagtcagtaagtcctcgtccagttcatttatataaagctctgtctttttccccaaagtctcaaacagattagaggtcgactcattggatggcaatacatgagcttggaatgaattccagtaggaagaaagagaggaagttaattttttcccttttcctcaatttcattgtatatttgttccacagtatcaccaattggtagtatgttttcctcttgcttttttgacacttcgtctggcacaggagttggggcctccttcgtttcaggatccatcttaagaattgtggttgttggctgttatgtaatagttcaagaggttaactttcgcgttttgtttccgtcaggaagtgtgttctcttcaccttgttgaccacgattggaccaaaggatatggcaacattgactccccccctgcacttcaataggatccacccgggcctgtatcggggctcttatcctcggccaataaactatacctttttacaatctttagccttgaagaccatcatagcaatcaccccagagacgatcacggaagaaaacgataaggaactgtacgatttttgccaaaagaacaatatcagtgtccaacatatcgactgccaactaagtggaaagggtaagaaacgaggtgtcccattggattacgaaaaagttaccaagatcttggagctcataatcaatgctgataagtctccggtgtacatgtattgcattaatggaggccaaataacgagtctggtggtcgcatgtcttagaaaaattagcttttggtcaagtatatccatttacaacgaatttatcacttatgctaccactatcaatcacaatgacagggtattcatagagaacttccaggtgaagctaaatgtccccgagaataaagtgagttggctatggactggattgaataaaaatgtgatagaaaatcatcccagtattactatcatatagctagttgaataacaaagccgctgcaacttccacatttcctctagatctaataagtgcttctttcgactcctcttctccgaatccaaggttgatcaactgctggattttttctggaggtatatccacaggtggcggttgtactgctggtctttgaattgtggagggagggcttccagccggccgctgaccgagttgttgaggaggttgtacaggttttgggacaggagctgtggatggagcttccattggttggttaaagaattcctttgggatgtctgcttctcctaaaaattctgtctttctgtctgcaatttgtaaacagttgttcttaaggtcaatcacacactgatgtcttctcaacatatcaagtccgaatagaaggtcaaccttggtatccaaaacagtgaatgagcagggaacaataatatcttcgatttttatgggagcagaatggatacgaccaatgatttcagaacttcctacaccctgtgcgactcctcggaaccttttatcaattagattcgcaaggttgcatttctctgcgagtttaggggacattatggtcgtttgggctccactatcgacgaatgctttacaatggacaccattaatttccacatttatatagagcatattcacggaaacgaaagattcaggtgagatttcaaaagcagtattcatattttcctctatagcttgttcgttaatgagctccataattcgtttctgattttgtggattgtcaggatctctttgtagtctgtctaattcctgttggacggaagtacgggaaggcccgtattgtccaaactgccccaattggattagtttttccacttcttctttgaagccttgagggtcgtcgagcttatctctaagacttggaggtaaactggcctggtatagcgggttttgtatcaactgttctctaacagagttcaagtgtgaattgacatcactatgtgcttcgactttgctcagaattatgagttcattatctttgagtcctaaatcttccagtggcgagtcatctccagtgagcaggttgttattgtaaaataattgttggtcgtttttaagtacggaagtttccaactccaacaggactttgaggtcagatagtagcatttcactggacacatcaatgtccaagatttgatcgttatgggctaatgttatggtcaatttcattgggttgtctggttgtggggagaggcaagtgcgctcaatatctcgactctttaagatgtcgaagattaacctacttgccaccagaaatcaaatcaagattcggaaagcaatgagtaagagaagcatcagacaggtgaaagctgcagtggcaaatggacacacgaatggcaaagtttcagcgccgcctttagccctaccaactgagttcatctcttatcatgatgctcactttattaaggctgttgagcatcttctgaaaattgacaataccctttatgactcagtggttcaaggcccatttgagagatttaaaaaaaaagaggcagatcctgttgccaatgatttgggctactacttcagtaagattattgatggcattatttcccagcaaattagcggaaaggccgcagctagtatcaagaaaaaagtcactgatcatttccaacaggctgggggagaattaacccaatacagattggtggcagaagaagacgctacggtaatgcgtgggttagggttatccgccagaaaagttcaatatacgaaggacattgcaagagcttttattgaagaagaagacagtcttttggagttcttcttcgaatgctcagaggaggagttgtttaagaagatgattgcgtggaaaggtattggaccatggtcggtgactatgttttcagtgttctctttgaacaaaatggactgtttcactgtcctggacttaggagtagttagaggagcctccaagtatcttcaggcaagacctgaactcctagcagaattgaaagacgaagtagcacagctggagaagacaaagaaaaaaaaggcaaaaaaacaggccgtttcatccaacaagaaatggattgcggttgatgaacagattatagaacgtttagctgaaaggttccaaccatatcgcacagctttaatggttatgttttggagaattggcagtgttgacttgcaagtactagaaagctaatgttaaaacatctgggcctttcattgttttaaacagttacaaacatggctatggtggtcccggttaacagcatttcatctctatggatagtaccttcaggcccagtttccgtaacatcacttaagatcacgttgacaaactcatcaaagccgaccaacgtgccttcaaactctctgtcattaatcagcaatatccgaacctgggatccaatcgccttatccaccaattccaaaggtagtatctcgctgtctgtatttatgtcggacatggcttctatgcaaagtgttaggctgagaggtctctgacttcctcgcaccagcttttcgttactaaaaaacaatcatggcaatagtcgtgtgacaccccaaaaactcaactgcaaatccaaaaacttgtaagacaacactcctacaaacagcacacaaagcgttcaacgccaaaataccatttacagtaatgtcaaagtctattcccaagcacatctgtatcaggcctgtgactttatatgatcttcaaaaatgtttagatttagaggaggcttgctttccagaaagtgaaagagcttccagagacaaagttgcctacagattgaagtactgcccagagttgtcttccgggttgtttatcagaacctttgaggaaaacaagaacaaggatgatgaatacgttttacctaaccacagttccgtcaaagaagagaaattgattgggttgattatgggtaccaagtgttacgatgatcgaattactgagagatcgatggaaattcccaaattaaccactgaaggccttgtcgacacaagtataccggacaatgataaagttggccatgtggagtctgcatctaatattggaatacactcattgatcatccatccagattaccgaggccaaaatctggccaccttattatttaaggattatctccaaaagatgtctcaacaagaggtggggtctcagattattctaattgctcacgagcgcttggtccccttctatgagaagctgggcttcaacaacttgggtcctagtcaatgtcgtcacggtggagaatcttggattgattttgccatccctattgttcacgttaacgatgattagattatgtaatagtaaaattgacatgtaaaccgcgattaccagatcactggtttgccatatcagtgctgtgcctattcctaaattcccaccctcatttcagattagcaggagacgtttccttgatcaatcgccttgtacggagatgactgaccatgttacctcgacggctggcaagtcccaattgctctatgcgaagagcaaagtgttcttacacttaacaaagcacaagactggaaatgtggagggtttcctgactatcaccaagaggactgcttctacttccaataaagagctcgccatcaatttcattccaaaatcaatactgaatagtgaagacgtgaagactctggagtggtttgacttgtacggcctggatggagagaaggagtactcgccttatcacgaggatgcgaatcaaacgaagcaatcatcgagtaacgaacctgtcaaaaaggcttatattactagaccatctaactcatcttcaacagcatacgcatttggagtgacaattggttcactttactccattgcggtacgacctccttcaatccactggaaaggctcaatcatattgcattcaactttaggcgagagattacctccaatattctttcacgacgatgagtgtccagggttcaagcgagagttaagccgaaaaagaaagcagtttcaacctttcagtgaaaataatctcaaaggtggcgaaataccgtattggggaggtgatagattcattactgtcttgcggaaatacgccgcggtagaggctaaccccgccgagaaaacaattttgatgatcaacccaaccccttcagacttgtcaactttcattccacaagatgccatagagaggagtaatgataagacctctctttttggacagggaaagtggaaacttttaactacgatggctaagttgaccaatttcactaagaataaggtgaacgaggtagcccaaaattttgaacaacctgaagtgaaagccattagtgaggattttgagagtgcgagagtgtaccttgccaaatgggcgctttcaattgaagaagaagcaaacagaactcgctccaagttgatcttgaacgatgactacaaatctctattgatagagaagttgggaaaggatttttcttcgttggttactccacaagacattaacaacgcctctaggaaggaccccttgaagaaagctgaatgggactcttattttgacactaatggattacccaaaataactattcaagagatcaaggatcggatttttcatggaggcgtagaccctgaaataagacctcaagtttggccttatcttctacaagtttatccatgggatgtttccacccaagaaaagcacagtttggaaatcacgctgcaggaacaatatctagatttgaagacatgctggcagacagatatcaacaagcgtgagactgacttgttcaaagatcaaaaattccgcattgaaaaggacattaatcgaactgacagggacattagcatttttaagagattaccagaagagacttcggatgacaatgaagacgtatcagtcattaaaaatccaaatctaaacactttgaggacgatattgatcacttacaatgagctgaatgcaaatttaggttatgttcaaggaatgaacgaccttctttcaccgttgtactatgtcatcagagatgaaacaatagtgttttggagttttgttaagttcatggatcgtatggaaagaaattttgtaagagatcagtcaggaatgcgattgcaaatgaaaacgctaaacgagttgactcagtttatgttacctgagttttacttgcatttagaaaaatgtgagtctaacaacttgttcttctttttccgaatgctgctagtttggttcaagagggagtttccttacgagactatactcaagttgtgggaaattttttggacagattactattcgtctcagttccatctattctttgcccttgcactgttggataaacattcaaacaccatcatcaataacttatccagatttgatgaagtcctgaagtatttcaatgatttatcaatgacagagaatgatgtagacgatctacttatgagagcagaactattgttcctgaagttcagatcgatggtgaacgtgatagatatcaaagaaagatacgaaggaagtgcgcaattgatctcctcggatcttagggacttaattggaacggagttagtgattcagaaggaaaatgaaccttgctcagtcgagtgatgcaaactgttatctataattatgttgcccaaatttgacctgagttatgcacaatatgctctatgccgcacgtgtctatttcttataaccactgttgtaccttcagccacgtgacgttactattatgtgcgcgggctatataacccaagataagttcctatccagcctactactttatctttatccgtaaatgagtaaggcatcaccggagactactcatctgttacaccatgatccttacgacaaaacagaaaggtccgcagcacaaaagtcatcttggaagaacactttatacatcatttttgccacagttgtttcagtgccattgctgtatctgttcttagtatatctgcccaacttagctcccgagtctgtgagcgagctgccaatcattcgcaaagttgacaaattggatttttcgaaccagttggaagtaccacggagactcattttaatcggagatgttcacgggtccttaaagccgttgaagaaactattgagaaagctcgattataatcccaagggcagtacagacacagttcttttgctaggagattttattagcaaaggtccccagtctgtagaagtggttgatttggccatcaaaaacaaattccagtgcattttaggaaaccatgagattagcgttctgcagagatataaccaattccatggattatctggtttaaagtaccgcaacaatgaaagtgacatagaaaattatgatttacaatcgggtcaactctacccattagatgatgaaatgaggcttgcaaagcaattgtatcctagacacgttgagtatatgggcacttgcccctttatttatgacttgggaccggtacctcgttataataggaaacatacaaactacaaggaaaccgttgacggggtcgccgttcatgccggtctcaactggaacgttcatgaactgtatgatcaagatgtcaccgaggttactgaaatgagagcgatgcttcccccagatttctcaaaagctactgatgacaaatccattcctggttctgttggatgggcaaagatatggaaccattggcaaaacaatataactgatagcgacgattttgatggtttaaagaaccgcaaagtttactatggtcatcatgctagccgaggtctcaatgtgagaccgtacaccatgggaattgataccgcctgcgttaagggagaccgacttaccgctgttgttattacttaccacaagggtaagataagggagaaacttgtttctgttggttgctgaacttttctttttaattaattgaatactaaatacttatacgtttttcatttcttatgatcattctcccttgatggcttttcttctggtctcaacacgttctttcccatgcaggtcaattaacttgtgcaggtcatctagattgctagcacgtagcatttcgtcttgacgaccggtccagatgccacgagtattctccagctcccactcaccagtaagaaggaaatgttccactaatggtcggaagaaaatcacatcaccagaacatgaggtaaaaagaaattcggtataacgatgagcaaatcccagctcagtgtagaggatctttatcaagtcatctagtccgcctagacttctggagcttaaaatatcatccattttgtcaagcaattcatcgtctgtaagattttttcgaacatgatcagctataggttcactttcatgggtgttgacattctgtgcggactcaataacttctgcaatagactgctcgttgttatgtgcagagagaacttgggcaatattctcctgttcaaagaaattggtagttgaagtattaggagctgaagaagcagaggcagaggctgcaactgctgcggcagcagctgcagcagctgcagaattggaattagatgtgaccaatggggatatgtggtccaaagagcttacagcttctacaccaaccgggcctggaaggccactgttacgtgaagtcccgcgtctttctctaaatttttcaatggaagcctttgaggtaaagttcgtcatcggattaggaacaccattgagttcaacagtcttttcataatacgcgatgtactgacgaacaccgtatttagaggcaaactttctgaatctgtctctccaggaagtctttgtatggtgaggaaagcgagattccaagtcatcaaatacacctttcagaggtttgaaaaattcttggcctgttgtctcatctacagattcaatgaaaggttgaaccgataaacacaaattgtaatcatcttgggcagaataatgaccacgaattccttgtggaagatcttgtaccttgatgtagttcccgttttcatcttttcgaggttggttggtcaatggatcgatatcataaacccaatcaagttgagcggaaagattacgacgaaatctgtggcggatagaatgattcgtatggtttttcatgtgctgagcgagctcagtgtacagttgatgtgtgtttcttcgtttaggatttctcctaacaaagtcaagaataaaacgatcttcttcgggagtgaactgtattttgctagtacgagcgtctggtttagaagacaggccgttggtagcgacaacaacagcagcagctgcagctgtgctggcagaagtgacatgatccacagactcttgaagggccctattgatcaaatcttgagccaagtcgacgttcttgtcaattcggaaagtgtcaatgggaagagatgtcttgtgcacaaaacactggtagatgaaggagtctctgtatattggaacgtcccccagttgctttagggtatcttcatcaatagacttgtaatcccctgtcaaaaacaacactccatctaccagaggaggcaggtctggaacgatcttgccacccatttcgaggatcatgttgatcaactgagaccggtcagacttcgtgaagtagcccagaatatggaaggagagcgggttaccagcattatctaccaggatgtttttatatggggttagtttttgcttcttggtgtttggttccgacatctctttgatgattggtgttgggggggagaagataaagtgtttgttgtggtgtttgggttactgttgtttttttcttcatcggttcttgctttgatagtcagggatttcgcgtactgagagatctgtcaacgagatgttggatgaccgtttaatcattatatgtacaaaaaaaaaactatacagtccatgatattctatgatgacggacgatcgcttagaagaaggtattcattctctaatctcgctatatctattttactctagctttctttagtccttccaacttccttcaaatgtatgcctaatatatgcaaggtgatggttcaaatctccagctccactgtggccaatccctggactgaagctggtgatcggaagaataagaatatcgtcgattaatttgggggagcgcaggttggtaaattgttcccataaaacaacctgctgtgcatatttacctgggactttctcttttaacatctctccgttcgggcgggcagagagggcatcacgttcttccaacgataaggcattgtaatacgctgagccagctccaattccttggcctgagtggcctgttgtattgacattagtcatataatcaaatagagtgtctgtaaatattcctggacccgtccagtccatcacatcacttccacgatcctttccttccaccatgttcaagtaaccgcttttctctttccgtaaagtcgtgctgacaactcttacaatcagttcacgcagtgctgggtgtcctcgtttggactgaattgcccattggcaaaattgtatccttctagcataccagtcgtgccaatcaggtctatcaggatcagcctcaataccaatgaccaacccagcattgttttttactccaccaatagtttcattgaaagtcagccacgattctattggttttaataacatagtgtccatgtcagcatacagtcctccacgggcaaaaagaatcaaatacctgaaaaaatcggcctttagaatgggctctggtagcaggtggaaagcttccaagacttctggtacacgttcgtattcatggtgaataagttcccatgctgcatcatcgggtatcacaaaatgatcataatttggggacctttgcagccaactttcacctaagtctttgaagtttttcggaaaggaactatcagagggagaaactttccacgtttgccaaatatgttggggaaaaggttcgtaactgcggtaaggaaaatgaaactccaattgtcttcgaagattatcttctacggtgcctggactcaactgtgaaggagcttccaaagtcttcaaatcaagtgatcggagcgtcaatggatcatagtctatttttggagatgataattgttgtgagggtccgtacaaaacgcaaatgacagaaacggcgaatatagccatgtagaagtaataccttctgggtggattgtgaggattatagtagagcaaactgccatctgccttcgccatggctgatgatatttgctacgaacactggaaattgtggaactgaatataagtcgcgtggtaatattactaggcagtgccagggggcgcaacttggaaggagagcgatagagaatgttccaggagagaatttggggaagtctcggcggaactcatataagtgaaaacagaaaaggcaggcttatgaaaaggaaaatgataggttgcagggaaaaagcaactgaaaaagcagcagagtattttcagacctcatcaaatcaaagtctgatcattcttccctagttacttagccggttttagcttcttcttacctttccaacggactccattggactagctatgtaatccttacaccacccagtagttctattccataaagtctttctttcgcggtgattgcgagcatttctgccatctatccaccccacaccccgccatttctccgtcaatccgattctcgctgaaaaatgtgaattgaacagagaaaaagccaaatcatctggtcaatgtaaactccaagacaaccttgtattgcatccctaccaggcgaccttcttttgaacccttttaccccagattaccagctcttctcattacttctccgtgtgtgacccgaccgcgaacccgcgatttgccatgaacaaaaaatattaggtcttctctatttctctgtcatctatctattaccccaagcctatgaaatggacaaacaaataaagccaataattcctgttctaggcctacgtcaggagcaccaggactcagaacgctctgtgtctgtttctgagtctcctgtgtccaaaatgtcccaaaaattgcccttgaagctaaataaccccaaggtcatcgacaagcagtctttgcagtatgtgatctattcaggagtagctggcggagtagcaggaagtgccgctaagacattaattgctccactagacagagtgaagattctttttcagactgctaatccagagttctctcggttttccgggtcttttagcgggctctttaaggctgtcaggcagatctatgggtatgatggtgtcgcaggtctatatcagggtcattcggctaccctgttgagaatttttccctatgcagccataaaatttgtatgttatgaacagattagaacgttattgatccctaatgactcttatgaaacagctccaagacggttactggccggctcattagctggggtttgctctgtgtttttcacttacccattggacctaatccgtgtccgtttggcatttgaaactcatagagaagttaatagggctcgtggaggaaagtttttgggcatagtacgcagggtcttcaacgaggaacccagatttcaagtcacagcattagacactttggcaaggttgggaaacttttatcgtgggttcgctcctacaatctttggaatgattccatatgctggagtcagtttttacacacatgatctcatccatgacgtatttagatcccgtcatttaaaaggttacacagttcaagaagaagagttcaaaactcttgaagacctgacggtcaaaactaattcctcccatgatcgtagattgcctttatatgtgtgggcgcagctgaccgcgggcggtgctgctggtatgttagcacaagctgcggcttatccatttgaggtcattagaaggcgtatgcaagttggggctgttacaaacaacggtgagtatttatcgatattgcgtactgcttcacaaatatatgttgaaaatggtgccagagggttttacgttggtttgacaattggatttataaaagttgtccctatgttcgcatgcagcttctttgtctacgaaagaataaaacgaaggttgggaatctaagcgaatactttactcaacctactgtcactcgagagtcttcttgtcaatcgtgctgttagcacgctgagcctcatatcggctccaaaacgacgtacgaaccgctctgccagtggtgttatcaatattgactccattgctgtctttgacgttacgttttcacttatttcatttcttggggattgttgcgacgtgccaactggttctgccagcaatcttcccacggctcctactagacgtacatccttgaagcatcgtccagtagccatattcaacaatttcactattgcctgatctccgtataattgtaccacctttgcccaaacagccatgttagctgagtggagaagaccagattcatcacccatattctcacataatacagcagtggacagcaatgagtttatctgcaattgaaggtaagcctcatcaaaccctttgattagatgacgggtttgttgttgcaagcaaatgattattgacatcagagtgtcttggattactctctcattggaatagaatccatttaatcggtattgatttatccaaccaacaggcggaccatccaaaagttcattttctagattcggattatttaatttaagtttgtatcgccagttgtttagtgctgtaactagaatatccccaatcagaataagaaatgcttgtagacacaacacagagtgaacatctttgtattcgtctatcacattattagaagtatggagtatctgtgttaaggatacgcacacgtgttgaagcaatgccttgtgtttgaataggaaaaaaggttttgtgtgcaatagccttactagtggttcaaaatccaccggtggagatttcataattagtccatttagccacagagaattcttgtcaattgagaattgcaactctcgatgtaataaaaggctaggtttaatatcactcattattataaaccaacataccaactcatggcccactgcagattttgcgtgcaattttaacagatcaacttcatttggagttaaaaagtacgatctcacagtgagcaaaagctttagaatatatctctgatgagggatgacattgtgagtactcatatcctgcaatccaatggaatgatattctctaagactcaggattcccggaccacaattttcattaaattgagtgtcttcttgattcgaaactgcctgctcccatatactgagaacctgatcattttttgacagttccaagatgtttccggcgaatcgtttatgccagaagtgaaacataatcagtgtattcagatgttgcaatagctttccttgaattgctctgtcatgttgatgagatgacgatagcgcagaaaccaaaggatgtatcgtatctatatgcagacgcacgctttcaagggaaggctcaaaggatattctttgtataatttgcctgtagttgctctcaattaggtataatgatcttctgtcagacgatcctgtagtcgtaagattctgtgtttctcttaccagctcttcaatactaatatccattccgattcgtgaccactaagcttatcaaaaaacactccaaaggggaagcaagagggtgaaaggaaaaagtgatttcacatataggctgacagaacaacaaggggacagacaattcatatcatggtttgatgtaaatttcaacgcgatgtcaaatgtaactatacaaatagcataatctataatctatcttcgaagcactctggaaccagctaccaagccgactgatccaactatagaagccttgaatagagtatcgaagatgctggaaccaaggtaatattgtacaaatatgccttcaagaccaacaattgaacctaaaaataatacgtgccagatcttttgacaagagctcgatgggaagttcttcaaattgtaactatcactgacggtccaggtaatcaaaaggccagcaagtattgctgcaataccaccaatgaagatcaaagagagaccagctggaactgtggattcttgttgtctgaatatgtgcctgatttcctctttagcttccaatcttacaggaggttcgtaagtagtgagcttttcaacgggtaatattgatgcaataaattcttgcagatttttgctggtatcgacatcacctgcgatcagtgtcaggtcgaatggttgagactttatggctccagagagtttcttgactgggatggtaaattgagccttactaccggaaagtttgggataaacaatttctgaagcagattcagagtctaagctcagagctacttgttgagggaacttgccttcatctgttttcaagctgaactccactttaatatcttggtttctgtacaatggaatactcttcgtaccaaatgcaaattcctcctggcctacagaaacaattccattttttatctttaagcaactggccaaagtcagtaatgtcgtcactatacccacggagatcagcttcatttactctgttgcgtgaaatattggtgtttaaagggaacacatagtaggccacgtcggttttctaggatcagtcgcgcaacaaaatctgaccagtagttactcaattcagttttattaatagtttttcgtgggccatcaaccactctcaggtaacatcagatggtgatattctggaccaagaaggagtatccgcccgctgaacacctccttcaatccatctgaaaccccacaaagacttccaggatttgttcatgtcatttgccgcgacaattttgcccttgatgagccccattggtagtaccgagtaagtacgagagtccaaactgtgggagagattatcacctgtcagccaaacgtggccatctggaatgacaatgtaacgttcaaaagctgttgaactcgcgtcacttttgtctttctctaacgatccgctactgggatctatgagaacaatatctccaggcattccagtaattcgtttgcaaacccgctgatctgggtctgttggtttcaatgctacaataatatctcctgtttgaatattccttccaaacttgtaatttttcaaagtatgaacatagtcatgtctcgcttgaagagttggaagcatggactcgccgcgagtctctttgaattcgtaaacgtgagaatgaaaaaaatggatcagacaacctgcacgcaaagtccacgatagagtggttctcagaaatgtcagatccatgagcttaatctatgatggagtcttgtagaaagttcagtgggacaagtttatcctttgtgaggcggagaggcagacgagatgagatattttgatattggtcgcgcgaagaagaatatctagttatggttcacaatcgaaggtttgactttaacatcacatctgacaccgttgaggagaagccagtaaaatcaagttcaactatttcatcaacacaagtaacacactatggctcactatgaacagcgtaaacttttggaacagctcatggggagtgattcgttgattcgtctgccaaaagattatggggaagagaacgaagattcatcggtggtgctgaatgatcctagagtttgcagaagctttgtggtagggacttgtccttatacactgttttctggaactaagggtgatatcggaacgtgtccaaaattacacatggaaagacatcgtattttgtatgagtccttacgcaaagagggcactacattgccggattacgagcgccaatacttgtctgaactcagaagatatatcgatgactgtgactatcgaataaaggttgcccttgccaggctggagcatactcctgaggaaagagcacagttgtcggatgtaactcgaagtctggacgacctgagtacgaaaattggtataatgacacaggaaatagaacagttagcacagacatctccagaagaaacaacaaagctggtgattgagagcagaaagttgcaagagacctgtgacgaacgagatcgtttaggaaagcagtacgcagagatgttggataatttggggcaggcagctcaacaaaagctacaggtttgtgaagtctgtgcagcatatctctcacgattagatagtgatcgaaggttagcagatcattttgtgggtaagatccatcttgggtatctgctgatgcggactgaacttgaacggttgcaaggggtccagagacaaaataacaaatgaatagttggtaaatgcttgactctagctggttattatattagtgatatatgatggcaaataatagcttttggctaggaaatggagtcactcaagatacagcctctgaattttgctgttccgataccttatcattggagacaccttccaatctttcatcgtcagggtcaatttcggtgactgtggcaacttttgcggatccgtttttcttcacgacttcgctgacccccactgatggcggcaatagatctgccaatggtgccaagagtcgtctgacccagccttcctcggcagtgaatccagtgtatcctaggtaaattatggacacgacaaaggcactcaagagactagccgctagagtgattgcaagcactggtatgaaggccaccgtagtggcacctgaaacaactacaaatattgacaaaaaggccaaaattccaacactagtgaacaatagtagcaccagaagatacagtaccactggtgctataaagattactattgacacatggaaaacaaacttgagaagaaaactaattagaacacatcctttgatctagaaacaaatagtaacacttaccctgatcaactgattttcaggcagatgggctgatacccaatcgaaatactgatgcaagacctctgtaaatgtcatcaatagtcttaaggatggaaaaaaccaagaagttagaagattattggaggcaaaaaattaaacaaggtgaaacccgaaaacaaaaaacaaggggcggttgacttacaattttaaagacacccgagcataagcttggtcttgtgcgttcatccattgggctattggcccgccaagtcttgtgatggcttcggagatccaaggcgtcctgggaggacttgcttccatgattgggattggatcaggagagtccagcttcagtgtcgggcctttgggggcaactggttgttttctcctgtggaacattaatgtgtaattggcgataagaaagtgggggataaggaagatacccgagacgcctcaattattcatagtgttggagataaatcagatggtggatatttgatccttgtttgacattaacaatgcagcgaatccgagtgcatgcatatgttgcatcgtctttttatgaaaaaggcaaatttccaaatcaggaaattttcagccatgtcagaattcactttcctccaggataacagccggattaatctacagcggctacaattcaatagttactggcatcaatggcaatcaggactgtttaccttttgaaatacaaggaaggactcgcgtatctgagagttgttgcaagaaatagcccacaagcgacggaaaagtgttccgatgcgaaaaatttgtgataaagctgcctcgcaaactttaaattgagaatcaaggatcaccacgggagacccctggatgattcctatcaaaaaaaatacacacacgaccctctttttccctatccatgcgtcaaaatttcgatcatttgatttttgcctacctgtttcactcagccctattagtattgtctgaaatgggtacatattctgtctatttctgcagcttgaggacaaccttgcatgtgtcatcatcgtctttgcacatgcaaggcttctctttatctccctgtagcagcatgtcggaattactttcaattattctgtcaccttgatttctcatggtccctttttgaggctaaattacaggtttgtttcatctgaacataaaatccgatctgatcctgaatttttgggttttggcttttctctcgtgctgcgttttttttctgccatccttccctcatccttccttatcgtcatccggaatagacaagtagatgtcaaactcaccaggaagtccaagaaaattaagaaaaatccctcctcctttacgtaagctaagatctactacagaccttttcaacttgagagactattccagaacgaaactcagccaacaaactccaagatcttctatttcaattgaggaaactagtggtatatcttcattatctctatctactttggctacgacccctacttctcccaatgacaatcgaaactttctttcaaagagaagatcttcctccatacaatcgttttcaactccatcgtcttccgtcaaaagttcacggtcacactttcctcagagaaaattcagcagcaatctaatcaatgagtcgtgctgcttttgtgagcttcttctctccataaggagtaccggaaagatgagtgtcagcttgagctgtggtcactattgccattacgattgcatcttggtcttgatcgaaagtgacttgaagttcccaaactgtcctgaatgtgcttgtcaaacagagcctgtggaggacacaatcagcatgaatcttgttcaagacaagctattgaatgtttcagctacaagctcctttagcagtgtattggataccccagctcaattgaataatcagttctttttccccgattcatctgttaatactgtcactccaatagattttgagcagtcaaaaagtgccaatactttatgtgttttccctgaattcggcgacagtagcagaggttacaagtcattggagaccccaagagatcgtgccatagatactcttctttcgccaccagctttgttcaagagtagcttctattcaaaggaagtctccccccttgctgccgattaccctgacacgttgaccaatcgaaaccaaattttcaaggaactctcttctccacagcttaagattgttccaatcattgacaagattacaatcaacgatgtcgacccaacctttgagttagattgcacggtttcgattaaaggaccataccaatcttcaatccgagatctttccgatctggaacttcaaacaaagggagacattcaaactgacattctgaataccatcggttcctccatcgatgaaccattaggaacgctattactttttgatatcttccaggtaggcgtagacgaatctgagtggagtgagcttcttattgtcttttttgagagaatgctgattacaatggatataaagggaaaacaggtggtaggaaaagtagctgttgatactatctcttccattacaagtcaaatggaagacaccatcattttgaaccttactcttttatctctaccggaactaatattgtactcaagggatatgacattaattgacaaatggaaaatagttttgcaaaaagcattgaagaagattgatcaatgtattcctttaaggtcattgtcattgaacggttggagttttctcgaggacaaatcattagttcctaatctagaatctcaagacttatatcagcaagtcaaagatcaaatgctgactcacatttctcttgaactcgacctaattatttgtattcccttgatcaccaatcacccgaaagaactacgaactttatttaaaacccttttgtctgcacttcaaactcaaaacgaaacaatgaatcagaaaaatagaattggcttggtacttttggggaaacgaaaagcaaattttgtagggtgcattgatcccgaatgggaaaaatgggatgaatacttgaatgaaataccgttttcaaaacccaaaaaatcccagtcaagcagtctctcctcaaaagagctcaaaagagtccttcattccatctttacttgcagtgaaagggatgccttagaccatcgatatctcaaagaaattgtccttattgattattacggagaagttgatataaaccttaatgcgaagatttccaattatttcctgttcaaagaaacgcagtcatacaatccaaattatgttaacaatgcaattaaccagtattccattgtcttttctcaaacttttcaggagttggagcagaaaattctggattatgttttgatccaactctctgaacaatattcaagaaagatatcttttgaagtagaattacccgaagactatgttaaagtaaaggaaatccgcaccatacgatccatatcaaaagagaatactctccagattgaagttcagaaccttcaattcaaccgagaagtccacgcgttaatgaagtttgaaattgaactatccaatttgaaaaagtctcctcattatgtttccattccacttatcaaccaccagatggaagatgtaaacgttcagttacggttttcatcatcccaaatccctcagtaccaccataactattgtcattctaatcattctaacgaaatcttagagattccactaatccaagctcccctttctccaaagaaggaccctttaattctcagaaaactatttgaagattctttgctagaacagctgcttcaagggaaacaactatcttttgactcggatgaaatgaacgcctatcggaaagttcatggagcatccatagagaccaatggtcggtttgaaatgcttaatcacttgctggccaattgaaacttcatttctttaatatatacatatactttatataaattgaataatttccttttgagctttttttttttcactcgcgaagcctgccaacatctttccgccaaacaagaaaaaggcagacccattctatgcttagacgttttatcagaacaatgagtgagagcaaaattaaagaatttactctgaagaccccaaaaggaactaaggattgggccgataaggacatggttatccgtgaggggattttctcttacctgagcactttgtttaagaagcacgggggtgtaactattgacactccagtttttgaattgagagagattctgtcagggaagtatggtgaggatagtaagcttatttacaacttggaagatcaaggtggtgagttgacctcgttgagatatgacttgactgtcccattcgcccgttttgtggctatgaatggaatttcctccataaaaagatatcacatcgccaaagtgtacagacgagatcaacccgcaatgaccaaaggtcgtatgagagagttctaccaatgtgattttgatgtagctggtgcctatgacaccatggttccagatgctgaaatgttggaaattttatgctcgggtttgcaaggtttggggatcaatgacttcaaggtcaagcttaatcacagaaaaattttggacggtatttttgaggtgtgtggtgttaaagaagaggatgttcgcaaggtttcttctgctgtggacaaacttgacaagtctccctgggaaattgtcagaaaggaaatggttgacgaaaagaaccagccggaagaagttgccgatcgtattggcgaatatgtcaaactgagtggttcaatcaatgaagttttggaaaaattgcaaaaggatgaagttttgctagccaatgaatcggcttctcaaggtatcagagatatggctatactgagtgactacgtggaagcctttggcattagcaaattattatcttttgatctatcgttggctagaggattagattattatactggtttgatttatgaggctgtgaccgctcaatctgctcctccaacaaccgttgactcaaaaaagaaaaaatctttgaaggaggatgatgatgccagtgactatgttggtgttgggtccattgttgctggcggacgttatgataaccttgtgggaatgttttccgcctcaaagaaatctatcccatgtgtaggagtctcttttggcgtggagcgtatattttccctagtaagacagaggctcgtacaagaccagcaagtgcgtgcttctcatacgaatgttttcattatggcttttggaaatggatttttaactgaaagaatggctgttgccaagcgtctatgggatgctggtattgagactgagtatctttacaagaataaatccaatccaagaagacaatttgaggcagctgagaaactgggatgttccattgccgttattcttggaaaggatgaagttgcacagggtaaagttcgtgtgaagacattgaacacaggtgttaatgatgatggagagttggttgatttggataatgtagctccatatgtgaaagagaaattagagggaattgttcgagttgatgacatctccagactgattggaaatttaacgaactgaacgcatcagatctaaccaatatagaactttattgcactgtgaacacgatcctttcacaggaagtaaatcagaagtgaagcttcgggctaaacaaattacatgaaattgagtctgacaatggtagcatgcgcagaattgtgcctgaaaattttctgtagtaatattggtggaacataacgaacatgacgggtttgagtttccctcttcatctttgtcttcttctctttctccggtgttttttttgctagcaactaagttttcatctttttcctctatgactttcatgaattctgataattcaacttccagtacgtccatcctcaaatattcaggagtttgcactccatatctgttgagacaccatgatttgtagatggctctgtctaagatgtatactgatatgttccacctcctgaatccttcactgcccagtagtttctttaggtttgcaagtttaatatggatggagttggaatggctgagtttgtcttcgatgtgccttgttaagtgcgaatgttgccaggcatgctcaaactgtaaagctgcgattttggaatggaatcctagacataacaacaccattttccacggcctatagccttctcgtttagttctaaaagcacctccagcggccaggtctccattgtgctgagctaatcttcgttgagggttgttggtcgatcctatgtaaaaggactgtggtttttcctgcgattgtaagagataaacgtagtacatgaggtaaagttacaaagagatggcacctgtaccagggggtggggcaagaaacgtcagtggtttcaacttcctcccgtttggagtagaacacccatacatttttttttttagaacgcgcgttatcaagagaagatcaaaaacaaacaaacaatcgctcttaccaaaacacaccaatgaggaagcagtacattttccccattttggacatcaaagagctagtgatgtgccttcaaagctgtggatttactgcaagtgaggatcttattggcagaccgactcgggagtatgttcagactttgttggagcaggtagctgatcagtatctcggaatcagcagccaagtaatttacaagatcaaagagaacaacaaagagaacaacagtgtgcatgtagtgatttacttgcaacgaataatgtatcaatttcttaaagtctgcgggatcgatgatttcaacattatggatataatgaagccagattctaatcgtgttctggtaatcctcagcggaatagtgaattttgcccggtttagagaagaacatttgatagactgtgaatcatttttgaacactagcgagcagatggttaaagaatacaagaatttggaacaatccaacgagaaaatgaaagaaaacatcgaacaactgaaacagggggacaatgatatcgataagatcaacaaggaaaacaaagacattgagaataaacttaaatctctgattagtaaacaggaggaattgactcagcagaggctggcatataaggaagagagaataaacctcattgaaaagctccgggaaaatgatgaacttataggcaatttgagacagttcaacttgcaactacaagaagaatcttcaacttcgatcaaaacgcggaatcaagcactgcaagagcaactaaatcaggaacaaacagttttgagtggattggagctcaagtctaggaaccttagcgtttctattgaaagtttcagtctattgaatgtggaggtcgagaattatttgaagctgatgagagatgtggaggctgaagtgaacaaacaagagttgttgatggaaaaacttggcaagcatggagaggcattagagacggaccaattgaaaagtaatgagttaaagtatcgcgtacaccaactttctagacaattgaacacacaaaaagataaaattgacaccttaaaaactacaatggaagagaaacggaaaacaaacaatgaaaaattaaccacaattcacgatcaatataccactttaatagcggaacgagacttaaacgagcaagatctcaacacgaagaagaactacatcgacagtttggagcagaaaatgtcagaaatgtccagactcttggatcaagaggtacaagattgtaatttggaattactgagactgaacagtcatcttaaactttatctgaaagagatggagaaaaccaaagtcaatgagtacatacagattatgtaattattatgtcagcgttttaatctttcctcaacatgaaaattataagggtagcgaagttttaggctcaggattccattcctctaacaaaaagccatggactatcagaatagagtgggttccaagaagggttccggagggcttgcatccgctgaggatactgataaacataggaaagaaagactacgtcaacttttgagaagtaacattaatatcgaaagtgacccgtacgtggtgagaactaggactggtcaatacgactgcaaattgtgcctaacaactcatgtcaatgaaagctcatatatctcacacacccaagggaaaagacatcagttgtcgttgatgagacgggaggcagaagtaagcaaaaatgaaaaccgaactgacggaggtaacataggaaacggaatgggaatatcaagtatccccaagagaaagtatgtcaagatcggtaaacctggatataaggtgaagaagacacgcgatgcagatgaacatcttggattatcgctagaaatcgcaatgaaagagttcaacagggtaaagccaatgtatacaataatgagcaaaatggaaacaactacgacccccgttaaggggcaatgtattgttatttcgggagaaccttacgagaacatcggttttgatattccagttgagttagatggattcaacttgggcgagacgtgggactactgggaccaagattctaaattatattatgttcaactaacttatgaccggacatcgtaacatcataatctactggatctttccttttcggaatcatccagcaagtacgcaggaagatagccatcaccgtcctgcaggtcagggttcttaatagtgttgttggtaccacccagagaagtatagcccatatcatagagcttgcagtattctatttttaaatgacggaggaagaaccaaatttggtggtaatcccattccagaatcggattgacccgcattagccggggccagcttggatctgtttcttgtaaataatgtaaatccttaccatatggatcacatcttctgatgcctataatgacggcttttatgcatgggttttgtaccaaatatttgtggagagctctcttcatagtgtctctaaatggctgtagatttagctggtattttgccgccgatttttttatgaaatcgtcctgttcttggaacattgactcatttttgatgtatagtgcgtttaatttgtaatcccttggtatcgactcgttttgatatttatcgtaaatgactgctaagtaaatgatcagcagtacaagacagtcttttccgccgttatatgatattgatagttcatctaatttgtacaagttcaaagattcaaagagtatgtcataggattttctgacctgttcctgggtcgatgtcaaaagttcgttttcaggatctgactcattcaaaaaatcagtgataaggttatagctgtgttcacacactgagagaaatgagtcttttatcatattgtgattgtgctgaatctgtgtggtctgcttactactattggagagaacagttaccatttcagttcttcctttgtaggggtgtatatatagtaggagagacgatatttttctcgaaaggaactccgcgtttaggctacagaaggtcatatctctcgcgcttagtgagaggagcacaactcatagtggaggcacttgagggagggaaaagaggatcaaagtaaagaggggcagctgcaaagctcagcaaactctcagactttggtttttccggctcgtatttgataccggaagcttattacaagctttccgtagaaattgttcattcattatttacccaaactatctagtagctaatgccagtatttcatcttcatacccatcaatatgcaaatagttcaccccagcatcctccagttgtctctttcctgtattgtccgcaataaacttcttgggctctacaacacccacaaaaacggtaatgacttctcccttgagatcaataattcgattcacgcatggcttattaccgctcaatctttcggaacatggctccatagtcgtatagagaatggaaccaggaggcaacttgtaatccaacttcatcaacgcacattgttcagcgtgagtgtttccctcgaactctctactgtaccccctactaattatctccccattctcatccgtaatgatacatcccacattaaacgcagtttctgtgtggtcgcatttttttgcctcttcaatagctagtttcatcatttctctgtgatgaccttcaatactccatttaggcattttggtgctgtaatcccaagactgttcatgcgagtaataacggtatgcatgcaaccatagtatgagatcattcacgcctggatcactatagagttctgatccacaaacttcacatccttcttctaataaaagctcaccagattcttcgggataataccaggacgtactctgtttagtttttccgatcttctcactcctttcactcacttccttaagataacctgggttctctttatgcagaaagccctttcccaaagtgagcccccatacatatggtgatgaatacaccgggtcattagcaataggatatccaataaattgcagatgaactctgatctgatgcgtcctacctgtcaagggcatacacttaacaatgctagtattgtctttagtgtcgtatgagatacgtcgaaacaacgtcttggcctccttcccatcttctaaatctactaaattgaatgtcaaccttgggtcaatggtcaaaaggggcttgtcaacaacttgcaaccccagaggaaatttgcctttgcactttgcgatgtacactttcccaacattacgttcctttatctgctgaaccatcttggctgttttcatggctgttttccccagaaacatgattccacttgttaatctatccagacgattacaagtatgagcgattgttcccatttcttgcttcattatcatggttatggagttgtgtctgtaccttccagtgggatgaacaggtatcccacttggtttattaatcaccgtaatttcatcatcttcgtatgcaatctctatttcatccaaagtaactggaggttcatgacggtgaatcctatggcttattagatcaccgtttctgagtactgaatcgacattggcgacttgatcgtttagcttcacttcaccatttgcaatagcattgtagtaatatgaaaacggtttcattctgaactcggatttgaaaacttcgatcaatttgcgatcttgccatctttctttacaatgagtcaaaaatgtaaaataatacggtgttactcgtcttaacccatgcacataatccttgatataagaagcaccttggctttcttcctcaaaaatactcacaccgtttccttcaattttcctatgagaatccaaaacaactttcttcactttgaacccatgagcatctctctgtggaagtcttttactcatagctgattagtctgcaagaaatctatttaggcacttcagatattgaaaaaaaaaaatcgagcctcatcatccaccttctctcattcctcatttcccatcaaaagattcatcctctcttatgctgaatccagtccgaaatgccagccagttttcgtcccagcttcgtcctctgctgaaccaattggattcaaatcttcctgcattcaatctgaacgcaaaagacctcgatatcattactcatccccaagacttctacactacattgctagacaagattgataatgcaaaagagagaatatttctaacttccctctatttaggcaaagatcaaacggagcttctaagcaaactaacctcatctctggatagaaataaggatctcaaattatacatcttgatggactatctaaggtgtactagagactctcctaagactagcacggcctctgtattgagcaaattgactgaaaaatacggttccagggtagatgttagactctatcacactccaaacacaaacaagttttggagtatggtgctgccctctcgattcaacgaaggtttattggggttacagcacatgaaattctatgggttcgatgatgacctgattatcagtggagcaaacctctcgcaagaatacttccaagacagacaagatcgttattaccattttcgtggttgtcacaacctatgcaactactacttcgacttacaatcggcggtttctaggattagttacaagatattaccagatatttacaagaaattccccaaagactatattgtcaactggccaagcaccaatgctacatgtgaaccatatatcaatagtgacagatttgtgaaggatgcttctctactgctgactaatattcttacaaatagaactgaagatgtaaacgaaaaccccactgatactgtagtgtatcccatctcccaattgactcctattttgtcaaaggagaaactcaatactgaaaagtcgacaatttttcaactgttatcatacattaacagcaactctttaaaatgggtattaaccactggctatttcaacatgtatccaccgttcatgaagaaattgttgacccccaccgcctatccgaaggaagatatgggaaaagtgatctgtgcctcacctcaggcaaattcgttctataaatctaaaggcttttccaaacatgttcctgaagcctatttgcaccttgtacgcaaatttatccgacgtttgacagattcagggttgcataagcagatcggcgtttatgaatggcaaaatggagtcgtccacacccccaacggatggtcttaccatgctaaaggtttgtggatctatgacaaagagacacaattacccaatattactgtagtaggctccacaaattatacgaagagatcctactcgttagacctggaaaataacctggttcttgtcaccaataacttaggccttcaaaaaaagttacaaggtgaagtggagaacatactgtcacacaccaccaagtttaactctctaaaacagtttgatgaaaaatacaaaataccatactgggtgaagactgtaacagatatgttaggaagtcacttctaaagtgttgagatgatgaggtacaaaaaagaaataaatagggttaagcaaaccacttgtaaataaaaatacactaacaatttgaacatgctcttcaagcattcaacattttgttaagctttagttgagcttcttgagggtatttgttgaccagagccatcacttggtcgctaggaatgttgttcaacaaactcttcacggcttgaatcacttttgatttggtgttcccttgtagagttgtcagtaatccctgaatcatggaatcaatcacgtgaaggacattattagtgacagaagggtcattcccttcgatcaatttcagtaaaaagttgtaacagaaaatggcacactcctcatccattatgatgggaagagatttaacccactcatctagcagtatatccaagcctttgccttggatgttgaaatttgtagtgtttgatgcttttaattgatggtagaactttcctaaagttgcaatgacgttctctgtggcattcaaattatctccgttacgagaattggcatcttgaacgatgttaatcattgttggcgtaaggtttattatgtattcaccgtaagaagtcaacgcggacccatattgaatactaactccaacacaatatgctgcagcttgacgcacttgagggtcttcagataccaaactttctccaactgggcttaggaacatttccttgaattggatagaatcagcccctgcgtgctcgatcacatcgctaatcatgcatagaccagcaactctgatgtcgctgttctcatcgttgatgaatgacgcaactgtaggtaacaactggttgaatacaggtaaaaaccttcccttgaaacacttgaaaatactagagaaacccttcacaatctcgtccaagagttcgtcatcagaaatctcatccaaatcatcgtaatcgtcttcatcgtcatagaattcaccttcctcgttaggttctttgttctccttggccttaatactttcaaagacgttcgtaagattctcttgaataacaccacccagctggaacaggtgctgctcgtttaggcaggaagcatctagtttttccaagcattgagcaatacaattgtagtatgcaacaattaattctggaactctatcagaacttaagactagcattaattgatcgatgcatgcatgccacaaatccatagtttgcttcgagttaactccagtggcttcaatgctgcattgaagcaacgatggaataataagagagcagactccacggactccatcatgcaaaaagaaaagaagaccggggatcacgatctcgtatgcaatttcgttcaaataaggatacatctcagtacccagaatctgcaaataatcctgaagggtttcaattgctgctgccttatcgtccaacaatgaggtatggatggcaatgaattttcccttaacctgaacaatgtcataatcttggttagtggccagttctttggcctcatctttgtcaacttctaaacgagattgttggaccttggcatccaatattaaaggaggtaggacaccgggaagacaagggaaaaaatctttgcctatgactttacaaattctgaaccaaccttgttgcaagtattgtttaacttgaggatctgattcactttcattattttggatgtcacctagaatacggatcagttcctgagaatgtggtaagaatttttctcttccaacagcagaagcgattagagtggcacattcgatagcctctgctcgtaaattggtatttgccaacgacgctaagtcagcagtaaggatattaaacaataaaggcatcatggtatcgtagtacttgacaaacttctgttcagctgcgtctgcaacaacagcaattgtggtgagaacctgttcttgaacatatctcttgggggaggaaaacacatttaacaagttggttaacaagtcatctaagaacggttcgagaacttcttttgacgcacattcactgaagttgacaatagcagcagcagcatgtgcttgcactctgaacgtgtgttgaggtgtcaacattccaatcaaacctggtaatattatagctccacttgtcttttggatgatattggcaaagtcagtggatatttggccgagggcgttacagcatgcgtattgaacacgaggatgttcatcctttaagcaagggatgattaaagaaaggatcttgtcaatctccgttatcagcacgtttctgcatccctcggctgccgaagacaacgccatcaaggccgcttgtcgctctcgccactgctgtgattgaagcatctgtggtaaaaactgaaaaagaggagaagctaaggattcaccaccaagcaccaaagaaactctgtccaaaaccaatcgagcggcattgtattcctcctcgtcttcgtcctcttgagaatcgtcactgtttgcccattcagcagcctgttcatcatctatggaaacctcagtcatcatggaaagggtattgagaatgacactgttagtgaaaagctcattagatttgcacatgttcggagcagattcagcaaaggtaggtaaaatctccattgcagctattctagtggaaccgtctaaatctttgtcctttgcaacggcagaaacaaactcaatgatttgtgtaaacataggtttgaaaatcttacaactcagctcaattagatcaatcaacgattctaaaatgctggtgagagactcttcatcaccgttactcaataaagtaggaagactattgagaatgctaggaagtaactctgaggccacgtttcttgagtccctgctcaacacacgaaatacggaaacaaaagaggtggaggcaccgacttttacctggttattctcatggtttagacctttgctaaaaacaggaatcatttccctaatgtaagtatcaccaattaactttggagcatcaatgaacactctaaaggccgattcgatcgtgaccggatcattactgttcgtgatgcattcaactaaggtgggaatcagcgtaggccattcattggcgctatccttggcaacttcactgatacagtcagccaatttgtgcctaatatggccaggaactccagaactcgaaacgaacccttgtagtaagattttctgaatttgagccttgacctctttgcttatgtgattaatctgtttgctggtaaagtcgtagtacggtttttcaaaacctttaccagttggggacttgatggcaaatcgacggaaaagaacacaactaaaagccctgatgtcgtcgctttggccttggactgcctgttcagctaaaaagagaagaagtacttctacttgttccttatctatccattccgtattcaatgagtgctcagcttgggcgtatatctgtttgtcaccagctccagttaacagtgcctgtataattgacagaagcacattgttgatttcaggtgggatgctagacatagtgttttgtgagcggaagggaagacaggttttttttttgaagtcttgatgaaacttccaactggtcgtgtctgagagaatgttgtagatcgattggaggggaaggttctagttggttcaagatggttctgctactgagggtgaaatgtgccctgtaattctttccaaacagcgtgtgagtggttcaaaaatactcagctgttaataggttagacagggactctggtctccagtaaaaatagtgagtattttgccacacagaaagactatgtcgcacagccctacaaggttctctgccactggacacgttaaaaataaatcgatccctcccatcgttgcagcttgtttcgaggccaaaacatgttttctttccactataattacataaaatttggcattcagcaaacatggacaatataactgacagactaccatcagtttggggagaaaaatatgtgaggttgagggcttcgtatcagaagctcctggataaatccacaccacatttgtacgctcgatgggccctttgttacgtccttgtttttgtgttcttgctccgaattttcttcagtgaaggctggtacgtggtgtgttatactcacgccatttacatgctgagtctgttcttacaattcctatcccctaagtttgatccgtccctggaacagcaacagcaggatgaactagtagaagatggtttacaaggcgtggatatcgaggataatgacgaatttcgtcctttcattagaaggttacccgagtttaagttttggattaaagcaacccaggccagtcttttggcgttgatatgttcgttcatacccttgctggatatccctgtattttggcctattctgctcatgtactttgtggttctcttttcgttaactatgaagagacaaattcaacatatgattaaatatcactatattccctttgacttggggaaggcaaagtacaataggggggccaaataactgctgaaacagaagaaaaggatacgtaccaatcttttcttttccgattcctttctcttgtgctatccatatgtaacatagtatagtcctgccaatgtcaacaagaataaatatgtcttcttgatcattgaaaacctgaacattgtgtcagttgctttggagacagtcttgaccagagacccatagtacgttggttttctgtagataataaatggaactgtgttcggtactgttattgtcaggtaaactggtttatggtcggatattgtcaattctggcaaactgttatactcgggctgtagatcttcttggtagtttaaaaacaggattctatcgcaccatgagggaattctgttagtcctaaaagtgtcctgtgttccgatgatgtatttgtaagtctgtgcgaaatgaattggagcttctgtgaaatctaaatcaccctttaccttttccagttcatcaatctccgagacgttctcgacttcaccaaccttgctgcatcggtagttcaaatctccgagaacaaaaatgtgactatctggttttaagacagaatattgatctgaaaagtccatttctgagagtattttattcaaatcttgatttcttcggttaaagttaacctctccttcatttgcgttcaaatgacagcttacaaaggtcaattctttgtcattttcgtcatcattattaatcacttgagacttgtaagcaactctaattcccactcctcctttcaacgagctaaaagcaacgcctctggggagataggaagtgcggatgttgtaaaaccggcttggccgtaggactaaaagagacaaagtgatcgcgccgttatgagtcaacccaagtgtgtgataagtaacttggtagtgctcggaaacccgctgaacaattgcgtcgttcacatccaacaggatttcatggactagattgtaatcaaatgaagtccttattgaggtaagttcctggaaggcgatagccactatttctggtggatcatctggaagggagttttccacggatttcgatagttcctctaacgcagtgttatcccgaaactcgtttttcccacaattgaaggttagaagatggatcctcatgtagagcttggatgagcaagtttggataaatgatctactctttgataggtaaaccgcgaaatttgtgggggatgaaacccttctactaatttctcttaacatgatttatgtattgatagaaatgaactatatctatttaataaacaaggacgtatttccagaagaagagttagaagaatattactacaaagtgtcatttataaaagctgaaaatgaagaggatatcaaactaagtattatgaacttagaaccatacgaaggaacttatgattactattttattataagaaacgaaaaagaagtagttataaaatgtagatcaaaaagcttctacagagaaaagaatatagggagtgtggagaatataaaagaatatataaaaaagtgtgaaaatggaagtataaaagaggaaattttagaactagtgaacaaaccaaaagattaccaagagaataataaagtaagagtatacaatcaaaaagaaaaaataatgaatgaatatgtagaatatctagaggaagaagataaaaagaagatttatttaaaagaattgaaccaagatatacaattttatttatattcaaaggataaaaattcggttggtataaaatccaaatgcaaaagtaacgattgggttatgagaattgaatggtctgataaaatgattaaagaattatataaacagaaggaatttaacttaaaaatatgtgaaaagttcgaagtaaatagaaagagaagatgtatttaatgttcttagttaatgctaagataccagatatagacttcttttattgtcctgaaacaaatactaatacttactacagattatcttttactagagtgaaaaatgaagaagaaataaaactacacttgtgtaatatgaatacagttatggatccgtattattttgtattaagaaatggaaaagaagtagtcttaaaagctaaaaacatggctttctgtagagagtatgtattagaagcaaatcaatctatggaagaatgtatagataatattgaaatcagtaatactagtcccgaagaagcaacaaggcctaaaaatccgcctattgaatatcaaaatgagaaaaaactaagaatttataatcaatcatcagaaaagaaaatagacttagactttttatcatattttgaagctagaagtaaaaaagaagcatacatgaaagaattgaaccaagaccatttaaatgacggtactttctatatatagaaaatgatagggctatataatgtgtgtgaataaacaatagattgggaattagaagttaaatggtcaagaaaccttctaattaccatgtttgaaacatatgtttttgaagaagaactctatgaaaagttaaaatataagttaatttttgttcttattctactaaggggtgagttgagaaagtcatcaacttttatgcgaaagtcgagccttctattctccacttttcatgatctaaatagaataaaaaacagctcattgttttggttctaaattacgatgagttctccatggagattttgttaaaaaaaaattgaactatcggaatatgttcccagcaatctaaaaacacccttttaattgggtggggtatgtgtaaaaatattttattcccgctatgctatgtgtatattaattcatacggtatccattatcgttttgtagtcatgtagtagttggcgtaattctagtatcgttagttgctcaaactgcttattgtgaagatcattctttttcaaatgaatcactaattgtaaaagctcgttggaagcaacagtgcaagagttactgtttctacgttgaccgattaatgaagttgcacgactacgtgcatttttgggagtcaacgacgctgtaacaccttcgttaagcgacgtacttgatggagatgctgataagggtcttaaatttttcatgacagatgaggttagtttggacaataatcgatcatcttcatcggtagggagtggttgggcaaaacggcccaaaaagcttcgtagattgtaactgtatggcttcttttcatgggccggtaaagctgtgatggctggatccgacagtccaagatcttttgctgtgacgttaagtaaaaattccagagctgcttggaaattggtgaggctgtaggacaattttccgtgttcttgtaatacgtatgggttggaaaatcgtcgtatgtagtgcaattggagaaacaaatctctgaaaaaatagatgcaaacaaaaatggcaagggctaacgatgagtccccgtctaatgacaccactgaattgatcaagtcgtggatctgcgctagcgatgtgattttctcaaacgggcctctctcccttttcaatcgtaccaatacacggtcaatgtgagctgcactcagtttcttcactaattgctgggaggtaccttcacagctcaatgccaattgctctagggacaagtttgacattcttagcctatccaactttgtgttgagatttacgttgatctcggcatcagtggcgctggatgaactagagtatagcttagagtagaacagatcggtcaatctcttttctgctctttggtcgtacaagaaaaccctgtctacagggcgtgcgaaaggcttgttttcgtccgttgacaaatcttcttgggatgaagcgagaggcgtccgggaaataccattcatttgctgagatcccaccaatatgacggcctgttgatggtactcgtcataaaaagtttggaataagctaccaatctcgtccagcgttaagggtttatcaaatttgggctctctcaatgattgtatgaaggattcaatcctatcgttaagagctttctctgtgtcgtcttgctcataggagttgaccaccgattggcttttgtcgtgcgattctcttatggagggagtatgaagcattgcagccctagtcgatctctatagatgaagaggcaggatactacttggatagacgagccaagtggaaacttgaatcgaaattgtgaggacagacgtgataatctgcgacttggtgtacagatgattaagctactttaggtttcgcgaaactacatatgtgtccctagactggcaggttaggtatcttagataagcatcgttaatttaagatattcctcagatcggacataaacaagtctccctaccccaggtacaataaataggaaaatctacgccaagccaaccgccaaaaatattgtctcatatttttgcaaaaagcttccaggttgtacctaattacggatccgaaagtatctacataagtgtggacactcacaacctgtttatacagtttggctcctacgaaggttagccaggttcacttaaaagccctactttgtccaagctttcgtcagtgacctgccaaccctattcggtctcgccacttgattggttcatccagtttcacctcatttttagtggtttatcaatctgaaaggaatccatataagcgaccgacgaaaaaaaaaaaattaaaaactccggtcctgtgcaatcagccgaatctccccaaccccgatcatttattagagcgccacattttaaaccgttgttgcatctgtaagggtcagcaacttttggaagcaaaacgcacagcgctgattggcttaatctcaatttagtgcatttggtacctcattctaagtgaggtcaggccatcgtccatttattcccgcccgtgcatttcctcttcggttaattttaattttagtctggattctaatttcggttgtcgcccacgctattgtttccttccacccagcctttaaaaaatttgaaaactccttcgcgacttccccaccataaatttcacccactgatagtttcctttcaactatctgatgataccaaccatagaccccaaggaccctgagttggtttctgaagatacggcacagtccgcttctgcccggaagcgttccaaggtatcgagggcttgtgacgagtgtcgtcgcaaaaaaataaagtgcgatgccacttttttggccaattcgaataccttgctgaaaccatgtacaaactgctacaaatacaactgctcttgcagttttaccagagtgcccttgaaaaggggtcccagcaaaggattcgcaagagatggttctgggtacgaacgcaggaggtcgtcatccgttcattcagtttcctcttcgcagagcgtaacttcaccagttccctcccatgcttcgctccctattcctccagccaatcccgtttccttaccccgtttgaatgtgccaggagatgggcttctgtctccaaaggcagtaccgccaacaaatttgttttggaaggttccatacgaactcccatcctttagtgatcgaaggtcttctgtggcttcggctgattcttttcgccgcccatcaatctaccaaagtgactcggaggatgatttctactctgcaactggatctcagcggaactcaatatcccaggcacctaggcaaagaaacttgtctcctgcattatctgtttcaagtacttccagtttaaacaataggataaaatccttaaatatggtggcatctactttggaatccaatattcacaactactactcccaaggcttcaactcaagtcttccaattttgccgcttgacgagcggattctttctacccttctttccaacgttagcaatgggtcttcatcggcttcttgggatgcgataaggagtcccatactggaactgttcgacaaatctatcttaatgcttttacgttcctatgagagccaattcaatttcaatgacctgctagaccatgtcactgagatgcaatctatatatccccgcataagatctcatcttttatccgatgaacttctcaagctaatttttttaatgagcggggttttgactgattatgctctcatattaactggccaaccttactctactggtttatcgatcacagtttcggttttcaatgactggaaaacgtacgagaatgtgcagagagttttagtgatcaatagggcgggttccttagatttagattacgattcactgccctttttgtttgcccgttgttatctctctttggcaactttggatttgatttactccctttccttttcttcgccacgactgatatcatcttttgctaatctgcccatcttagacattgttcaaaaatgtggtatcactaaggatgcgaaacttgatgaaacccctcttccagtacttgaccaatttctgaattgttttctaccaggtgacacgtatccaacagctttgaacaccctaaagactggccttgttctattagacttcaccaataatcgttcgacaacactaaggttcccattcataaacatacatgatgacaatcatatgacaggcctaagccatttgttatccaacgtatcagatttcatgagccagttcactgaagttcattctgattccaaagattctcaattgctcttcttacggtgcatctgggcgttttgggaaataggctcggtcctatcagagctaatagatcattttatttcctcaagtgccaattcacaagtaggtgacaaggatgcaagttttttttacgaacatcaactaaaagtgactacattgttgggcactttttccaatattgcaagcgcttttttgacttccagtacaacagctgcttcacacccacctcccagtatttcgccatttcatattatctcaatggtagagtccttcaagatggtgcagtttcttaacaaattaatagcatcttttatttcattgaatgaaaaactggaaaaacgagagttggaagacgaactgtccaagtgtaaagaagaattaaataacttgaacgaaagatttcaagctgtttcatccgtacaaacacttcctgttgttcatgtccttttccgtgatttggttttttcctcaaacagacttgatactcaaagggatagagcttcttcggtggtgtcagcaacaaccacaacatcaactgctacaactacagcaacaactaaaaaatcgtctttcgggaatcttctacattcagatgaggagaacatactacctacagttatcgattggtgcaaggaacaaaaacacagcgctgaaatgtttctaaacaaaaacgatctaaatggctggctttattaaacgagagtattactttttatgaaagtttgaagatcattgatcctcaacttgatggaagtctaaaatctcactgtacatcattactcgccaagtgtctacaggtaagtcggcatcgttgaacgaccagtcgaacttctctgctgccacaggctcatcagtagggtcatggtagggctccaagtactcgtgggccagagactcctctgcagtgattctcttacgtgcatcaaataccagcattttttccagcaaatcaatagcaacaggctccactccctggaaccgttctattaaaggcaccggttccctatgaggcagactctggacaaaccttagtgtgttttcagagcaaatagtatcaataacgtcagtgggtggagatccaagtaactctgtaataatactgaattgattgatatgatctttaccaggaaacaaaggctttccttcaatcatctcggcgaaaatgcaccctgcactccatatatcgacctctgtatcatatttctgccatgtcaacatgatctctggggcacggtaatatcttgtagaaacgtaaccggtcatctgatggtcctggatacgagccagtccaaaatcacatattttaaggtcacagttttcgttgataagaatgttgcttggtttcaagtctctatggataactccggccgagtgcacatatttcagtgctctcaatatctggtacaggaagtactgtatgaactgtttttccaacggcctgcttgtcaacaatcgatgcaagtccgttccttgtaactccgtcacaatataaatatcctcaagaggagatagaaagatgtctgttagtgtaatcaaattctcatgtctcaggtgatttagcaacttcaactctctgtaagttcttttggccaaaacaggagtggaaaatggtttcataatcttcttaattgctacttgttgctccgtaagcttgtccttggcagaacagactaaaccaaaggcgcccatacccactgggttcaactcatcgtacctagcggtggtctcaaagatcgtaccaaatatctgagttcttgaggaaagctggttaatagctgaatggttaagttattctttggttacttaccttgtgaacttctcttgggacattttgaagactgccggtttatcctctgtttagagacgaagaaacggcacgaattccaggggccacattgaaatgtcctgtcagcgctcataactgctatcaacaatcgaaaataaactacgtcatatcgtattcgaggttactgaatattactctatactgcttgctatatggggtgatgtcagggttaagtaagcacagatctagttaaggtaattcacgccgtcgaatatgctgcccttggcaaaaaacccggtaatagtcttgaaacgatcggagctgttttctagggcaactgcgaacaaatcgttcctctgactcacttcttcctgttccttccgtaacgctgttatggtgtccgttttctctgcgcatttcggacactccaactcggatcttaagtgtttactattctcatactcgctgtcgttcagacaccgttcatggtacgagtgatggcacaaaaagtaaataatcggaagatccaagggaagtgaacatgaatggcatctagtattctgcagagtcaccggattatgcttcaagtcttctacctgagcattgtctcgttcgatctgcttcgaatagtggtcgattaatttttcattgtttaaaatctcagtcctcatagcggtaacataacgtagaagatattccttgacaatgcctacagtagctatactgttttcaccaagtttttgcacaatttggagaggcgtcatgaggtttctagtagtgattgtgtctaataactgtttaaaagctccactttcttcgacttttttgaatatatcaggatcactgatatagtagcttaggcctagtcggtataactctggttgttcttcggcatactcttgcaaaatactctgaattgactgcagatctccgttggacatcgccgatcgaaataggtctatttcaaatcccacctgttgatcccttacgagcatttctccggcattaaacccgtataggttagaaatcaatatgatagaagtttcattcatttttgctttattattcttgatcagtgtcaatgctttttcttcccattcagatttctgatcgggctcttcctgagccatcgtcagatatacttcatatagtgttgtcaaaatatcgctccgatcctggtcattgccaccatagtaatcatgactctccaagcatgcttcaagaaatatgatgaattcattggggtggtcaatgaaagaggaaaaaatgatactgggtcttggagggagataagtgggtgaaatatcatccttttgttcattctccgacgttgaggtttcggttaatgatgccatatatgatacaaatgcttgatagctttgtaaaaccggaaactgcttctcttcaggttcagatattttttcttcctgagaaacaggagtaggtttgaacttgcctgtgaatacctcaatcaagagtttggttgtggggtgcggaaggcgagttaaaaatggtttcaaatgatctagtaaaactctcaataagtcttctatttgcaacgttcgcaagtatgcgagtgttgattttgttttattcaaatcattcagttcaatgtcaactacaatggacggctcgttaaattgtttagcaatagtcgaagcaacttctaagtagtcgctctctctgcagagatcaatcaaggtgaagagatcaaactcaacatctgggtgtttttgaggaaattctaaaagtttgtcaatctgtttcagtttgcaataggaacataacaataaagtgatatggtcttttcttgcctggccttcttcaaccatagcttctaggtacaaagccagtcgtgatatttttgaactatccttatactttgcaattatttcactggttttcccgagagccaaacatttgatgtactcagtcattgcctcgccatatgattgttgttcatataagtaatctccatactttctgtgaacagttagaatatcactttcttcaataccagtcattgattgagcaagccttatggcaatatcgtacaaatttcgggaaacgacaatatcgagttgagctttctggtctagttcgtgtattcgataaagaactccgtctgaacccagcatatacacatcatcccatagaagaaagatgttgctgatagcagtttcaatgttctcattaagggcgataaacatgttgatgacatctattatcaacaatttgtgatcgttggaaatgatcaagatgtattttccaaacgcaaagagcttttttttggatatgtccaaagcaatggcattcgatttacctctggttgaatagcattgtaacattgagtcatttcctacgacaagatgcctcttgtggtctaaagtacagcagccgatgtcaactccaacacctctatcaataatcttatcaggtttcccttgattcttacctgttgttggtatagtataaatcttgcttgtggtggttagatacaaagagttttcgtccttgaacagcaagttggtcactggctcattactctcaaatactagtctctgtctggttcctttatcatgtagtagatcccctctaaccaagataacactcccattactaaatccaaaacataggatggagaaattattgcagtgagtaaatgcagtcatggggaaattattgttcccattggcaatctgacaagaagaatggaattcgaattctaaagactcatccgatttctccatagccatcagctttttcaaattccacagtttgagagtcagagggaagccctgtctttcagcaattgtacacaaaaaatgagaatcagtcaagtaaaccaagtgtacgatattccatcccaattcgtatgctgtgaaatcgaattttttaatgtagtctttagtgatcagctggaccttgttgaatgcagtggcaataattagatattctggggaagcacatacgcttgtcaaagaaggatctgagtagagagatttttctgagcccaaattgggatccttgatgggggttagttcaaagaaggagaattgtctccaacttgacagtgacattattagtttggagggtgtatttcagccatttgatgataatgatagaatcgcgcaccaaactccactgtctttacgtctaccctcgaaagaacttaatacggaatttccccctcatcgcttgttactttccggaagcgtgtttcacaactgcttcactatcaccatgagctgtcttatatatagagcgggacatctttcaggtggataagccaatgcctcaccctcttaccattgcaagcaaacaatatgatcagagttggcaccaggaacttaacccctacgctttatccttctgggatattgccagatctggggaacccaactcgtctagtctttatcggctgattcaatatgaatgctcctactatatgagcttaaacagatgcatctggatatacaagaggaactgcccattgaagaacgagcagcaattgagcttgtttaataacctctcaacaatgatggatctcagtttacgatttcttcatgacatttacacggaataccatggaataccaaagttgctggagacctttggaaacctatcatttgtcaaagatcttccaggtaacgtttctattgatatttctgcaattttggagactcatcttgttcgaagctcagctctgtatgcttcatatctcacaaacagagacgaccaatactggctatactgtctgattaaggattctgcttcccgttggttgacttctcgaaacaagatatcaatcgaaatggatggttatgatgatttgatggcctacttgagagaaccagctcaacttgggataatataccaagagtatattgaatccttggaagatgatgaagtaaggaacaaactactgtcttatatgagctcattcaaagctgaagaacgagaatatttcaaagttgacgagattattgatgatgcactcgaaatagatagggtcctgggtgaattacaactaggtgtgaaaaatacaatggcttgcatccaacaccattttgacaacaatctaaaagtttgtcagtattttcagcattgcagcaaattgtcaaacacatccaatgtcgaatccaagtacattgattcatcatattcttgttatatggacaagctaaaatctcaacagcaacaatttgaagaaatatttgaaggattcaaaatgaatttacaaaatccgattgaccaattcttggccatctccaaccatttcaagatttggattgaaaagtatttgaagtatagcaagaagcagttcaagtattgggatcatcttttagaatcaagagataggttgaagggcttggaaccatttctggagcttagcagaatgcttgtttcctgcatcccggaattgtatgtccagctcattactgattttcttagattgaccaccgctggctcaaaagtttacacatacaaacaattgctcagtctctttgaggcacatactagactgaacaaacaagcaatactcaaatcagattcgaagcttattcaattttcaataggagaaatgagcactacaatggttttaccttcaaaacacatgtgggacaggcaagccagcctgaaacaatagacaaaacaatagaatcaagagtgcacgattttttcgtgcatatctattggctggtgaacactttatgaacctatgtttcggaacttgtcagaaaattcggagagcctttggcaaccatgtattccgtcatcggaaactaattttcatcaaacaatttccctaatctgattcaattattcggcatgctaataccgttattataaccaattaaagtagtaacttcccaaaggagattttctcgcgattgcttttcctgttgcacacgataggtaccgaacaaggcgattttctctccataatacatttcgaaacttgaaccaattgttgttgaaaatgtctgaatcaatcgaatcaaagggccctcaaaccacttgctgtggtggtaaatgcctcagccagaagtctgcatcaattttaacttggaagaacccaattaagactggtacggtctttgggggaatcattgttgcattgttgctgatccgatacgttaatgtgttcaaattggtctttagactggctacttatgtactctttgccactgcaagtgctgaattcataggtaagattgctgtcggtcagggattcattagcagaatccgccctgattactttgcaaaactctccagtaaggctcctcttgtggctgatcacgtcgccaagtatctgtctggatttgagttgaagtttcagcaattgctttatgctgagaatgtggaaaacacattcaaagctgctggtatctcttacatattgtacatcttgacaggattgatctctgtctggtggctgttatttgtgtccacccttgtggttttcactgtacctaagctgtacgaaatctatcagaaagagattgacgaagccgttacccgttatgccgaagttgcaaagaacaaggccgacgacttacagactctagccattgagaaatcaaagcctttattggataaggctgagacccaattgggaccagtaggcaagtacgtcaagcaagctttccctgtcagaactgcatccacctcagccaaggctgacattcctgctgaaacttctgagaaggaagtccctaaatctgctgctgatgtgaaaatttcggagactgcctctgagaacataagcgaattgccatccgctccaaccaccaagttggaagactttgttgcagacgttgagaagaagactgatgagtcaagagcagaacttgctgctgaaggagttgctttgtagtgttcgatctttcgagttatattattatactagtggaaatataattattttgtgatggattgtgtaagaacaataagttttcacatggaaacgcaatattaaggtttacccattgaattagatcagactgtgaaacaaatcagcctttttaaacaggaaatgtaacaatctatcaattggaagtttcaatggtggtttttgggcgcctgagaataagctcttactataccaccactctatcatttaccaagactgatttgcctcagggcgtgtggtctagcggtaggattctcgcttcgggtgtgagaggtcctgggttcgattcccagctcgccccgagttcaattttttctaagaaatcagattcgagcatcgaacgttttttcacaagtttttttcttgatctcaaaaaaaatttcaaatcatcgttttcagcacctacacagattacaaacctaatctcatcagtctcccgtccaatagaagttgccccattaaagccgacctcatccctcatacgagggcaattgtcgtacatgatgtctccttgttcctcctcctgcatgtaattaaaggtcgtttcttttttctttaacggactgatccccctgaaccaagtgctttccgctaatgccctcctagtgttcactgctcaaatctcatctttgtttcgcgtcagccttcatccctacttttgtcagcgtctacatttgaaaaaaggtaaacaaaatcgcgacgagattgtttcaaatgcagcctcacaggaggagatcgagtctcgatgctaccttggcactaggtatcggccttttagtgggccaaaattcttccctgttttctcttcttccttttcttcacattttgacgattttcatacaaaaggtcactatatccttcactcactctattttttaagtgtttttcccacactagtcattccttttatcaaccatgcaagttaaatctatcgttaacctactgttggcatgttcgttggccgtggccagacctttggagcacgcccaccatcaacatgacaagagaggtgttgtcgtcgtgaccaagaccatcgttgtcgatggttccaccgttgaggctaccgcagcagcccaggtccaagagcacgctgaaactttcgcagagtcgactccttcagctgttgtttccagttcatcagctccttcctctgcttcttctgcttccgctcctgcctcttccggtagcttctccgctggaaccaaaggtgtcacctactctccttaccaagccggtggtggctgtaagactgcagaggaggtcgcttccgatctttcccagttgaccggctacgagatcatcagattgtacggtgttgactgtaaccaagtcgagaacgtcttcaaggccaaggccccaggtcaaaagttgtttttgggaatcttctttgttgatgctatcgagagcggtgtcagtgctattgcctccgctgtcaagtcatacggttcttgggacgatgtccacactgtctctgttggtaacgagttggtcaacaacggtgaggccactgtttcccaaatcggtcaatacgtttctaccgctaaatctgccttgagatctgctggtttcaccggtccagttctttctgtcgacactttcattgctgtcatcaacaacccagggttgtgtgactttgctgacgagtacgttgccgttaacgctcacgctttctttgacggtggcattgctgcctctggagctggtgattgggctgctgagcagatccaaagagtttcttccgcttgtggtggcaaggatgtcctcattgtcgagtccggatggccttcaaagggagacaccaacggtgctgccgttccttccaagtcaaaccaacaggctgctgtccaatctctaggtcagaagatcggttcttcttgtattgctttcaacgctttcaacgattactggaaggccgatggtcctttcaacgctgagaagtactggggtatcctagactcctaagcgatggaagcctgatcttcgattcttctcttttgttgtttttattttgattatttctgctccgaaatagtagcttgataccactgttagcttttttttataaaatgtgtattatttcatgggccttctttcgttaactccgattagttttttcctttactgtgtggttagatcaaccttgcatcgtctgaaattccatcgaaattccttcgaaatacctcacctcatgtgtcatgtggtaaaactgcatgtgtggttaagctagatactctatgtggcaatatttggcaattccctgatctggaaattctcgcgggtctggaacagagtgaaatttgaaaattttgggatgttggccagatggaaagttgaattcagaagaccgcaggttcgaagctaacaatgtgattttattattgtttttaagtttattttttctcaaatttttctctatattttttttctttgtaagacaggcaacatcaatagcacacaactgatatgggattggctgaaccaaagaatagacaacgctttgggttagacccaagaaacacaacatggtccaacgatacctcccgatttggccatcagcatctggaaaagctgggctggacacctggatcagggctggggttggtttctcatgccacaaccacacacattaaggtaagagtcaaggatgataataccggattgggagccaagctggctcgtaagaataagaaggatgagtttgacagcggcgagtgcactggcttggacgtttttcagagacttttgggacgtttgaacgggaaagagactgagataggcgacgaattggatagacaaagaaaagagaatgtgatcaatggtaaatggggaattgcgtttgtcaaaggggagaccttgcaaagcacttgggatagagaggccaaagcgtttgttttaaggcgtaagaggcgaataagcgagagtatagaggatgcagaagtgcagaggaagttgttaaagaaggaaaaaaaggaaaggaaagaaaagaaagaaaagcaagataaaaaagagagtaaacataaacccaagaaggaaaaatccgaaaagcaggccaaaaaggaagctaagaaagaggctaagaaagaagccaagagagaagctaaaaaggaagctaaaagggaggctaaaagggaagcaaaagacaacctgaaacagcaaggacttattgaaaacacagtcactaaagaaagcatgctgctgccgaaatcaaacacaaatataattgcttcaaggcttgcagtgagatcaaggtggatcaaacagaaacgtgctgcggttatggactccaaagccctcaatgaaatattcatggtcgctcagtaaaataaataatgtaccatattttctatttttttgaaaaaaattgactataaaagagtgtaagtgaatcctgaggtcacaaatgttacaaagaatgcggccattaataattctgatccagactttggcttgtgaataaatgcagcatcatcggattcagtggaagtggcgtcggcagatgatccagatccagatccggtgcctgagctgcctgaaccagtggcagttctactggagcttggcgcggtaccaacggtggaggcagactgcaaaatggagacacaagaggaaacggcagtggtacttacgatcgaggcagagccgtcaaagtcacaagcagaagaggcaccattctggtcctcgtaatataagttcaaaacgaaagaaagtttctccttggcatcacagaaagagtaaggaccgtactcaccaatctctgcatcggtgccaatgtctccacactcaatacgcgaacaaacgtagttaaaaatgtctgcgtagtcttcaggttcaacgtcgtcagcaacaacacatgcaagtgtattttgcaaacactcacatacctccttgtttggagttggaggaagatcggtagatgctctccagttgtttccggttggtggacattccaattcggtggcggtggcagaaacttcagattgagtagcgagcgatggagaaatagtggccaattccgatctaaggtagttaaagtccgaataggttgaaacatctccatcgggttcaatagtaaccaaaccgtaattgttttcctcttcgaaatacatgtaaacaatacctccggaccagacatcagtcatgttttcaccgtaaagggcttgaacttcagtaaacagacgtggttgaacttcgttacaaccatactcggagaagaagagaggaactgaaaggtttctgaagtcttcggttctatcgtcgtatccggaagttgtgaaagaagatctaccacaccaggagtagatgttgtaaccgtagaagtcggccctaacgtccgagtcaccacaagcaaagtagttagcggaagaaattcttgtcagcgcgtcatcattggcagaataaccaattggaatttgtctgtagccttggtcttccatgtaagccttcatatcacggattgcagctttgacgaatggagcagcatcggtgtttgatctgtttgtgataacttcgttaccggcgaaaaaacctagaacgttgtcgtactgttgcagttcgtcaataactgaggtgtaacggtcatacaagtgaacatcccaggccggatcagtggtgatgatggaatcacctggttcagaaaggtcagcaataacgtagatacctgcttcttcaagcaattgcatacactcgtcgtgatcagcgtctacgtcgatggcgtagacacggatgacgtttgtgtgtaactcctctaaataagggaaatcacgcctgcaggcctcgacattggccaacggatcaatgaagttgtcgcctgtggtggagttggatgtatcctgttggtaggcgatacccttcatgtagaactgggatccattattggagaagaagaacttgtttcctgtgacctctataggtggggtcagatctgaagcacaagacaggcccagcagagttaatgcacttaaaatggacaacattgctttggggtgatacaaagagtggattgaaaggaaaaaatagggaaaaggaaacaaatttatccaaaaggaagatcagaataggaaaacaatctcggtagcagttttgccaagacattcacgcccaagtgggtgatttttcaggatgctaaatatatccacgcagggtttcctaattcggtctattggttgaaaaagaccgagggttgtgacgtttctgaaaaatttaaagagatgcgaaacttgacagcttgagcgtgactttcatagacagggtccatgatcatccatatgggtcacggatggagcagcgcacatcggtcagttagcgtgattttgttgttgttttgttattggacggcagagagcgtgttgcagaaagaggctgggtacaacgcgaacgaaaatcccctcgatgttggatggaaaatggaggcttagacttcggagggggccagaaggagtctagatgttcaacagagtagagaaggagagtactaaagatttgagtgtcaaactttttcaagactgataatgcgcaaccatgtgatctacaaccacactgcttccttggctccttgtcttaaaaaaataaccatatcaattcataccatctattgtacgtgcgttgtcggtacggattgataccttttagtctttccaccctctctttgagcgtaactgtttatgaatcttgtgtgcctttaattaatgtgaaccgcttagaatgacataatcattccaagagctacggaaattgacacaagcccggtcattgcccagctggagcctgaggcaccaccaccaactccagcattgcttgaactagattgagaagcggagctggactttgaagatccagaattggatccgctctgggtggcagcttcaaccgatccagtgataccagtaatggatcctgttccagcggttcctgcagcgctaaggatagaggagcattcggatgcagttgtacccgagactaaggtagcagacccactgaagtcacaggccgagctcttggccccattctcagagtagtaaaggttgagcaggaacgatagcttttctttggatgagcagaaagagtaagaaccatactctccggattctgaatccgcactgacaccgtcacaactggagacattctcacagacgtagctaaataggtcagagtaatcatcagtgtcgacatcttcagacacaacgcaggatagcgcatcagccatgcactggcaagcagcctgttctgggactggtggcagatcagtagaggccttccagttgcttccagtagcaggacagtcaatttcggtagcagtagcagaaacttccgactgggtagcgattgatggagaaatgctggccaattcagttttgagattgttgaaatcttccaaggtagaaacatctccatctgacttgatggtgactaaaccgtagttgttagtctcttcaaagtacatgtagacaatacctccagaccagacatctgtcatgtcgtcaccgtaaagggattgaacttcagtgaacagacgtggttgaacttcgttacaaccatactcagagaagaaaacgggaatagacaagtttttgaactctgcggttctgtccttatatccagagttggaaaaagtagcctttccacaccattcgtacatgttgataccatagaagtcggctttaacatcggagtctccacaagcaaagtagtcggccgaggcaaccctggtaagttcgtcatcgttagcagaatatcccacagggatcgatctataacccttgtcttccatgtaagttttcatatcacggatcgcagccttaacgaatggagctgtgtcagtattggacttgttggtgataacttcattgccggcaaagaatccaagaatgttgtcatatttttgcaaattgtcaagcacagcagtgtaaccgtcgtaaagatcaacagtccattcaggatcagtagtaatgatagagttgtttggctgggaaaggtcggcaatgacatatataccggcatcttgcaacatttgcatacaatcatcgtgatcggcgtctgcatcgacagcataaacacggatgacgttggttccaagttcttccaagtatggaatatctctctcacaggtactcttgtcagctaaaggatcaacgaaagtggcgtctgaagagagcccagatgtgtccttttggtacgcaacacccttgatgtagaattgggatccattgttggagtagaaaaatttgtttccagttacttctatagtggggaaatctgctgccaagactgaactcaataggcaggatcctattaacatgcacagagatttaaacatattttgattatctttgtgagacgcgaacaatctgaaaacttcctgggtgagaagaaaagaacgaaagttgccaatctggatttatatatccaaaatggaaccgttttgtcggaaatagagagttgattcaaaggtccaggcattggccgaatcaggaaactcgacgaagcggtttattgttgtgcgcgttgagcttttcctaaagcggaggtatatctcaagaaagcttgtacatgcattttcttccgcgactgattcagagtgatcttgagtctctatttttaggtgtttttttcggggcatagccaatcttccccgatgcgattaattcgacgcgtatattgagaaacttttcagggaaggagttgttcttacacgagcagtctctatggagacaacagttccgtttcttctttcaggtttttcattcctttcgtatgcatgccgttgtgatgtctccagttttgcgcagccgtgaatacatcacaggaatcactaggctattcagcgcatatctgtacttggccatgtgttgattacagctccgactactttttggcctgccgacgtcatctccttgcgatggttaaatgtgtctcattccccaggatgctaagccaaacattatgcctgttatgcatacaaagctcgccgcacaacatcaactctctattgacacaaacatgatttggcctaacatttcagttcacacagagttgatatacagtaaccatacctcctacgccctgcaatcctttccctcagatgattagcaatgagagtcaagaaatctcggatcagccagagatcgaaactccatttaacgagccgtactactcttgggtgtctaataaagagagccctctaaccaaagaagaaatcttaagcatctttttgaagttgggaaacatttttggttttcaacatgattctgtgatgaacatgtatgatcattacatggttcagctcaattcaagatgtagtaggactgaaccccatgtggccttggtctctctccactcagactacattggaggagaacatagtaattaccgtaaatggtactttatcacgcagttggagtttgatcctgactttgaatgggtgttgaatgacaaaaaatccaatcgcaagagcatgtacaccaagaaggatacagattacccagatgagtactcattggccaatttgaaagcgtccaatctcttcaacgctattcagtatcgttggaagcagagatgctatcaactctctacttcagacttgactgaacaggtggccttatatcttctcatttggggagaggctaaccaattacggtttatgcccgaattaatctgctttatttacaagaccgcattggattttttgaacttcacaaaggcaaacgaagacatcagtcttttctttccagaatttgattatctagacagagttgtcactccgatctataactatattagggatcagcaataccatctacgggaaaattgttacgtccaaagggaaagggaccataatagagtgatcggctacgatgacgttaatcaattcttttggtactatgataactataagaaactgcgtcttttggataaaacaaaacttatcagtttgccgtcgtatgaatggtattcaaaactgggtgaagtaaaatgggagaaagtattttacaaaacttataaggagaataggtcgtggtggcatttggccactaatttcaaccgaatatgggttatccatttatgcatgttttggtattatacgtgcttcaattcaggaacgctttacaccaaggactactctcaattgctgaataaccaaccaacaccggcagctgttttatcgtcctgttcattagctggagtcattgcctgtttagttcaaattatagcagtattttgtgaatggacattccttccagctacctggttttatacaaagaccatcattttgaagttactgttaatgttcttcttattttgcattaatctggcaccttcagtttacatttttggatttatcccactagatgtattctcacacaatgcatttattttgtccattgttcagttcgtgatctcaattataaccgtgcttttttgctccattcaaccattgggtagaatagtgggatgtttcaatagaaatcaaatatcagctcaggatatctttactgcttcgtacccaagactgagcaccagaagtcaaattttatcccacctcatctggatattgatctttggcgcaaaattcacagaatcgtattttttcctgactttgtcattaagagatcctatcagaaacttgtccaacttggagatgaccagatgtatcggggatgccttgattggtaaagtgctttgccaacatcacccgaaagtggttttagtccttatgttcttgacagatcttatccttttctttttggacacgtatctgtggtacatcatattcaatattgtgttttccgtaggattgtcattttctctcggaatatcggttctctctccctggagaaacatcttcactcgattacctcaaaggatttattccaagattctatccacgtcagaaatggaagtgaaatacaaacccaaggtgttaatctctcaaatttggaacgccgtcgtcatttccatgtatagagagcacttactctcggtggatcacgttcataggctggtttataaccaaatccccgacgaagctgatggaaggacaactctacgacagccgtctttcttcgtaagtcaggacgacagttctctcactttgaaagactacctcatccctttttctgaggcagaacgaagagtttcgttttttgcccagtcgttatcaacacccttgccagaaccggtttcaacccaagcaatgccgatatttaccgttctagttcctcattatggggaaaagatacttttttctttgaaagagattatcaaagaagatcaaaactctagattgacattactggaatacctgaaacaaatataccccatagaatgggggtgctttgtgaatgataccaaattaatggcccatgcaactggtgattacgaatttcctgagcttgatatgacaagcaaagaacttgaatcaaggctacttgagagtaaaacttatgatctgccattctattgtgttggatacaagtcgtcatcacccgagtataccctaagaacaaggatttgggcttctttgagagggcaaactttgtatagaaccgtgagtggattcatgaactatttcaaagctgtgagactcttgcatcgtgtggaaaatcctgatatcctagaggatgtcattgaaacagaatttctagaagactacttggattgtgttgccaggaataaatttcatttgatagtatcaatgcagagataccaacaattttctgaacgagagatggaagacaccatggctattttgaaagtttatccagatctcaaaattgttagtcttgagaaagtagaggttggagaagaatgtttcttttattccgtcctttattcaggtagaaataaaaatgaagacggaacattggccccagtatacagaattagactatcaggaaatccaattttgggggacggtaaatctgacaaccagaatcacgctttgatattttatagaggtgagtacatccaggtgatagacgccaatcaagacaattacttggaagaatgtctaaagattaggtctgtgctggctgagtttgaagagatggagattgatactacttcgccctacattccaggagttgctgataaaaataacagtcctgtagcaattgttggagctagggagtacatattctccgaaaactcgggagtattaggagatgttgcagctggtaaagaacagacttttggaacgctttttgcccgtactcttgccgaaataggtggaaaactgcactatggtcatccagattttttgaatgcaattttcatgactacaagagggggtatatccaaggcacaaaaaggattacacttaaatgaagatatctacgccggaatgaatgctttgatgaggggaggaagaatcaagcattgcgactactatcaatgtggaaagggaagagatcttggatttggatccattcttaacttcaccaccaaaatcggagctggtatgggtgagcaaatgctgtccagggaatactattacctgggcacacaactaccactggacaggtttttgtcgttttattatgcccatccagggttccacatcaataacttgtttatcattttgtcagtgcaaacgtttatgttagttttgttgaacctgggggctttatcatacgagtctattaaatgcatttacgataaaaatgtccctattaccgatttacaaatacctattggatgctaccaaatcacgcccgtcctggattgggtttcaagatttgtattttccattttcatctgtttttttatttcatttgcccctctttttattcaagaactgattgaaagaggagtttacaaagcattttcaagacttttccttcattttctatcattatcacctttattcgaagtgtttgtttgccaaatttattccaattccttaaaaagtgatttagttttcggaggagctaaatatatttctacaggaagaagctttgccattaccaggaattcattcactcacttgtacgccaattatgcaccaacttctatttattctggcgctagactctttttggtgctcttgtttgcaacactgtcaatgtggaaacctgcgcttctttggttttggattactttagtagccctgtgtgtctccccatttatatttaatccacaccaatttgttattttggaattcttcttagactatagggaatacatcaggtggctgaccaggggaaattcaaaatggcaccaaaattcatggatagggtttactagaagtggaaggtcgagaatactggggaccaagaagccagagcgtaaccaggactttactcacgctatcagtatgacacaccggacatcattagccagtactttctttgtggagctaataattcccattattcaggcagtagcagcattcattgcatatactttcgtaaacagccagaatggtgtcaagaacgtagaagctacacattccgtaataaggatcatcatagtcaccatgttgccaatcgtactcaatattgttactcttctggttgtttttatcttgtcttgccttacaggccccattttctccgtctgttttaagaacactgcaagtttattggcaggtattgctcatggaatggggttgttcaatcatgtgcttgccttcctcgtactatggctattagaaaattggaattttacccgaaccctggcaggattgatctgctctatattcattcagagagcaattcttcaaggagtaaagatcttattactaaccagagagactcttttggacagctctaatagggcctggtggtcaggtaagtggattggaagcggattgggagtgctcattttatctcaaccattacgagagttcctggtgaaaattatagaacttagtctatttgcggcggactttgtaataggccatacaatcctattcgtcatctccatattcttgctggtgccttttgttgatcaatggcatagtagtatcttgttttggctaaaacccacaaggaagtaccgtggaagaatctattccctcaagcaaaaagcacgtagaaggaggagtgccattagatacttcttaattttcattatcatcctaatagtgttcgtgggattaatagtgggacctattgtctctgcgaagtttattccaaatatgcagcaattcattccggagcaaggccatggtcttttccagcctactggccagaacaataatgatactggacccaacgcacctagcaccatcccaacccaaaaacctgagccaagaacatggtccacatgggcttgaggaaccgttcacagggagaaatcaaatgatctattatatgtaggctgtgtctatttttatctaatcatgaaagagtcccccatcttattagcatcatccttcaatgaagcaaatccattgagagtagatttgcgcctgttgatgtcaaaaagcttccaaaacttgagactttcgtcagctgccactgttgccaaagtagttccgtctggcgacaaggcactgttcaatatacgggcatcatgagcgtcattgattacccctgttttatgcaacgttggatatgaataaatgctgatggagttgttagggtatccatgggtggccacaatttctcttccagtagtgtttgaataaccccaatgtagtgatgatatttgagatcctgcatccaaagaattgaccttgcagcctgtggttgtgttccagaaatggatatgtttatcggcagaccctccacctgtcgccagtaatgataatttgtctggactccaagatattgctttcactgcagctttgtgttcatgcttggaaaatcttggtttattagaacgaagatcccagacacttactacgttgtcattacccccagtagccaattgttggccatcagagcgccatgagagtccgcaaatttcctcggcgtgcgcattagtaatattactaacgatatgttgagacacacggacatcatgatgtacaatgctaccattacgtgatccagctgtcaaaatatggccagaccaatcttgagtggctactcgtgaagtatggccttgcatagtgcgtagtctttcctgtgtttcaatatcccaaacttcaatagatccatcatttgttccaatggacaagtagtagccgtcttgtgaccagttgacagaggtcacaatgcaagaacactcggtgaggctagtaactgctccagttgcagcgttccatacataaactgcgttttctagagcaatcgccaaaagattaatacttgaccattgcatcaaactgaggtaaaagtcatcaactactccaggggcatccagcactttctcagaacaggaggggacttttctagtacgcatttgctgcgatctggaagtagccgattgactgctttcgtccgcaaatgcagataactcagaagtggatctttgtaaagatggaggaggtagattgggctgaaattgcaaaattcttttaccaacttgcaatccacaggcttctgccacactgtgtttataaattcttttagtttctgcttccaaatgtagggctggtaatgcgcttggtgggggcctactttcgtccatacacaagcgaccagatgcagtatgtcggtttggaatgtatctgtcggtggtactagctcgctgaagctttctcggtgaaccagaagtggaagaaacagcaccagaaggagctggctcccttaaatctgctgaacccaacctgccattgaagtctggaagtttctgagatgcttgatgcctctttggagaagaccatgtcataaggtcaatattgggagatagaatatcctttccctcaaaaatggaatttctctttgcattaggactcactgatccaaagacgatgcgatggctggccttcttaggagtggataataagggttcatgattgtttgaatgaggtttactgggtgaggtgtccagtaacatgcttgggtttatcttaatgcagagagtgtgagtcttggaggtcttgcctacgacgcttttggtccttaagacttagtggatatttcagatgagctacagaaagaagggtttggatgaaattgagttcagtttctttaaagggaaaggaataggaaacgtctgaagtctgtttatgttttgccctttccggcaaatgaggaacgagtacaaaaataagggatgtcagatgtttcgtgagtgtgattaggtaataaaagtcgaggtatgtttttcctccattgcattataactccagtgctgtgattaacggcaaaaatcagcgtctgctctcctgtctccaacagtatcctcttctatgagtaagacactgggatggactatattgttaacgtcctggaccatgtgtctcctgacgttagggtcaatttttgacgtcttccccgcatcatcctgcatctcaaaaatcgccaataccaaagtcgatggtattagttcttactacgtctatgcattttttctcaactttgtcattctttggatttggcgtgttgcatcgtggattagtatcaagttgttctctcattcaaaaggaagaggttagtttactcgctgtgatgtaccagacattcacatccacaacccgaaggacacatcgtttgatgatcctgttcccaccattgaacagcacagctagcatgcaatatatgctgacatttctgacatacgaatacccttctctttgctgctgtgcaacaataatggcacattctctgccgaagactcaatgcgtacttgaatgagttgaaaaagactcgatcacgttccaactggggatcatcttgagatgacttgagcgataacttcctcatctttttgtacaaggcgtccttttccaccactgtcttatactttcctttaaactcagcattgaaattggaatcttcggggctgcattcgttctcttttctgggatagttaaatttaagcattttgattgaatttacgggcaatccccaagcaaacagtaatgatgcatactcatccctatattttttgaattttgattcactggagtctaataatggcatataatacacgtcttcatataagtccatattcggatggttgaccatttcaagcctaaccactggcaatgctggattactgggtttttgaattaaactcctggtttgacttgacgatttgttttccagcgccatttgtagaggcatgttactagagttgttcccatagtgaatacctctcttctgtgagctgccagctgttttctcaaaagaatttcctgatctaaggcttaccccatcaaaagttgacatggtactggatattgactcgattctatttctccccaattccgcagctgagttgctgaagttcgtgccgttgaacaccatgctgggtctttcgtcaatttttccctccagtcttttactcactgcaacggtgtttggattattggagtcttcatagttttctgttaaaatacaggataacatggccaacatttgaacattctgaagtttttcatagtagtctattatccttttcactagcactcttcttccaaaaggatgtgctccccaaaagaatttgtgattcatcttactaagagttccgaggtggtatatgtctaagccatcaatttggtcattgtcgtagcgctcaatctccacgtcagtcaccagtactactgataacaaattccaacagtctgccagctccttgtagccatgcttttcagcaatctcggcgttatatttggccagccggtccggggtctccccgagaagcctgtactcgaaggctagctccatttttgcaggtatcaaatgtctgaaatcatagattcttaccaagttcttgttatgtttcccactcttaaaattttggtcttctattgatttctctgttacagatttactcggccctagttgcgctccagaaacgccacctttgaagtttccaaataatccaggctctttgatatctccctgtataatatcgttccaatcttttgtaaaactgtcctctgaagcattggattcaacatcatcgttctgttgttcaaaattttcgtcatttcttcctgacgcaattccaaacccttggtggtcaaagtccatcaatatattctttgccttgtcctgttttggtaaaaagaaacacaccaaatgaccacttgaagtccaaaccgctccacatcctttagggatcggtgtgctgtcgaaccctggggtacttcttatcggaatggcatctacggaggacttcatgggcactaaatcatcgtcttcttcttcttcctcggagtcactcagagtttgaggcctagtcaaatgatcatccccatcattatcggagtcataaggaatgtcgaaaggatctaaaggtaataaatcttcttcgaggtcgagatcgaccttttctcccataagaaaccttaagtaaggctctaagaaacacctattgtgtgccatatatttagtcgaaatttcatttaatccctctattattgcttttttcttctcagggttaaggttgtggttctcctctaatgaaaatctgaagttcctattacttgaacttggctgtgagggatactcttcaggaaaaaataagtccaatctcaaataaataagatcactgtcatagtcatcgtcgccttcaactggatcgccccaaggtccatataacgagacaatcagttctcctgtagaaactgaaattttctcaaatcggacatttggaaatttgtgtcctacaatgctaacttcttcacctaggttgtacggctgagcggtatcggctccaaagaataaattcgtgtcagcaattgcttctttatcggcttcatcattactggggttgatagaaggtttgccgattctaacacccgaaatccagttcaaatgttcctgttgctgaccatcatactcagcgttaccgtttatgattttatttttcttccttcttctcaatatagtagcattcaaccagggtgattgcaaatccacgttgaactttgtggagggagattcaggctcttccctaaaagtctggtacgtgtacttttcaagaaccgttcctgctggtaatggcttatttctttcatggccgaattttgtatataagtcatcagtaatgggccatagttttaaatcacagtctttggaccatgaaacaagttgaaactctctattatcgatgttcttgtcgttttcctggtatctagtcctccaaaggaaatctctgactggttccgaatgtcccttaaagacatataatggtttgagtttcgtggttttctcttcatccaattgttcttcgtctctaaaattggatatgtatatgcaattattgccacctctagctggcataattccaacgcaatctttggcaaacggaatgtgtctagccctactaaccgggaagtctgttctaatacaagactgaaaatttaagctatccttctcgtaatcccaaactttcactgacatatcattagagcaagagatgagttcggagcgattatgcttactgaaatcaagtccattaattcttccatcatgtgcatcaactttcatcaaagggacagcacctttcctaacatcccaaatgtaaaaatggttattgtgagcactagcaagaatgttaggatctctatagttccatttcacctgggatgcagcagctctccaatcagtgtactttccaactggtaacctcggtgttctaaggtcccaggaaaagcaaaaggtatcaactgaacaagttgaaaggacattaggatcttgggggtgaaagttgatatctgtgatggctcttgtgtgtaaatgcaatacatgttcaattgcatccgaggaaggccgactgaggttccataccagtgccttttgatttgaagtggaaactgcccattctgcccgtgaacgatgcggggaccattgaacatcagctacttcccaggaagtaacgtgatgcaaatgtcttggttgtgcaaatgggtcatctaaatctataacaactaaaccgtttcgtctacaaaggagatgttagtattctcttaaactctgttccctgtgagatcgggggtttgagacttaccctgccaaaacagcatccctgctacagggagataaagacatcgctccaatagcaccatccactcgtagagacaacgagttttcgaagaaactcgtgtcataaggggagcaaatcttgccaggcatggagtaatcagttgaactagcgtaagtctagtggatattttgatagagagagagtcgcggggaagatttgggtgagaaaaaacagatagattgcacactggccggatgatcttctcaacactgaattgcttagtttctacttaatgcaagtcatatcaagtgatagattctggactagtacgagtgtacatggtagtaatttattcggttaaacactgacagactattggttcttggcatcccaaagagaacgtttaacttccccctagagtgtttccttcgcgaaaaatatgtccaactaaaaaaaaaccactgcaggctgtctttctcaagccaccaacacccagccctaagatgtctgcctttggtgtggttccgagtgtattaaacactggaaaccagatcaagcagaaaaacggaacgcttttcaagaaatcttctggagtttacaataaacagcagcgggatcacaattccagggataaaaagcgatcagctcgtaaaacaaatacaccgccaacaccgactgagagtacttccgcaaagaagtcatcaactcaatcagacgacaaagtgagtcctgatattttacaattgtcgcatattgagattcaatatgtgggcccacttctttccaacccagaatctttgggatatgtgaaacaaaacaataataccaaaatcaagactccgaaatatttagtggatacagattcaaacctggtttttggtcctgatacaactaataaatgggatattgagaaccagcacaaaatgatcgaaatggaatcttcccatcaaggtgactggcaaggtatttatgaacaatttcaagaaatgaataaagtggagcgtcaaaaaatggaagatctgggcttggtggcaaaagagggacaaagcatggacctgacaaatgctatctcattcaaaggtagctgcgtggatatgtgtcccgtttatgatagagtcaagagggaggtacagagagatgttgatccattggagagagatcctgccactggtaagatatctcgagagagagctttaaagaaatttgtgcgtccttcaggccaagcaccgcctcttccttctgacgtaagacctcctcatattctggtaaaaagtttaaactatattgtggataatttgctggataaattaccgcaaagtcattcattaatttgggatagaacccgtagtatcagacaagattttacactacagagctactctggcttggaagcaattgagtgtaacgaaagaatttgtcgcatacatctactttgtgctcatataatgccgggttctgatcaatctgacttctccaagcagcaagaaattgaacaattcacaaaatcattgaaaacattaacagacatatatgatgttgtcagatccaaaggaggaaaatgtgccaacgaagctgaattcagggcttataatttgctggtgcattttcgggacccaaatctaattcatgaaatccagaacttacctactcgaattcttaaggacgaacgagttcaacttgctttaatgtttcgaagtctactattgaataataatttcaaagaataccagaggaacattcctggttgcttgggggtttttcagcagtttttcaatatgtgttttgatccagccaccccattcttaatcggatgtgtgctggaacttaattttgaagagataagattttacgctttgaaatcgatctcacgttcttatcacaagaaatctgcccctctaacgacccagaagttagcatctatgctcggatttgattccgaggataagctcctaactttcactaattatttcaagactcctacgtgtactaattctagaaatgaaacgtgcattgatatctcaaaacttagatacgagagttttacggatttggctgctccaaagcagatttacacttcaagattagacaacaaattaaaaggattcacctataaggatgttgttgatcaaggattaaataacacatccttgcacatagctaatttgaaagaaacaatggctcagaatcaacatattgcagtggagaaattacccaatatctcatttccacaacatgctttgtcttctacccctttcgaagtagaatcaaagtcagacatagtcagatcttcttccggatcggctccgccccagactttgatcccaccgattcaagaaaaagtaataacttctcaaatacagccaccaataactcccgtcgttcccactgaagaaatccaaactcttccaaaaatagaggagcccaggttcaaagatcttccaaattttgaaaatgcatgcaaagaggtttcctctattttaatcaagaagactatatctcctttgattgctcccatagtgaacaatcagctagaagagtacaaccggcgacaaacggttttaagggatcaggagagacaaaatcaaagaagacaacttttgatttcatcccttcaggaagaattgtactctgcttttatacgagaacaagtgtatattcaagtggttgatactcaagccaaagagtgctttaacaagaatctgaaacggcgaatatttcagaaattcatcgggggtttaattacattgaaaaacaaacaaatgaataagagaagaaaacttgatgaaattcaagtcttcaagaataaggttgtttcctcaagtcaacttcggtattcagtttcaagaagtcaaacggaggacaattcaacgtcaaactcgagtgacgaggaagcatcagctgttcagatgaatattactctttcaccatctgtggatccactttggtcacccatagatattaagtttatattagactccaatttaaagttgtttgaggataacaaggataaatactggaatttcatgtttgcgattgccgattggactattctaccaagcaaatggcttcgttacaaattccaacttcaaaaccccagtctcataaatactgttgaatcctcaaattacaaagccaaattacgggctctacccagtgacaaacttcttacaagggaatacatggagcactgtcgatttttggtatttcaagtcggaaaggttgatgaatcatcaaacctgaaagaatctttgttcagagactcacagtttattaaccgattaatgaaatatgccaagaagtactcgcaataccagattggagtacttgtcttatattatcatgaggatgactcttttgataaacagaaaattattgatcttttgttattagaacaatacacaaataagttagtcaactcactcgagatagttgacatgaacaaactcacaaatgatgaactgataaaagcattgaccacgctagtccacaactataaggataaaggtatcaacaaatcggtaccaacatcttccaccaaaggacacaccactagcattatggaacaggatatgacagtatacagctacagcacgtccaattccagggatgctaagcttaattatattttgaagcaagcctacccccgcagggggtttcacttgaaacaatgaaatgtatagaaatattatataactcaccctccctccatttataaagaacttttcaacataacaatcttgagacttttctttccatcgcacgggcgtgtggtctagtggtatgattctcgctttgggtgcgagaggccctgggttcaattcccagctcgccccgtttattttttattaacttttttcctaaggaacctactgaatagatgacttgctaaaactatggaagatgaatatgtcaactgttcttatattgcatttggtaatctatctatatttcttctacgctatggggtttcttgttgttcatcaacctcagtaaatttcttaacagcatagctatcgtcacttttccaatagatggaacgtacaaactagcaatgtctttaatcctgtcatcaaagttcttctctgacgaaaagtttatcaccacagcaccatctttgacatactcgagaggaaatttgtaatttgatgatggtaccccagtgatgataacatcggactttggtgcaacgtcttttagctcaaactcagtatcaacgacacggtgggatttcaattgaagcccgtcacctcgttcgaatttctggacattgtttatatccacagaataaactgtagcaccatcgttagccaataacgcagctaagggacgacccacaatttcagatcggttgacaatggtgatagtttttccaaagagcctgttaccgtatggtagtaaggtgttgtaaacccccaagtactccaaaatcttgaccatcgccaagggtgtacaaggtaggatagatttcttggtattttctggagcatctaaatacctgatattgtggtacatgtttgagacatacttgaagtttagcccctctacatccttctcaatagacacacattgctgcaaatactgatcttggccatcgttataaacaggaaagtacaccattataccgttaacagcgtcatcttggttacatttgtatatttcgtcctccaagttttccttggggcattggatcagttcatattggaatcccagggattcacaagtacgtgcagtccactctgcgtaagttttagcggctggatcctgattacccagtaagccaacaagtttaggtttggtggccatcttgctagtaactgaggtcaattcttcggagtatttcttagctatggtggaagctaagatggtttttcctgctctataagacatggctgctcgtctgtggattgacttaggggacaagtctggtttagttgaagattcaagataagatattagacagtaaatgcagtcaaaaaaaattaagttttttgattagatttgactccgttcggagatggagatgaggtgcggattgactgggcggagagtccgtgtaatgatggaggcaagttccgtactttggaatcatgtttttattctctaaatgacccatggcctttatcttgataattttagaaactttgcttcctggatctctttacaacagtttagtgaaaccacttgttgggccaacagccacttagtactagagttcttgagttgattgttccttcgcgcgaagggctcgtttagacatcatctattatcagtactttgtagaccccgattaacgaacagcaagcacgttccttaccttactgatgggcagaaggaaagggtaccagaagatcaccgagatgtcccaagtggaccataaaagcaacaaaggtggcctgatgcaggcaaacggttcaggatcattgccattcttctttaaatcgttgacaaacggtagctccaatagcgttgatagaccgagcatagacagtagaagaagtagtcacagatgggattccgaaactagtagccctaaaccaatgaagtttcaggatgatgatgaagattgggacgacgatatattaagtgacctgactataaagggagaaaagtttcctccattcagaggagatgatgataccacaaaatatttaaattcgattgtgaatcagcctgacagtatttcagttaaagaacctacggttgaacttcaaaagtcccccttgaataagagtatcagaaagaatttcaagagtttgatcaaagaccctctctctcttttatcggatttagatttggcagaagagaaaaagatttatggtgtcaagtttgaaaagttttatagcattttacaagatgaacaaactaatgaagagcaagaacttaataagctacaaaatctatcatggaatggaataccaaaacggttgaggatgataatatggcaaatgttactaaggtacatgcccattaacaactcaagaagggttgcacaactagagagaaagagacaagagtaccagcagagcctgtcggagatgtttaaagattccaaaaaggataataatgtatggcatcaaatttctattgacattcctaggactaatgcccacgtgaaattcttcagtaataccaagatccaagattctatgagcagaatattgtatatttgggccatacgacatcctgctagtggatatgtacaagggataaatgatctagtgaccccattttttcatgttttctttgagaattacatggagaacgatttcaacgttcaagaagacgacattgaagaactgtctcaatcaacaggtttcgaggatatacttaaagctgttgaagccgatactttctggtgcctgacaaagctactagataccattcaagataactatattcacgagcagccaggaattcacagacaaattagtaatttagtgaaaatttctgaaaaagtcgataacgctctgactgaacacttggaagaacatggtctgcaattcattcaatttgcatttagatggatgaattgtcttctaatgagggaatttcgactcgaactggttataagaatgtgggatacctatttaagtgagtttcctcaagggtttaaggactttcatgtttttgtctgctgtgcatttctcatgaaattctctgaagaattgaaagagatggagtttcaggatttgatcatgtttctccaagataattcaaagactagtcactggaacgataaagatatcgaactgctcctaagcgaagcattcatatggcaaagcctctacaagaatcaactaacttatacgtaaactgaaatgaatattttagaaaattatgagttctatgctattgtacactatttactacatgggttggttcattatctgcttctcaatgtcatcggcaacatcaatatgaacgacgggaagattggaatcctttctgtttcttctcttcagcaatgcaattttatagatatgattgttgactttattttcatcaatttctgaatctctggagaatcttgagggtatgtccttaatgaaagatatgcactttttcatggctctagaatttgccaaagcaaccaaagataaataaatggcaaactctacagacaaaatcgctatagcaatgaggaaacccccgattactgcagtaccgatatgatcagcaagtgatttgatgaatttggcgtcgcctaaatgccatgaagaaccctctgtaatattgaaaaaagcgttggggccgcttttgtagtctgcaggttgtaatatacgaacaaccccagattcaggaacaccccatcttttgtactgtttccaaataaccgacaagaacaatggacctgtgctgtacataatagtaatataaggaaccagccaatttctattgtagctttccaaagacttgattgttttaatgaaaaaaggatgccttggaacagatcccataacatcatttgagataccagatggcgtggtctttcgaacaaaggcaggaaccgacagcaatgggtccagtctcctggcacagccgtcgtccaagtcgatataaataccaccaaagtggttcagaacgaagtatctgattgagtctgccctttcgatgttgtacttgtaggaatcaaacgtcttcaagaaccatgggtattcttcagaaatgaagttgcgtgccatttcatcagtccacatgatgtacttgtagtcgggatgaagttcctggcattttttctggccatcctgccagatttcagggatgtcattagttttatatgtttgatggataattttggggatgagttggggtctgcttgagatgtcgctgttcaagtcgctgtctaacaggctgtccttgaacgtgtcatcgtacagcaaagtcatcaggtcaaatgtttcatagcacaaaaacagcacgagagcaatgtgagcccaaatgaggatcttaagctctgttttcattctggagagcttatgtaaacacggtctaagtagtatggaaaggaatgactagaaatggtgatatgatagcgtctaaagtgtatgctttcttccttgagtgtgatgagcaaaagtaggaaagaaactgaaatgataaaatgagcctatggaaaagaaagtttacggtgatggcattttcagtctagttttgttgatacaaccgtaggcaacaatcgtgtgtcactcaatagtttcaataaaaaaggacacagcctcgaggaaaaaagaaaataatgcagtcgttggcagggcaacggtcgaaaaggatctcggcatctaagttaattgtaaggggctttaccaccgaggagattaacgcttcctgcgaggaggtcggcagccacatataggacgactattgagttagtcgggaaggattaaatgctcgcagaatatccaattcttctgcaactagcaagcagcaagttgggtccaacgcgttctggtcagttttttttctcatttcgcggggccccgttctactagtgggaatggttcttctggctatggtttaatgtggtagcaaaagtgctatcgggcatttgctgaggaaggcgacagcaggtaaaaaaaaaaaaaaaaaaaagtgtgggatggttgttaaggagatgggaggagcccctagttcttttttggaacgagtgaatgtttgctttagataagctttcgtcaagtgaggttctttgcaggcattcgggagtagtgaacaaatgtcatcttccgagcgctcagtgctcgataattcggcaattcccttcaatcttcctagaggcgggcctccgcctaagcacctccaagttcatgtctagtacattctccaactacgttctcccaacttgcattgacaataacagtttacctaaagaaactttctagtccatcatgtctcacttctgatctagcgttctcctctctattttctatttttcctttgacgatttgctgtcttttccttgccgctttctctcatcttccctctatcaaatttgatttgtcgctcccatcgaatgaaaaaataatctcaccaaacaaccccaacccaccatgtcctctgttgcttaccgattgactccaggtttgagaaccaggccattacatgcggtccagtttggcttgcgttttaaatccaccacccctccgccccaaagcggaggaggtgccaagggagtggtaccatcaattaacaaaataggaatcccaatgaaatcttacattcctccaagcttcaatagactcaactttctctcgcatcccattatatcaatcaaatgtctcttaagaagatgtgggcttttggccctaaatacgtatcaagttttggatattcgaaaaaatattggaaagcccgatttcgttctatggaagaacaacagcattgaaaacttcattctggtcaacaaattgtttgccaatggtcatttgaaacctttgaaaagcaaggtatcttcttttgttttcaaaagtctggaatctagactgaaatctcttcctgaaaacaccaagttggactggaaattactcaagttcaataaaccacccaaattggttaacctgcacaacttccctaatgacgacggttctaccatgtgtgttcaggttatatacaaatttgacacccagcaacgtttgatcaccgtcaaaaacggctccgatgctaccactttcgacagaaacttggttcaatacgtggggttcaacgttgacccctactccaacgaggttgtccttgccggttctctgtttgaaagtgacttaaccaccaagatatccgactcccaagccaaccccacacagaggcagctcctcgacacaatggccagaaatggtgacattttccgtaatcagtagacagagatccaaggtcgaatgacatgggcatcataaattcaattatatatatgtaaatagaaagtaaaactataagatttgatatactatttttggtcaatagcatcttggtaactaggaggcttatctcttggtcccactgtatcctcgtggaactgagagagattagcgccaaattgaatatccttcttgaaaaacacctcgttaggaatggatccactcagagcatccgcattgtttagtacatcatcaattgtattgaactcattatccaagccagaaaacgacatcatggagtccgtcgcagagagcctcctttgcaatgcagccatgtcagtactcgacgaaggttgcatcaagggagatgacggttgcaatacagcttcttcaaatgttggcaaattgtctgaatcttcttggtctttctgggtagatgtcaaagaaaagccactgcgaggattttctgaataatctggcaaagttaagatatcatccttacagtcgggagatataagaactaacggtgtatcaatgataacctcataatggtgaaacttctctgaattgccttcttctggaacacttatacgaaaacatatttgaagtctatgtttcacgacaacactggtaaatgtggtaaaatctggattcaatccatatgtttgttccttgcctggaaaagcggctttgaaagtgagggggcagctaacctttacagggttagtaatgacaatttcatcagtcttctgtctcattttacggcttttcacatcaccattattgaagcaagcagtcaataagttatcatcttggcaattcttgatcacctctgttctgagagattcatgcttacttttatccctagttcttatttcgaaaagtgtaattttgcgctctttctgactcttggtcttgctattaggtatatcgccatatcgatactcatgtgtcatatccttcgaaacatacttcacgcgttccaatacgttaattttgatacgtttcagttggatatctttaatcaatggtaccagctttagttgcaagttcatggtagcattttcattcgaatttgttaatctcacatatttctgtggcagtaaaacttcataattaagagcgtttccccaaaccttattaacgtagattgacttgttgaatgttgtcgtgcccattggtgggggtaatctaaccacaggaatatctgccttgaacgtttcaggctccagttctacactttccgatttccttcgaaggaaattaaacctggaaagttcagaagagcgaggcgacatactgtaggaaagttcgggttcaggaatatttgacacaagattcttctgtagttgggccaccacctggtgttgaagtttgctgtagataagatttgttgactcaggtgccacgttaggtatcatcaccgatagtgtgaaacaataataaccaggtttgtatacgtatcctcctttacgagtctcgtcgtcaggtatcatttttaatttgtcttcgtcataatcttgatactgagatactttgagtaattccaacgttttcacattgttgtatggtatagaaaaaactccagtcccatcgtcatccccagagccagagctgtcagaaactgagtattctgagtcttccttgaaaggtatgaaatggtttgcttcgtctaatgaaaggtcccaatcgacatccttagctactttataacattcatggtggattagtttatcttcatcatcgatataacctagaggccaaaaagcggtcaccagggtttgataccggattctaaccttgggggtaagtaacgctgactttttaagtttaattattaccacaatagagtgattcaatctgtcggtttccaaggcatcagcaggtttaggagtcccgctccttgagctttctgaattgcaattatcatacctatcttcataatcctcgtcgccggattcctgcaggagattctctatggctgagcctctaaacttctttgggtcaacatacggtagatatacattattctcagatctgcacataaataactctattggtaaatgcgagctacctttaacatgattcatcttagtaatctgggaagtgaacccaccggttgccaaaacattaatcagtaactgctcttctttcttcagatgttcgccactgttggaaacacttagataattagaggtgtctgatatgatggaaggcgatttgtttgctgactcagtgctaaccacagaaagtaagtccgagttgatactccccttgcggccaggcccaatagaagttgggagggatagcttcttcttgatattcgacactgtggccatggacattagtctatccaaagagtgtgccggtggcgactgctgcgttggcatcgtatcgaacatcaaatcgttcagtgaagtgttactggacacacttctgctcctgtaactagatagggagtcgatattcctcggcgcggaaggagtgtccataacatgactgttactccgctgctttctcaggttcataatgtcattcaaagacggtgccatttcggttaacagcttatctctgactctgaactgagtatgtgaaaagcaaatgaattatttgtcttggcctcgtatgttatagggttgaccttttttttttccaagacgtttgcacgtgattaagatattctttgggggtgtgtgagtttcacagattgaaattatgtattatatgaggttatgtgcgtaaattaaacattttccgaggatgtcttgtatgactcattattggcagaagaaaatgaaggcgccagagaggtgacagtgttgttgttggttgctttttgatccagcgagttagacttctcactgccctcgccagtgtatgcgtacttacttctttgacgaattctggctccaaatatgaagaacatgaagggaatggcacagcaggccagcgaaatgaatgccatcagagaagtagcccattggtatcctaacctgtggtacatctggacggtgaacaacgggaccgaagctccccatatcgaacgtaagaatgtcttggcagctaacccggaggcggcataatgctgatatgaatccacaatatagttgtttgcagggttatataacaacgtaaaaccaataccacaggcaagaccggaaatagagggtccagcccaacttagacgtgggtacgaagaccatgcaaatgcaaataatcccattggaaccgtccaacatccgatcatcatcggaattagtctcagttctggtggaggtagaagtccctgatctctgtatttttgagcccttttgttataatctttgttgaatagtggggcgagggcgacagctatgaaaatacccacggcaatcggtataaatgtcaaacctgtcttgcctgcattccatcctttgccctccatgaatacgattgggtatgcaaagaaaaacatgtacaacagaccataaatgatggacatgtacacggtaatcaagaacacaatcatttctctcagaagaattaatggtctcagaagggtttcatccaccatttcacgagtgcttcttattcgaagctccactaaggctctgtacgatggatcaccggtcacttttcttagcttcttagcccttctcttcaaaagtgtaccagcatgtgtttctggaatagttacgagtagcaaacagtaacagaacccagtaaagatcattaatagccaataattccatctccatcctttatacattcccaaataaccaccgatcaaaggaccaatgacaggacctaagaagggagcagctgagaaaattgccatggcaaggcctctttcatcttccaaccagcaatctgcaagtgaacctccaatcaaggtcattggtcctgaaaagaatagaccgtcgataaaccggcagacgataagagtggcaatattctgagccagagcacatgggataataaaaacgatagccaaaaataacgttggaatgtagaccatgtttcttccaaactcttcacttagaggagacaatatcaatggtccaattccaaaagctagcacaaacatcgtgacacttgccaagatgacaacttcttcggaggcatgcagatctacttgtggacccagcatttctccggttacaatagctgagccgatagctacgttaaagcagactaaacctaaaacgaaggtaataacccattttcttgctttcgaaaaatttttggggtttaccttatcaccagggacaaactccaccaacctcaagttagtttctctatcgacttgatacttccattcgtccaattcgtggatagtggaattaggatccggatcggctatggctaatggagcatctaccattttttcgactggacctaaagtacctgctcttgatgtgatcctactgatttttctttctattccctctttattttgggtgaccaacttttcgagttctagttcatcctcacgatcatgatgagccacatggctcaagactgaactcagttgggaaagaggatggtaatgattgtggccctcctcctcttgaggagcaaactcagttactctgtactccccgttctctggcacatcaggtaccaaagaatcgatactatgcaaacttctagtactcattattctttttctaggagtgcttactgttaaaataaaagtcaacggctcgtggccatacttctatataagtatgctttcacattttgtctcttctgcaagatcggttatgtctggggccagttttgcctatttgtcaccacatctggggtacaacaaatcctcaagtcgtacagacatactttagtaagtaggtatggagactattgtgaaccgatcgccgatcaaaagttgaggcatttggccagggtctcacggctgaacagtcagtacactgtaaagccgcaaagcggcaggtagttaagagcttgctggaagtgagtgaatatgaggcgagtaggcatggaacctgccgagttttgtttcaccgagcagtttgacgggttgctgatgcttatggttgacaaggactgattatataatgtctgtaatgttcggtcgtgtaccatatcaatatcagtgatctagttcatccacaacagtcccgcagattgggttaaatctccaattattctctgcccctaacccaagaacgtcatgaaatgcccactataaagttagcagattataaaacgatagcaaatcttggatcaggcaagtctgggaaggttatcctggtcgaatcagtccagacaaaacttcaatacgctgtcaaggtcataagcctcaaggagaagaaaccttcaattgatttctataactacaacaacttgagtcgcatccagaatgaagtcaagctgcttactttaatcaacaagtaccatcatgaaaatatactggaattcattggaatggtccaatcaagcagcaataactatatattcctagagttttgtgcccaaagggaattgtctccttcgctttttcgaaagctcacaatggtcgaaagcctgtcttatgttaggcaattggttaatggtattcttttcattcatcaattgtcaataattcatagagatttgaagccaagtaatattttaatcaatgaagcagggacattaaagatttctgattttggcatctcttacaaactaaccaatgatgacaagatagatcgctttgaactgagcaatttagttggaaccccgttattcgttgggccagagctcgtcaatttcaacaacacaaaaatgcatttggggtttcccatcgattactgggcttttggaattactttattttacctgtactttgattattttccattttttaatgataacgaatacaagctgttcaatgataccttaactaaggagttagagcttccgctgtatgaagaacttaccactaccgaccgagattctcaatttttcagttacttacttcgaattatatcagctctactgaacaaagatccaaccgaaagactctcattgaaccaactacagcacgatgaattcctactgaacggcatgtccaagaaggaagtaaagagatttctaaactacaacaacaccctgttgcaccataaatctagtccgctttcattgttcagactaaaaccatccagatcaaagaccagtaaattaaacatatcaaaccccttaaaggaaacttttgaacacatcaaagacaatcatttatcctcaattgatcaagcccataaacagcgcttccagttgaatgagtcttccgtttcacttcctatcaaaccaaattctatgacgatatcaccattgaaaaacaggtttgatgatacactattcaagaggtcaccctctccattgaaggcgccttctgtgtttcccaaacccaccattgccattcatcctgaagaaagaacctctatgcataccctccccaacgatctttcagaattgagccctcaataccaaaccaacttaataaagtccaagggttataacaatttgaacaatgtcctgaaaagtcaggcgccccactttctagacatgaatgaatactgggatcaagtggaaagaaatcacgaacagagttaacttttgaatgcattattatgcaggttacgcacctgtcctcccccctcatgtttatctctttttcgcgctgacaaccttatctgaggtgagtcagcgtaattagagtgcgatgttaccgaccgatttttctttatcaacttttaacccaattatcttgtaactgtcctttcgggaatcgaattgggttaaaaatgcctggcatttcctcaattgagctactcgttttgactgtggtttttctgactgtctttcactttatcatctatcctctttgcttccaccctttaagtaatgttccaggcccaaagattgctgcgatcacccggcaatggatcttgtaccagacatggtcagagaatagaaacaagacaattctaaaactacacgaacaatatggtaccattgtccgaattgggcccaacgaggttgatatcagtgacgcatcctatataaaggatatctatgtgaagaacttggacaagtctaccttctaccgtcagtttggtgcttacggggcatacaatacgttttctgaaatcgagaaaactcctcatctagaaagaaagaaggtgacctcaaagttttactcaaagactaatgtcgctacaaatcctttacaaagcagaatgagaagtattattgatcaaacaattgatcgcattaagtccactcaacactccattgacgtgtacaatctgtttcaacagatggctttggatgtaatgtgcgtgttttcttttggaactgaagtctatgataaaccgttagtcagacaacctgaaaaggcacaggacctcgtcaataatttcagatgggcttcatccacttggttttggacgacactggtaccgtttctagagccttatgtcatctctcaacatgtaaaggacgcagcttgcaagacagcaacttgggtaatggatttttccgcccaagcttcaacatgctcagacttagaacatgggtcaaaaccattaactttggttggtgtgttgaagaatagcggattagatatgaaccacgttgcttctgaggtcattgatcatgtcgtagcgggtcatgagactacaggaattaccctcgcataccttctatatgaactcgcagcaaaccctgatattcaacgaacattgaaagatgagctgaaggtttatcaagagaaagattatgatttctcccaaatcgatgttctaccttatctagaagcggttcttcaggagactttcagactgcatgctgctattccaggacaagaacctagagtcactccaattgggggaatgaagtggaggggtaacgagcaggtaccctccatgacaattcctggtggtactattgttacaatggagccatggacgttgcatcgagatgccaaggtatttccggatcctcttgttttcaagccagaaagatggctggcggatgaacattctttatttcccatgaaaaggcaaattctcacatttggagcaggagtccggatgtgcattgggaaaaatcttgctattcaagagatgaaactgttacttgtaggactgctgagaaatcaccatgtagtgctagatccatccgtggattatgaatcagatgtcgtcatggccgacaagtataccacacatcctgccaatcaccgtctgttcctgactttttgccgtgactaatcagctactgcatccagctcatcgcttctccccatataatataattatctcaccatcgcatctcgaaaaaaaaactgataaaatttaagtaggaaaaaaatccgattaattcttacttcataaccaaagaaatatggccaatatcgaagggaagctacctgatattctctctgaatcagtcttaaagtcctctgtccctgttccagaggactttgtagaggtcaaaggaattgactacgacaagccggaaagtcgcaatatgaaagccaaggatctcattaagggtatgagaaccatggggtttcaagcctcctctttaagtgaagcttgtgaaataattgacgaaatgagacagtggcgaggtaaacatattgatgatcttgaggagcacgaccgtaagggggaatttgacggtgagggataccaaaaatcgactatcttcatgggttacacatctaacctcatctcttcaggtctaagagacactttgagatatttggttcaaaataagatgatcagcgctatcgtagcatctgctggtggtatagaggaagatctcatcaagtgcttggccccaacttatatgggggattttgccttgaagggtaaaggtcttcgtgatcaaggtatgaaccgtattggaaaccttttggttcctaacgacaactattgcaaatttgaggagtggattgtacccattttagacagcatgctggaggaacaggaacagaatgttgtttccaagggggtagatgctcttgacggtgatgcaatggtttggactccgtctactgtgattgatagattaggtaaagaaatcaacgacgagacttcagttttgtattgggctcacaaaaataagattcctgtgttttgtccgtcattaactgatggctccattggagacatgctgtttttccacacttttaaagcatctcctaaacagttgagaattgatttggtaaacgacattagaaggatcaactcaatgtctatggaggcttccaaagccggaatgctgattctggggggtggtttaatcaagcatcacattgccaatgcttgtctaatgagaaatggtgccgactgggccgtctatgtcaacacaggtcaagagtttgatggttcagatgctggggctcgaccagatgaagctgtttcctggggtaagataaaggccgaggcaagatctgttaaagtgtttgctgacgttacattagttttccctctcatggtagcagctacatttgcatccgaataaataaaaatatattgtttcacttatataaaacatgtatcatctatgactgttcactgtttccttaagccattgactctgccaccgatccttcttctttctttccttctatctatgcgcattagggtctttccgtgactttcggatcccaggtagcacacttaggcctagcagtgttgtaagggacgtaagccccatctgtgtatgtgaggttggggacatgtttcttaacggggtaagctctgacacttttctcttctggcttcaactgattaggtggaacatcagtaccataagccaaccagtaatgccatccgggctcaacttcagacatatcctgtctccagaacccggtgtattcaacaaatctagttctcatgtggatttccacaggatcgtcaacctcgtagaacttgtttccgaaggagtcagttccgaccaatcgaccggattttatatcattatagccttgtaattgcttaaaagacttcttgaagccgttcttccatagatttcttagggtacgctgaatagacgacgacatgtttgattaatggatggtaagacgattgagttttgttctcattggtgagaagagaacttgatcatgtgacaaatcacgtttgagcagtacactggttgaaaaaaagaagaaaataaaaaaatgaaggtcgtacccgggttcgaaccggggtcatccggatcaaaaccgaaggtgataaccactacactatacaaccgtattcttacaaagatataaaacttttagtatttgtcctaaagtacatgtattttgtattatattaacattaaaacagaactaacttgtttgtactccaacttttattctaaattaccactatgcaaatattattaatagtataaacaataaaatcaccgcaaggatcaccaataaccacatgcataaccctgtggaccgtttttgatatgcttcagctctacgaagttcagaatgcccagcccttgaatcatccaccacactgtacaggttgttctctatgttatccattagttcaccttgactggtaaccaaggtacccaggtcctggaacagctcgttgagctctactattccgttagcaatattctcaatttccagctctcgttcgttaataagatcctgttggtactccaactcagctgcgttaatcggttcatattctatgataatctgctcgccttcttgcgcttgctgttgttgttgctgttgtattcgggcttcctgttccactacttccatctcattgagtttactgtctaaccgggtaaaccagttctgaagttctttgaactcattcagattatcactaataccatttaccagttggtctttttgaaatttttgtacagcactaatatccacaaatctcaagtccatcagatactttttatcggctgtgatgtcacgaaactgtgccatcaacttattgatcaattgtaaagcattcttttgatatttgttgaactgctggtagttgtaatccttattgaggtatttatcaaaaaaacctaggctctgtttcagtttttgaatatcattactgattacaatcagtttgttggataacttgttagctttctcgttgaaatcaggcaagtcctgataaatcggttgttcttccagagcgattccttcgtcaaaggaactcattatgggggactatgacgagatgagatatcggtagatgcgattgatggggcgcaataggcgcttgataattatcctagaaattgacaatacctgggaggttcgagaacgggatcgtgtgagcaagcgcgtggaactctagaaggagcgccggaattactattccaggagtatctatatatacatgaaatctactgtaacctcttgacattttccttcgtccagccttttttacctagaagacccgaaacttcccctgcgtcaatattttccgggttgttgaagtctggtgttcctgaaatgtatgaaatgtaaccctctgggccacatactaacgataagctggcaggagaaggagaattatcattagactcccgcttgaacaacaacagttgcagagcattgtcaaagtacgaggttgattttgatttagctagcgacggctcaactctttgcttttcagagtcttgaagctgagctaatttaacctgtgattcagcagcagccgttgacgagttgtcgtcagttgaatttccagatttgagttgctccattttctgtttcaacaacttcttttcctcatactcttttacaaacttcagatccttgtatcctctataattggatacgacactggcgggcacatcagtaatcatctctcccttgtcacgaataaatcgataataattcaagcgtgaagtcttttgcagaaagtagtttaacgagctgaacacttttgggatctcctcttcggtattggcactatgaaataaattaacctttcccttaggcggattgggagaataaagacattgcaaaaatggagaaattcccgttccagctccgaaaaagttataattatctggcgacggcatgtcctctggaagttctgaatcaggaggtaatttgctcaaaacgtttctaagttgtggtctatcagttgctttatccaacggatggaaaggaaattcgtagtcaacaaagggtcctcgcaattcaaggtcggaatacaatggtgtctggctgatccacctagccatctctccttccggataagttttgatatataacatcatcttcccttcttccccctcggagtttataatcttgatgaaaggttcttcactgttgttgctagccacatacaaaggcaatggcgtgtattttctgacaatactgatatcaggctgtttaatctccactgaccataatctgtgaccattccacatggaggtcattttaagtttcatagagttcaagattttggatctattcttccgtgtcagctcaataagataatggtcctcgtctatttgttgtttaaaagtgatagtatacttcttgaactcgctggggttaagaaattccaagtcttcatcttctacaaagaagtagttgtacgagaacaatagccatacagtaccacctatgacgaccagactaggaataaatctcaaccatgggtttctccgctttctaatgaccttttctgctttcaactccgatggtgaaggtggaggctggtgttcataagtgaccctttggttgggtcttggaatgtattgttttttcagttgaatcccttgcaacggttgaaggccgccagtcaacttgggggcgtttttcttagcagggactgcataatttctaacgagccgtagtattctctggttcatggatcatagaactgaggggaaggggaagtgtagaaatgagcagaaatggtaggggatttggagttctctctaagcagcgaacagaaaattcaagcaccctagaagcagatcccattaatgcaatccgccccatcaaccatgtctctatctttggttcacacattcacaggtcacacagataaatgctgggctacttccattcactctaaacttcctttattggcaacagtctccggggacagaacttgtcgggtctataacttggaaacgaagagactgattgtcgtactcgacgatgattctcattcaaagactctttccagcgtcgaatggaagccaactggggaattcccttcgttggcaatcggctcgtttgattctacaatctctatttgggggaatgaagaagctgtcctggaagacgaggataactggacactgatggccattatcgaaggacatgagaacgagattaaaggggtgagttggagccatgatggagtgtatctggcatcatgctcacgagacaagtccatttggatatgggaggctgatgataacaacgaagagtttgagtgcgtctttgttgtacaggaacacagccaagatgtcaagcatgtaacatggcatcagcatgaaaatgtcctagcaagctccagttatgacgacacagtcaaacttttcaagcaagacgattacgatgaagacgattgggtaaacgtggccgatcttactggtcacgaagggactgtttggagcagcgattttgaaaagaaaggtgaaagggtcaccagattatcctcatccagtgacgatgggactataaggatatggaaaattttgcacgctgcagacgatcagcccagcatagatagtaagcttccttccacgattaaaacagacacgaaccaggatatgtgggaattagaaacaattcttcctataatccaccatggacctatctattccgtagcatggggcgagaatggctacattgcaagcgttggaagtgatgggcgtattgtcgtctacaaggaactcaattcaaaggaatggcagattataatctctcagccgcactctcacggagtctatgagataaacaatatcaaatggcatggagaccggttaattacagcgggtgatgatggtttggttaagctttgggaattggctttatgaaaaatcttaatctgatcgcattttattacatcgaagataagcttcggattattcaggtatttataatgcctcagacggcgcgaccgaatttatctgctatctttatcgtacatcctttttcgttcgtatttaatactcaactcgctcaataaggataatttcaaacagcttctccgtcaaacgatgtcagaaactacgcccttgttacctgagatcattgaagatccttcaacgggaactcctggcattgttgcaaatgagttgatgcaagaagaacagctgactaaagtttattcaagctcacgttcaacaggctctttggccagcagtgatggtgaatatgctgttccgtctaagcagctatatgtgattatctcttcgctgtttatgtgctcctatttgagtgctctggatactactgttgtgactacgctgttatccacaatttctagtgatctggaagaaatggatagaagttcgtggattgcaacttcgtacctactgtcttgttgtgccttccaacccctctttggtaagattagtgacatatttggccgtaaagtaatgattttgttgtgtatagggtcatttgccattggctgcctgatatcttcctattcatactcattatggccgttggttattagtcgatacttagctggtattggagccggtgggatgtctgttttgggtaccgtggccatgtctgatttaatctctttgagaaagagaggagtcttccaaggtggagctaatattttttacggtttaggttctgcttctggtggagtcattgggggcttgatagccgataattggggatggagagccgtattctccttccaagttccaattgctttatgctgtgcaactgccattacaatctgcttccatcttcctgaaggttctcccggaaatggatatcccaacagtgacatgtggaaaaagttccagagtattgattttgccggtagtattttgctagccacgtctttgactgggctcgtcgctgctgccgctttagggggacatgaactaccatatggcagtgcttcgttcattttattggttgtaatctcgctaggactactagcttggtttgcgtacatcgaactccatagtgagcaacctgctattccaattgaactactaaacaccagaaccgtattgtcagcatgtctcgccaattggttctactcaatttcagtctattcttacatgtattatatcccaatctacttcacaacttcaatggacttttcaccaacagacaatgggttaagaatgattcccaacttctttggaattgcatttggaagtgttggttctggaatttatatgaggaaaactggaaagtacctgaaatttatcgctgtgacatgtttactcggtgttctagggacgataagaatctgtttcatcaacccagacatttccttattcacccaattcacgttgactgtcgtgcccgggtttggatactcgtgcatgttgacagttacactgttagcccttatcgcctcagtaccaatggaaaaacaggcttcaacgacatcgattcaatacgcctttagatctacaggttcaacaatcggtgtctcgttagccgccgccatattccgccatgggttatcaactactcttggtagaaacgtttccaacgctctaccagataccgaagaccccaaaattatttcagagatcctccagcaggcactaaaaagcacagactacatcaaagaggctcccaaatgggccatagaggccattcgaagcagttacgatttttcctgccacttggtcttttatttctgtctgatcacagttaccatgggttatgtaagtgtcatgatgatgagagagcacaaattgcacacatcggtgaaccgagaataatttcacggcatctgttttcatgcaacgcgttatgtgtctcctacatatttggatccgaacacctgtagatttccccatcgggcaagtcgagcgatgtataaacatatagatttagatgcttagattttagatcgaatgccagttaagagttccatcgtcctatttataacctacacaccaatacccagagaagctcagtatagaaccacggaatgaaatgagaaacccggagcataggtcaagacggctgctgttcaagaatgtggccaacacagccagcacagtggttactactaccctccaaacacccaccaaagagcaatttgacttggtgcttaccgataaacaacagaggctgaatgacacgataaatgccagaacaataactccttcgccgaagtatacgcttaacttgaaccataagccgtcaaaattggatttaattgatagttcattcacgtctttcccattggctccgcccagagacaatgaaactgggcaggactccacggtgtcttctgatatggacgccacgccagagcccagatatgactctccttccatcaaaaaaagaatcctatccacctacttgaaagaattgaaaaggaattcttcaaggcatgatgaggacatcactttggtggaagattacatcccaatgcccaagacgctgggaaagaaaagagtttccattgtggatttcaaacagagaatgaaacgacatcacacacaaagcacaatatacgacgactctgggaattgccaccaaccatctataataccagggttattccaatcatcatcatttgcatcatcattaactccctttgggacttccattaacgaacttcaaaaacctcttcatgtcgacaaattcaacgaaacagacctcaaatattgtgttatttgtgagaagccactttatgatctcagttcactgatccaaaactgtccatataaggaaattgtgtgttctgattgcagagctaactatgaagtatatttcaaggttttagagcaactggaagctgaagaggcaagtaatgggtatgacagcgacgattcgaggtttttcgtggaggaaatgccaccagagcaatctaaagagtatcagttgattcaagggctgaggaagatcaaggctatggatgatcttagacgagtccaatcactggacgaaattcaacgacgatttggggaaaagggaaacctttgggaatacattaagaatagattaaagaaacagtgatctggtgcatgaaggatagtaaatgaatgtgtataataggacagttaaataaataataggtaaaataattctcgtaattaatgagaactgattgtttctaggtacttgaccagcttgtttctttcattcttttcaaactgaatctttccttggtacttggacgggcttcctcccccttttaaaacactcttctccaaaacagaagaaattccatccgtggtatctttgacgttttcaccataaacaatcaaagatccttgattttttccagataacaaaataacagttttatccttgatggctttgtttgacagtttgaaaatgttgctggtaaaatcattggagaactctgagtctacaaatatgatcttagagggagatgccacaatctcctgagctttgatttcagccaattctttcagcattttcttctctgtagtatttgaggctttgatagaactgttcaactgggcaaccttttccggtattaattcatccggacatgaaagttggttcctcaaatttttcagaatactaaaactctggctcacaaaatcattgactctatcaccgacaatgaactgtaatctcgtattagtcttctttccagaaatttgattcaacgcaatcacgtttttaatttgtaaagaagattgcaggtgagttccacaacatgaattgttgtccagatgtccaatacgaatatctctcatggatcccttttcttcgtgaatttcgtcatgctcaacgacagaaattggcaaattctggttgatggtcgctttgatctgcaaatttagttgttcgatttcaaaatcttctaatttcctggggatttcaacgtagttcaatacagtgtcaccagttcccattccccaaccaagggtagggacgtcgaaatggatcttcaaaagggcactcaagagatgttggcctgtatgctgctgcatatgatcccatcttgactcccaattgaccgacacaacaacgttatcacccacttttaatggcaagtctccgggtgcgattacataatggacagcattcaaaccgtttcttcccacataaatgacatcaaatgagtggtcctcagaagctacaatgccagtgtcacttggttgacccccgccctctgggaacaacactgtgtcttctagttctaccaggtaaagctgattttctcctatcagtcccctcctatctggtggcaattcgttcgtggcatcttggcacggagtttgggaaactacctgagtttcgatgtctctaagaaatgagttgttttggcaagctaatcttccgatgatagtcatgaattcacctagaaaggactcgtttatagactgagtagtactatagttctagcagagagtgtatgccttgaactagaaagagagaaaaatcacgcaaaggagaaatcttaggcgggaaaacaggcagctcctacatgcaacctacataccaacacagctcttgcagatcatagctctcccaaccagtcaacttttccagcggtctgaacttctagaatacgaaacctctcagatattgcccgtaggcccttcaaaccatcaattagcaaaaccctgaggtaacattaattgtgcgatatgtgcgataggtctcaggcttagtaataatctggtattttcctaaaccataatatttcgcaagtgagacatatctgatcttgcctcgtttgaatactcacaatctttattgccagtggacaccaacattcagttcaacagggaatttggctttttaattttagaattacatgagcagccttcattgagtattgcaactatatcctgtacaacatttaaagagaatacaagcttataattgccatcatgtctatttccaactactacgttgctaccaattctaatgatagcggcaaccatagacaggagcaattagagataccgaccaacaagactcgttcggagtcgtttcctaaggtctctgagcaggtgcatcatgttccccagcagaatctagaactccaaaggcttcaacagcaactacaaggccaacagatccaacagcaactacagcaacatgtgaaccaatccttgcaaaatgttcagcctgtccagccaatgtttgatcatcaattgcaaaaccaacaacaacaacagcagcaacaacaacaacaacagcaactacaggggatcccaagcaacagtcccagtcactactttagacagcccactcagaatcttcataatgggaatttcaacatgaatatgaacttgaacatgaatctactccaacaacagcagcagcaacagcaacaacaacagcaattggctaggcagtatcaacaacttcaacaacagcaacaacaacatcaacaccagcagcaagcactgcctccaccacaacaacagtattttaatcaagctacagagttcccagtgacctcccaagcgataacaacactacaacacatccaacagcaacctaccaattactttcagaactctatatttgctaccagaaaggaggcttatctacagtatcacgattgtccatacgagtctattaggaaagagaacttctgggtaaagaataacgataacttgaccaagatatcctgccaattaaaaggctgtgacttcaaggttaacataaaaaagatccgtaacaccaccaaggattctcaaacgtctttgcccaaggaggaaactttaggttttgagttgaaggagattcacgcacataatcaccagcatttgcccacttatcagatatcagatcagatgtacataccagttggactgcataaagagttgcagaaacttatggagttgcatccagacacaacctccgctaagttgctcaaatcttatgaaatcaacgaagtgctgggactcaacattgacaagtttgagaaaacaacaaaatccaaattgttacgattcatgacccgtcagagatcgaaactcaagctctccactccgaaacatcaaaagaggaaaactgacgacttttatcagggtagcgagcagagcaaagccgattcaaatggtaaaactgagtccgttgatcttgcagatgctgatggtcaagttcctcctaaaagacaacgtacgaaagctgatacaactgaatctgaattttacacccaactacaactggatcccactgacagcatgctaaaaaattctctttccgacgaagatgatatgtctgcaatggctcaggttactggaatttccggcaaagaggagtaagtgagttttttctactatacatagtttattttctatttagtttagtcttggtagtaatgaaccctccaattttgagactctcttgagcagctgaactgatacatcgaaatctcgaaggacccaaagggattccaccataccacctactaacaactacaaggacattgcggcatttgtataactccaaaaggcccaaaaggcggttcccagcaccgctctcaccgtcatcgtgacttccttggttcaaaagcttccctgcatcatcagtaagccgccatgcatacatctttggatgggttgctttactaagaactttttgatgacattcggtgaactcctgtaaaactggctccagttggctaatttcggtcaatggggtactccacccaatgaactttgacttccgttctagaagaggagccgtggcattccagacacggcccaacctgctcatggtaagatatctctatctatttacccacaacgatgcaatcgtgaaaatttcaatatctcaaaattgaggttttacttatataataggatttagtttttatataataacgtccgataaacattacagatcaacgaatccagagggtccaccctttgaaaaaccaccttccttaacagccaactcgtagtaaccatagatggttgtaacagccaaaaggatggaggttcccgaacctaaagtacccaaaaggtcggaaacaacggaaagtgcaccaattgtggcacctccaaatgcagcggctgttggtataatcttcttcaactccttgtaaacagtagcatctctgtgtccagcaataaccaatccttggtctttgaattgcttagcaacgtctcttggggaagatcccgaaatctcaatccatgtcttggagaagatggcacaagtggtcaaaacaaacacaacgtagacgacagtcttgatagggtctaataaagcttgactcagggacattggaggctgcatgtagtaggctaatcccgaggcagcaaacagttgtgctgaaccaggttgagcttcccaagttccaatgagcttaacaaaggcattgtcagggaagtgtgaatacaacatctgggaaataatgaaaatgtttgaggtcaaagcggattgtaacatgattggcatgttggatgtgtagaacaatctgattgggtaagttccgtaaggacctctttgacgggtagacttaactggaatctccaaacggaagccctgaagatagacaacggtgaaaaagacgacaagagtagcaataacttggaacatgtttggagcgttgtctctgtaaaatgattccaacagagctctcttcttgtccttcttggtcaagatcaggtgaaagaaagaaatgaaagctccttcaaattccttacctcttccacggttaacggtggtaggagcaaaagtcttccaaaaaatctgctcacaaatgttggtggccatgaaaagagaaattccacttcctaaaccgtaacctttttgtaagagttcatccaacaaaatgaccacaatacctgcaaacaccaattgaagaaccaacaaaagacagacaccaactcctagttcaccaggggggccatacattccagttaaaacataaacagtagcttgtccgatactcagcaaaatggcgaacactttttgagcagtttggaacaactctctgtctgctttgttttccatgttcacgtccaagatttggattccctgcaacagttggaacaccattccagaagtgacaataggagagatacctaactccatcagcgttcctctgttagaggccaacatcatacgcagccaaaacaaagggtcagaggagtcacttgaagtgataccatacaggggaatttcactcatgaccaagaagatcagaagagtgactccagtccacatcaacttctgttgaaaggggacctttctctctggagagataacctcaggcagaaatggggtaaagggctttaccaagtctagaactctgaagctgctcatcttaggttctaattaaatggagcgtgttaagagcgggagtactaacaaaatgtaagaaggaacgatccaagacaggacacgtatcattgaccttcgcgaccaacatctggggggagttaaagagtcgcgcaatgaaatttccagggtgcattgtggggggagggaatttcagttggtttactcggtttactctgggatatacaatgcaagaacgtaggcgacttgagggcaaaaacgctaccatcattaagtgaagcgtgtgtgcggtaaggtggtaggggtcaaagatgtaactacgacgaatacgagtttttttcgtttttttttcctacttactttggtttgccttccgggttgctatgtcgtgttgtccccgagcaaacaattagtctttattgtccgttgtccgttgcccatctaatcacccagtctcacttgtccatatttctcagctctacaagattgttatctgacttttttgtccctttgattttgttcttcacagaattgtcttccattcgtagttcatcagctgtcctttcattttttgtgtgaacaatctcttattttcgtcattgggctccacgatgaatctttccaagttacgcttcttgtggcactcatagtaatgacgagtataagctaaaagcctattaaaccagcccttactgggattgtaatcaggcatggcatgaaatgtcatagagctcatattcatacagtcaagatgaggacagacagctgccatgtgatgcaccgtgcgttcttcagctactccagaaacctgttttcctcttttcttctcatggaaaacgaaatcatcaatgagaaggaagggatctggaattctggttccatcagatagcaccccgtgattctttcccaaatggtggacatagcttgactttttgatgttaaagaaaacctcgtcatatgatctaatgtctatcacatttacagtgcaataagggcacaatccttctacatttgatcggtcatcctccctgaatctcaacaccaaaggctggtaaggatcatgggccttggagttggaaatgtaataatagccatccctgatgggaggaaaactctctgccttgattctatttggtattcggaagtactccaacggaactacctgcttgcgatcctgtgcttggaaatagctgtaattagctgagagagatcttctatgacgactctgcgtgcgaagagattcaccgccgtttgcggtgtgagtttctagttcttgtcctggttgagagctgaagcttgaagatcccatctgttcttcctgagagggaaatatctcttctacaattaccttggactcttgtggatttatctcttcacctgcgtcacaacctgattcggaagaagaagttttggtggagatcaccattttcttcaacatattctgaacgtattcagaactgcagaaagccgtgtcttgagccacaacctgtgctcctcctacttggacaggtaccgggccatcaacactcatgacatcaattgcctcaacaagacttccaccctgggagttaaagtgaccgtcagcttcataaccttccgcaattgtctctgattgacaatttggatcaaattgaacagagttaaaggagcagaagttgaaagtttggttggtcgttgtctcccatggtgggtcttgaattgcatggttgtaagggccaacttcttcttccgaatttaacataaattgcctgtgaacatcctgaggacttgattcaaaaaagtcaagatcttgtgaagaggtatttccatctaaagagaacattgagtttccccctggtgtggtccccaggtgttctatcgatgattctctacttctacgtggttcactgaactgaggtgttgtgtgattgttttccagaacctggaaagagattttggagggaactggaatgggacctgacgtctggactttttggtttaccggggactggatttgaaactgggtttgaatgggaaattggactggttcttgcatgcggacaggagtggagatctgattctcagatttacgttcaggctggatctgggtttcagctctgcgggcagctgaatcttgggcttcattttcctcccgaacagcttctgttagaagcaatcccatgtcattatctgaccattcgatcttttgggatatatctgccacaaaaacacttgggttctcttttgtgtctacttcaaattttaccggctcttcctcgcaagccgttaactcatgcatgaccatatccatgtcattgagatcttcgaatgcatcgacgtttaaatagctgttgatgtcgaaagttgattcaatcatgtaaacagtagaagagaagcaggggtttcaaatttggagagttagaggtttattatatagaccattttttcttcggaatgttctgcagtttgagagaatgggatatcgtcttcactagatacgacaccagttttcatcctgcatgaatagttgcggtggaagtaagttcttgtgacacagtgcaaatttagaaatacaagcagccaatcgatagaccttgtttgtgacaattcaatggtgtcttttcagaacttcctgtgacatttagatcttgtgaaagctttggccatcgatcatggtacttgctgtaggaacctgcaaggggggtacaaaaggaagaacttgcgcgagaaaatgatctcctttatgcaagtttattttgacagatgttctagaaactttctagaacggcttaatcgcattctattacttactctctttgaaagttaattgacgtaaaataagttttcaaaccccaattgtcttgatgcgcttctgtatgtcgtccacgctttcgatgttaacaagatacctccttgtacacaactgttcaatagttcaacttgttctactcatgtacccctcagcgttcagcagttttctatcgtctttgtgtaacgtttcccattttcatggcacccaatcgtttcatgtcggcccaattatcctatttcaaattttagaagttggatatcatggatacccaaattggaaacaactaagattgggtcacgtgatagcttttttttacgttttttgaagtttatcatatttctgcgtattccgtctgttctcgttcgaagatgaggataacaaggatactcaagcaggataacaagctgaaaaacctgttatattcgtccataaaaccaaagagcaataatttgctggatttctttgacaaaccgttgtcagagttgacgactaagagaccgataaaggactcaattctagggctcagggaaactaccaaagacaagattgtcccctctaaagtcctgaaattcatttgttacgattccatgttagataaatctgattttgatcatttgattccacatttccaccacagaaaatttgattttgatgacagagctatcaaattcgacgtcataaaaggaagacgtagttcaaagtatggccttaaaagcaatggaaattattaccttatttttcctagtaaagaatggagcactgctttttatttggaaactcttgacaaacaaatagttggaatgaacttcaaaccgaagttcattgatcctgaaggagatgtagagaacggattggcagagttgaaaagtccctcatccaagtcttcttttcaagatgaggtgttgccattttccgatcttccatggctaaaatcgcacttaaaggttagcgattatataaatttaccagatcaacctacccagcaggataccaatgacgtttcagaactcccttctcatgaacctttaaaaaatacagtaactatacctcccattgatagaagaaatgtggttatactaagaaacatgatacctcaaatgactgcgaaagagttgggtgaaaaactgagagactattctttgtacagagttcaagatagagctgtttgggagcttgaaaataaactgtttattgtcatttttgacaatcctgacgatgcccggctagttgtcagaaggttcaacggaaagcattggaaagatgatcccaatttaccggttgtgtttgcagaagtattagagtagagactaatggtcaggaatatcctatgtcgggttgtatatagtgtataagtaacgagagaactgggatacaacagttgttcggatagtataaactctgctggaacttttcagtcggcctttgaaaaattatactttcacttgtgctgcttctgctacttatcgtccagatccgatcctctaaacgatgtgatcaacaattgtgaacaattagtggtctgaatgggcagatcctcaaaactagacttatttctgtccttcagaaaattggcgacatttcagctgtataccttctgaaagagggtacttgcaactcatttatttggcttctggtgaagcaaaccaacagatgttttcacattaacgctcgataggcggggaatgggtcaaccatgagggttcatcatttattcgaacagagtaagtagacaacaacttgaaaatttcaccttttcggtctaacactggtccagtgaatgccccaagcttaaagcaaaaagtggtgctcatttaatgggaactaccatctggttgaacgccatcaaaaactacattgtaagctcgacaatcaccacactaacagccagttggaataccagacaaccaagcacagattaagggaacctctatcaaatctcgaaaagtggaaaacatcagagacggtaaagtaactcttccatacatggatactattgtattctattcttctctattgttgtcgtgcgcacaatctaatcggtcacattggagaatatggggttcaagtttcaacgccaagggatagctgcctctgtattcttagttctatatgccatatatttcggagttgcggctaatattatttggcagaagaaaacattcaattctttttacacctgtctcctcgcatttggccttatcagattgggatctcaagtttgtggtatagcctttgcaacattggggtatgagcatttgaactggttgattgctcatttagtgctgggagctgctgagtattttcttctgattctgaccactttcttggtggtctcctacgcacacaaagaaactcttggttcttcttatatgaccaaggcgttatttttgattccgcttggttttttcaagttagatgtggacagattgcttttgatacatattgggggaattctagccaattttctggtgatttctggagcatctacactggcaggcttgactccagaacagtatttgtttgatactaatactgtcaatataagcaatggactccgaatcacaggtcagattattcttttggctttcaatattttagcagggctttatgctctgcactcaattatttatcttaagattcgttcatattttgtcttttcggtgcttcttgccaccccatttcttttggttagaggtacctatgcagttgtcgcttgttttgttgataaattggactctttttcaattgaaaattatacattgagtggcatgaatcctgaatttgtcattactgagtatgtattggcaaccacaatggagtacatcgcagcatcaatatttctgtcaactttttacctaaacaagaggcagaaaaataaaattatgcacgcagtgctgaacgaagaggagcctgaagaggagtttgaagagaagtcggaaggaaactctggagagaagtctgaagagaagtctgaagagaaatctgaagagaaatctgaagagaaatctgaagagaaatctgaagagaaatctgaagagaaatctgaagagaaatctgaagagaaatctgaagagaaatctgaagagaaatctgaagagaaatctgatgtgaagtctggagaaaagtctggagagaagtctggagagaagtctggagagaagtctggagacgaattagacgagaagtctgaagagaaatttgaagacgagttagaaggggagtcagaagagaatcttgaagaaagtaataataatcataaagagagccttgaaggggggcactgatgaacgtcctgaataggttaatcggcccaaaaactttttttaacctagcaatacgtcactgttctgtattgcagccgattttatgactaccatgctaagtcaatcctaagtaatgtcctcgtttgtgctggtttgataaatttatagacaattttaatgcatattgactttttgaacaccgagatatagagccgttttggatagcctgagcacaacaagaaatcctctaaccatcggcaatgtagcattgaaactccctacattcattcatctattggtgcccacaatgataacaaaaaaaggtctgaggaatcatagtagttgttgctcgttcgtgcctgtaattgaactcaagctgtcactcatttaacttttgaatgtagaaccacatgacattgaaagttagggtctgaaagaagatggataacagcttctctctccagcctatttcgatccaattttcaatgctccatgaaacacaacctaaagcagatcaaaattttcttatactaaatttttcgacgcacctgaacagatgaacctggttaactcataattagttgcattcttattatatctgctagtactaaacatttagattcaatcgggcagctctaaatctgctgattttgatgggatttccattctcatctataggttcaatttcctgctctttttcggatttcttaaatcctccattatataaatgtaccatcttctgtctaagtgtatggtagtcaagattaatttgttgatcaagttgatcggtggacaactggatatcaaggtcggtatcttcgacggacattatgggggcgtgctcgtcaagttcaaactcttcttcatcgtcatcatcagtttcatgttccataacatcagtcagtatgctcttatcttccggtaattcttcttctccctcttgtttttgcttggaattctccttcctttctctggcttcgacgatagcattgatcttctcaaaatctttgagttcattcactacttcgccttcggtttgtatgtcatcatcatataggcccaaaacataggcctttgccatgctatctatatcatcatttaaagatgggtagtcaagtgttggttgcactattgaaatatcatttgatggttccacctcagttggctctgtttcaggctttgggtctataatttcttcaatcttgtcagatttttctatgctgggaggtataatttttggctgaacggtgtgattttctatcacattggcagatttgttagacagcgacctcttaaatctagatactttagcagttttgggattcgtctttagatgttcttgatcgtttgaattattcttattaaatccaaggttcacttcatccacaatctccataggcaaaggagcctcagtaatgctcctctcaagcacaacctccgacacaggctgatccggaatagggttcgaatcatcaggtatgggaatagtctctactatatcggctactactgctgattcttttggtctttccttttcttgtctcaatttttgaacttggctccaaagcataccgtttgcggagtcgctatcaggtatccacgagatatcatcttcactatcatcgtcttcatcttcaaagtcgtaatcaaattcaccttcgatgggtaaacttgaatcttcgtctacatcaagaccttcatgttccatctcacctgcaataacttccaaacttaaaagctcctcaggatcaatggctggagcagtatttactttggagcttgcattcaccactgactcggtcgtgtcaaactctctaacctctgaatgcgtaaatgccacagttttgctttctttggtctgtttgcctttcttctttcgtttaaatcttgaactctgagacgcttgcttgagaataggtttaagccccactgcagcatgctcgtttccattagtggaaggttggttccctgacttgctaacatacatttcctccagaagatcatcgacgagctcgacatcgtctggattgtcagatggtaggctctcatccttcttctctgtattctttataagcactgttctatcttgaaccactcttgtctcagtttcctcttcagcatcggtatctttagcttgctcttttatctcctctatctgcgaagaagcgttgtttttatcctctagttcaacgatcttctctaccagagtttccaactcatcgttgttcagttcagcctgtttaactgtggatctgagcaccccatcgttatcgtcgagttcttctcttatctccattatcggaagcgcttcagtatctccactttcatcatttagtttatttttggcatctatatcatccagcatcttcatcttggtcagcagctcagttaacttctcattttgctccaagttcatggttacaggatagcttgctgaatcgaaacgaactgtaaaagcaatgaatcttgcactaattatttgcaccgcgcaatgtacagggcatcgattatgtaatagatatattttcaagcgaaagtggattccattcttaccaacccttataccacaccaacagactccctttagcctctcaaagtcatgcctccctatgcgcaaatagtcataggtcctccgggtagcgggaagtcgacgtactgcaatggaatgaaccaatttttatcctctatagggagatattccatgattatcaatctggacccagccaatgatcaattaccatacgatgtgactatagatatccgagattacatcactttggaggagataatggatgagacaaaccttggcccaaatggaggccttgtgtttgctatgcagacattcaaggagagcattgaagagttcataagtgaagttcgcttgttgattaaaagaaaccacaaggctgagagtgcctatttaatatttgattgtccagggcaagttgaactgtacacaaataatgacatagtgagtcaaatttttcgaatcttgcagaaagagcttgacttcagactagtagtagtcagtttgacagacagcattaacatcatgaaaccctcaagttacatcagctcgctgctattagccctgaggtcaatgcttcaaatggacctgccacagattaacgtgttcagcaagatagatttacttaagggatacatagaacaagaacgctacgggagagtgaaacccccgaaagataaaggcactacgacagatgatggtcttccgttttcgttagaatactatacgcaggtacaggacttgaaatatttattaccctatcttgaagttgaggagaacaacaccagaacgaactttttcaaacacaaatactacaaacttaatgaagcaatttcggatctaatagaagatttttctctgctttcatttgaagttctgtcaattgaggataagaattccatgattagtctattagccattattgatagagccaacggctactccatgggatctaatgagcttggtaatgacactatttgggaagatgcaattagacaatcatctgtagccaactttctgcaagacatcaacattcacgaaagatgggtggacgaaaaggaaaagtatgacgaagttgaacgaatacggagggaaaaacaattcaaggaggcgacaaataatgaggagctcctcaatcaaacaattgatcctgaaaaagattgggaagatgctttgaagaaatgggagacctcaactgggaagcctgcatttaaagagtagctaatgactcaataacttgattggctatctgtaattcgtcgttactcaaaccgtccgttttcttgatgtattccttgagcgattttactgtatcattaatcttctcttgtaaagcgggaataatgttcttggtttcttcgtagatctccctctgtttcttcaaaacgtaaaccgattcctcatcgtatgggtctgagttgattttttgctctaatttttgaactgcctctttgtgttccagcagctccgcctcgttgactgacttttctttgatcaaacgtttcagggcgttagttttgatggttaatgtggatggcgaagacattgtgattaagtgttaagtagttagttaaatgggataattcagaaaataaacaaaagcacgcgattgagatgttggatgttgaaagagaggaggagtcttatgcgtagggccatgtatagaagtcaaagagttgaggtacagacgatcgccttaccgaagcgagtggcttactgaagacggtggacccagttgaagattctttgacttactacgaatgtcttctccacacttgatgatgaaataagaaaaagaaaaggaaataattgagaaatacgggaatcgaacccatgtcacctgcttggaaggcaagtatgataaccactacactaatttcccttggatgtaatcatgaactaaggttatccccatgtagggttatttttcaaaaccttgctttcactgactcaatttcttatcgaagacgagaccatacaagtacttattcattatatttcatcaagtttattgcatatagcaattgtgctgtcttgaaataataggctggtgtcatctcttgataaaagtctctgattggattatgctaatattgaaaatatagtaggaacattctaaaatttttttgcgttttcatgttatgttttagtcaacgtttcagttgtgataacattggaaaattacaatgagttcacgattggttgactttgagctttcattaagggctcattctacaaattagctttccccactcaaaaagttctgggacttttgattccaatagtcaaaagttgtacccataccagtccgaccttcttataccaaattcttgtgggtaaactaaacccaatagttattttacctacggaaaacgtaacggtgtgggaaacaaccatattatttacaggaaaagtaggtgtctaatcttaccaaaaaaatttgcttaaatactgagagatacgggaatcgaacccatgtcacctgcttggaaggcaagtatgataaccactacactaatctccctcagttttaccaaagtgaataatatgctatacatatcacataatcataactttttgttgagacggaaaaacttttgaaccaggtttcttattttgtttcatgctctatcaagccaaaatacacctgtggatgctatccgatcgtatctctctcgctcctcataatcactctcaacaacaacaacgatgtcggatgtcgccaactacaacgctgtatatcttcgcgacatccataattccaagaggcaaatccatcaaagtatcacttaccttaacactatccatcaaaatgcctacagtggtgactaacgagtcctctctcttgcaaacaaccgtgagtgttgcaccattggtgcttttatctgttgttgatcactacgaacgagtggtgcaggcacccaacgccccaactaattcaaacgacaaaagagtcgtgggggtcattttgggagacaatacaaacaagaacttgatcaaggtaaccaactcatttgccatcccgtttgaagaagacgaaaagaacagggatatttggtttttggatcacgacttcatcgaatcgatgatggaaatgttcaagaagattaatgccaaagaaagacttattggatggtaccactctggaccaaagttaaagtcatctgatctacaaatcaacgagttattcaagagattcactccaaatcctttgcttttgattgtggatgtaaattccaccgatatagtcgatattcctacagactcatatttggcaattgaagaaattagagacgatggctcaagtgcagaaaaaacgtttatccatttaccatccatcatccaggccgaagaagcagaagaaattggagtggagcatcttctgagggatatccgagaccaggcgtgcggaaatctgtccataagattgactaacaatttcaaatcgctgaagtctttaaacgatcgcatagccaacattgtccaatatttgcgcaagattttaagtggagaattaccaataaataatgtaattcttggaaaattacaggacatattcaacttattgcccaacttggttgccgttcaaggtgatcccacaaaaccagccactgcaagtgctaaccaactagccacatcattcaatgtgaagaccaatgatgaattaatgatggtttacatctccagtttagtaagatccatcttggctttccatgatttgatcgacaataagatcgagaacaagaagaacaacgagaaagataaggaattcacaccaacagaggaagaaccccaacaagcggctatagaatcgaaataagtagctatctgaagcctgatattgaattaattttctagattaaaatgacttggtgcttttcctcgttagaaatgaaataccagtagtgtatataccaatatacaccgaagacctaagaccccgatactttcaagcttcttaaagtattaaagggccttcatttccccgaatattcctggcggtttctgctttttacacgttgtaacacagccttcaagagtgccagtttgtaaagggcacaaatttaagagggaaaacgttataaagaaatatcgtaaaggcaaaatcttcatagcccgtaactctcaaaatcatgatgaaaagaacggtatcaccgagcttcatccggtccatggcttcggcatcttgcttctattcttctaacaaggtattgctgccgtcagtgatcaatttcagccgtagtggcacagagttcaaactacaatttatacccaattaccgattaccaggttctcgaccaatagtcacagataccgcacatgtattggagcaagttggaaggaaagctctgacctgccaaccttctgattctgtgtgtcagcaaaaggatagcaaggactttcacgatcggcaggcacttccatttaccgttaaaccaaaggagaaaggtactaagcctgctcgagtgctgtctactaaagactatatcagagcttatgttgccctcactaagccaaatttaacctttttagtgatgctctcgtcgatttcgacctacgcattaactcctaattcggcaggaatagctgagttggtttttctatctattggaacgatgttatgctctggggctgctaatgctatcaatatgggaagagaacccaactacgataaaatgatggtgaggacatccgcaagacctgtcgtcagaggaatagtttctcctaaagaggctttcacttttgctgggatcacaggtaccattggaactgccattctgtattttggtgtgaatcctacagtggcaggattaggattcttgaatatcgtcctttactcctggatttacacctcattaaagagaaaaagtatattgaatacgtgggttggggccatagttggggctattcctcccttaatgggatgggcagttagctcttcactagcagatccgggtgcttggtgtctagctgcgctactatatgcctggcaattccctcacttcaattcgttatctcataacattcgaagtgagtataaacgtgcaggttatgtgatgacagcatttgaaaaccccaagttgaatgccagggttgccttaaggtactcattcctcatgttccccatttgcttcggtctcgcctatttcaatgtcacagatccatattttgtactggactcttcgttattgaacggatggatgtcgtactggacgttcaagttttggctccaacaggcttctaactactcccgaaagactttggcagcaggaggagcttcacaggcagcggtggaactggcaaacggatatgcaaggaaagctttttggtgctcagtgtggcaccttcctggaattttagtgctggccatgttacataagaagggccaatgggatcgttttttctcataaattagacattatctgtatataaactaatattatcaccttatgaattggaatttgcttacagagagataagtatgataagcgaccggtttaagttttctccgcccagccatctcaagctttcaaattcgctaacttctttccaaacatcccacaaaacaatccactaatccaccttagttcatcaatgtatctgccgaatctcatgaccagagatgtacatcatctctggatgtaccctagtaaggaggaatcaaaattaagcgtctccattttggaaagaaaaaagactaagaagacaacacagaacaattccttcgcacctccattgacgtcctactcatccgaaacaccggggtctacctccctgacgaggaatcatgagtctcgtggtcccaataatggccttataattacagaagaaacctcagtacatcaacacaacttgaactacctttcacatcaggtttcaagtaagctaaatgagcttgatagttatagaaccctgggatttaactatctccaaccaccaggcatatccacaactatgaaaatgagaaaagcccaggagaaagaacagaaggaacacagtcacacacaagaggttcatactaccgaacaagctcattacagccagattaattcagaagaagtgggcaattcggccatgtccttgattgatatggatagcagtttccacatggattacgaggggctcaataactccaatatgttggatgatcaaagcaatatttcagcgcaatctcatgaagattcggtaagcttcgatgaagatgaaaatgttgactccgatttcatggttatagaagaggacgaagatgaagatgaggagtttgaagttggagaaattgaaagtccagagagacagaatgaaataaacgaagacgatagggtgttagcaattacagctccgactagatttcagagcaatagactgcatcctaggttttccagcgggtctgtcaattctaattctcacttgagaaatgaagtcacctactcggaagatgaatgttgagggtattttgttaccattctatttcactgtatattactgtacattatcagctttatgcttgacttcgtcaactctggagtttttgaagtcaatctcatcaacccttgcatcttgaagatgtattgcgggtatcatccattttccacagctacatcgggacccatgccaggagtaagcaccaactttaccctgacatttgggacaacaaaactttccttctaattcaccctttgaaagttctgctttcatccaatccagaggctctacgaagaaatgagtgcacttggaagagcctttctccactcctattatcctgttatttcctgctctctttataaattgagattgtctatcctcttcaggtggaggaatgtggggtacaaatgaagtcgaaagtgcaattttctgtctacaacgcttgcaacgtagttcagagtcagctgttgcttcagctgctgtattattatacattgaatcctcaatttgaaaagtatcgtttttcaacgctagttccaacttccattgtttatacagtggactgtccatgctttgaatctcattgtacaagtttaattgctcgatgaaaaagtcatttggtgcaatatcaggttttttcctccttatagcatatatactgcttttaacatctagtttgtatttcttcatcaggtagcctgcaactaccaccacagatcgagaacagccttgggcgcaatgaacgagaatgctggacttgtgacgttttctctcatcttttaagtcggcagcagcaccaaagagagcttcatctataaagttgtttgcttcgtcgaaatgttggagaatattagtcttgtcatcatcaaggacacttatctgtttgtagttgtagtttttggtgtattcttcgggtacatcgtccgttaatacactcaaaatactagaaatgttatactctttcttcagatcaactccctgagttaatggctcaatagaggaaacgtaaatcccccctagaatcctggttggggtagccattattgggtgagatgagatttaattttttttgttacgtttctactttcgctaactaaacaatcgataactagtttctgtcactgttcaattctggtacaggagattcttgcaaaagctccagtagtttttccttatcgggtcatatgtagtgctcagcaactcatatatttcttcagacttgttcttgtcagatttctggtagatttctgcagttaattccagggcctggatggaaattactcttggattctccactagatgagtgtactgaattgcaaacaagttcaggtcttctatgagcaatatcaccgaaaacttcttatatattgcttgaagatagttccaagaagacggattctctggacaaagatcaattttatctttggtaaggatgatttcgtccctcagatattctttgtcgcatgacgaattactctcgatatcaccaaattggaccaaaaatcgatggttccaagcagaattattcctcacatcaaggttgattttgtcattagtaaattcgagttctctctgagttcgatacagtttgaatttttcaaccaaccatcgtctatgagaccagacatggtagtttttactatcctgttcaatcattatatccaatagcggatactccaatttcaataaatcatcaacagattcagtctctttctccaacaactctataatttgttgtctataaggccatatctgatagtttttttcgttctcgtaagcaatattatcacaccaatccagttcctggaccaaatttttcttcaaatgaaccacaatatcaaatctgtacttccatatcgtgtaatgagcactagctatattaatcacctcatctgttataaaatacgctctttctgaatactctttctgtgccatcaaggccttggcataccccattaccttcttgaattcctcagtgtacaaaatatgacaaagtggggccgttgtctctgcgatatcaattggagtaatatcgtcccactcaaaatcctcaaatacaaccatactgcctcaacttactgagtggagaactttgttatatagtttgggtgcaagtgggaagatggttatctgtttgagattagctaagttgccctattaggcccccaacaatgttctcacttcccggttgaggttccctcccagaaatatcgcgccccttccacggtttcctcccaaaagagtcatcaaactcttttttttactaaaatcttctcgtatctgcaaacaaaaaaaaaatttaactctctctgctccgtcagataccagttgacaggttgaaaacatatcgtcaatatcagaaatgaccgtcgttgaaccagtgggagatgtattcaacactatcttagtgctggactttggttcccagtattctcatctgattatccgtcgtttgagagagtttaacgtttatgctgagatgctgccttgcacccagaaaatctctgaacttccattcactccaacaggtgttattttctctggaggtcctttctccgtatacgaagaaggatcccctcatgttgataaggagattttcaacctgaatgtgcccattctgggtatctgctacggtatgcaagagttggcctggatcgataatgttgaaaacgttgccagaggtgaaaaacgtgagtacggtccagctaccctaaacgtgcaagacaaggactgtgctctgtttaaggacgttgatcattctcaggtctggatgtctcatcacgacaagttgcacaatctcccttccggattcaagactgttgcaaccaccgagaactctcagtttgcaggtgttgccaacgaggccaaaaagatctatggtattcaattccacccagaggttacccacagtgttcagggtaaaaccatattgaaaaactttgctgttaatgtctgcggagctacccagaactggaccatggaaaacttcatcgacaccgagatcaacagaattagaaccttagtcgggcctaccgctgaagtcatcggtgccgtttctggtggtgttgactctactgtcgctgctaagttaatgaaagaggccattggcgacagattccatgctatctacgttgacaacggtgtcatgagaaaaaatgagaccatcactgtcaagaagactttggacgatggtctgggtatcaacttgactgttgttgacgctggagaacagtttttgagtcaactgaagggcgttactgatcctgagaagaagcgtaagatcatcggtaacactttcatccacgtttttgagaaagtggctgctgacatcaagccaaaagatggttcagagattgaatttttattgcaaggcaccttataccctgacgtcattgaatccatttccttcaaaggcccatcgcagactatcaaaactcaccacaatgttggcggattgacggagaatatgaaattgaagctgattgagccgttgagagagcttttcaaggatgaagttcgtcacttgggtcaactattggacattcctgaagatttggtatggagacatcctttccctggtccaggtatagccattcgtgttttgggtgaagttactccagagcaagtcaagattgcaagagaggccgactacattttcattgaagagatcaagaaggctggtctttacagaaagatttcacaagcttttgctgctttactgcccgtcaaatccgttggagtcatgggagatcaacgaacctacgagcaagtcattgcattaagggctattgagacttcagactttatgactgccgactggtttgtctttgaagctgcattcctgaagaaagtagcctctagaattgtcaatgaagttgatggagttgccagagtaacttatgatataacttctaaacctcctgccaccgttgagtgggaatagagggaaggagtcagaaatggtagataagtagatgtaaatttgttgataattgttagacaatattctatgcattattaagttgttgtcgtattactgtagaggcaatatagtctccatcatgggtgatgctcaccagaaactcttcatttggatgtttcgtaaaataatcttgattcataataaaaggacggccttttgggtcgtttaacttgaaccaatctttgaagctaaacaattgttgatcgctgtaagataagcttttaaacagtgcctctttaacacaccatgagcctgccagaagttgtacacattggctcttatcgcagtcttttgaacttttcagaaacagagggtattctctttctgggtgcaagattctcttcgcaagacgaaccacatgacttgaagtaacgtttggatagttgtgcttcgtcaaaatagtttcaaaccttgtctttcttatcagatcagtgcctattcctaggactgtcatagttggaaatgatgaattcaagttttaaggaaaacccacatcgagggagccctcgcaccttgttggtgtcacccttcgaaaaactctacaactttcttcctgcccacaaagaaagtcggatcgtgatgccatgcgaatagacagggcagattaccttgaaatcaacaaattggtcacacgattgtcaattgcattgatcctgtttgctttgattcaaccaagatatccttactcgattccattcggttttattcttgcgatgctagttagctacaagaaccctatagttgagcgcatgtggaaacgatttctcttcatggggttaccaaaactttctactgaagacaaaaagcttctccaagccattgacgctttgagcaagtataaagcaaggtcaacatcatggaacgacagacgtcgtgtgttgttcagaagaatgccatggagacatcagaatattgccatgaaattgggatttacggccaggatcaatgacgttcagaaatgcattaatgagaattccaaattgacagaatcggtcattgaaatggtaagagatgaatatagtttgccgccatcctgtcctccagatttggctattgaagacaatatcagagttattgagacattgtgccattatgccagggattggtcaagtctaggggatgttgaagtgcagccattggtagattacatcaaggatagtataactaaggttctgagccaggacgcacagaggcagacgaatgtgattgttcctgggtcaggtctgggacgtatttctcacgaattagcgttattgcctttccattccgtccattcagtggaatattccacgctaatgtatctgtttaacaaattcgtttactcagattctccaaaaacctataaagtttatccctttgcgcattcctattctcatcatgtggaagctaaagaccaacaaagatcgatagattttacccagctgccagaaaggccctctaatctacatattcacaatcaggactttaacgagttcaccctatcttcccaacaggaaaaccttgtcattgtcactgccttctttttggatactgctgaaaatatgtttgagtattttgacacgatagacgctttgatgaactctgtgacaggtaccaagctttggatcaatgtgggccctcttaagtatggtacggcagctcgcgtggaattttcttatgatgaactgaaggctcttctgtctgagtacaattggaaactgttagatgaacaggatccgaaaccattgggatatctcaccaatctgaaaggtctttggcaaggtaactacggagttacgatgtggacagccacgaaataaactaaatatgcatcccctctattgaacatctctattatacactcctgttaatttgaatctttttgtcatcacccccactcacgatcccaatctctctgttccacgctacaccaaacaccttattattattctttttctcttcagattctctagtgattgtgaacacggatttattagctctaatatcccacactttactagtaccgtcgtgggaaccggaaacaaacatatactcgttgttaggtgaaggtgctagggagacaacaaagtttgtgtggcctattaactgtgattgcacaacggatttgttgctatccactctcggatcgtgcaaattaatatgtcttgccgaagatccacaggcgatcaacccaactttatccaattgtgttattgacaaaagagaataggatgtagccctggtatctacacatctggcggttactaagtcccaagttttgactgtatgatcctgagatgccgaataaccaacagtggagtcttttttgtcaaaaataactccctcaactggggatgaatggccttccaagaatgacaagggggctcgtctcttgatcgagctgtcctcgatggccaacttggctctcttacgagcactggacgaaacatgggcaaactcgttaattagtggtgctgaagcattcatatcatcaggattagtagaccagaaggccaaactatgatcggcactacctgacagaattctattcgtagggctgtccaatgccaaagataacactggtgccttatgtccttccagaatggctattgttgtggctgatatagattcttgctgggcttcaccgttctcttgaaactcttgtgggattgtagcatcccacaggcgaatttgtctatcgttaccagcgctcatcagcttagaagatgaaatgaatttgacatctttgattggtccaccatgtccagctagctgtgcttcgttattaccggacatatcccagattctgactataccatcataagaaccagataagatttttggctgtgtggcaagttttggatcggaactcaaagtgtctacgcttgaaatccaatcttcattgttgaaagatgctaaaaaatcaggtggaagtacagcacggctgtactcaagagtcagaaatgcttccgtagaaagttctcttgatttcaaatactcttcaagggaagtttttagcaatgttccattgataaggaaatcaaacggaattggggaatcatgtcctataagatgattgacaatctcggaaagaccgtatcttttcagggaaacgggaacatacaatggattttccgaaacatggattgtctcatcctcgtctctggtaatgaaccggatcttaatttgctcttgtgactcggacattgtgtacttagagggtttggaaactgaaaaaaaaaaaaaaaaacttgcctaataaaaggttggatctcatcgggtgcgtgcacgaccaaagggtgttcccactctatcatgatcatgtctaacgggaaagagaagacctctgaagttatcttataaagtgaatttgctgcgtatgattgtcctttttcaactcttttgagtactctttagtctacagttttccagtatcttcctcactgggaggaaactctataattgatagaatatccttcgcgagatattctccacggagggatatctggtgggagatggcgcgtatggtgcaactttcttccatcttagctaacagcaccactatttcaaactatggatttaccatttgtggtttccgctccaggtaaagtaatcatatttggtgagcatgctgctgtctataacaaggtttgtacaatttttcttccacggttttttctcttctccttctaacaatttaagcctgcaatcgcagctgccttgtctttgagaacttacttgttggtgacacccaacgaagattctgagctcattcgtctggaattcccagatattcatttcaacaagtcatggagaaaggatcatttcccttgggaccagaaaccaaattataatggaaaaccttccctttcccaggagttggaacctgaattggttgatgcattgagtttgtttcttgctgatataacttctccttttcattactcttcagcttacacctttttatacttgtacatttctttggtgtctaaaactgttcctggagctactttttcggtgcggtcgactcttccgattggtgctggattaggatcctctgcatctatttcagtctgccttgccacagcatttgcattattagacggccatatctccaagccaaccattggaagagacgagcgtactctttctgagtcagcagactgccaattcattgaagcttggtcttttcaaggtgaaaagtgtcttcacggaaacccatctggtatcgataatgcagtagctacccatggaggtgcagttatgtttcaaagaaaagagggatcaatgccaagtgtgcgaactagtatgagaaactttccttctttacgcctgttacttaccaatacgaaaacagctagaaggaccgcaacattggtagcaaacgtttctacacttgtaaccgagtttgccaaaacatctgagtttattttaaatgcaatcgacagcttgacccgtgaagcctatatcttaatgacaaaaccagttctggatgctgaggctcgtagaagattgagagagctgataagaatcaaccatggactactgatctctttgggagtttcacatccctccctagaaaagattagaatgaccgctgacctactagctttaggcgaaactaaattgactggagcaggaggaggaggatgtgccataacactgttgaaagagtccgttgaagaatccaaagtgcttgagcttgtcgaagaattagagaatgaaggatttgagacttttgaaacaactcttggtggtaaaggagttggagccaccttcaacccaactcttgatcctagcgagttcatcaagatggatagaattcaaattgaacacaatgtctggagctcagactggaagttttggtgagtcgaaacattatattctagtcactttttatatacctctattgaactctacggtgtttaatttattacctctagagtcggtcaaattatggaactttgtctctagtttagaaacatgtatctgttgacgctggggaaatacagctagtgcaaatggcaatacaatcaaggaggtggcacagatcaacccaatattagtaaaggtctgaattccgacaccttttccttttaagaatcctttttgcaatttgactaggattaacgggggtataaccataatcggagtagcattaataacacgtgaagcagcagtctccccaactgcgtaaaaggcggctttctttgaaagacccacgtcgtttccatcttgatcgaaaacacttatacctttcttgatctcttctcctctcattaaaaatacgttcacgacaccggcagatacaacagcggcaaagggaaccaatcttcctaggatcattctagtgtttggagctaatgactttaatcttggaacaatcgagttcaaccctaaggcgaccgagcatgaggctgttacagctaaggtgtaattcgttataagctgacgagttgacaatgggtgagacttgttagaatttgcaatgttgatcgcaacattcagtgactggttggccacttgccagaaaagagtccctatgcttccaagacctggggttaacatacctgctgtcaccaccaggttactcaaaacgcatgacgacattctgaatggaagcaacacagtttccccagtgtcaggatgaatagtggagtccaaaactcttttggccctccataattctggcgtcatctgcttgatttttccgttcttaaaatcagagatcagggtcttcgcagtttctacatctgcactagtgtttaacagcatggaggggtccgaaattccagcacagtgctttactctccccatgtatgtgttgaggtcataacgtgactgaggcagcgggatgggaccaggaattgcagaggccatgttttgagatggttggagtcaaataagcaagaagtgagtaagcatttcatgcatcaggaaaaaaaaaaagagaaaaaaccgttgaagagaatcgcgggagacccttagtggctctgtcagatagtcacttagcgtcaagcacgagtgtgaagtgaatcccaagcaaaagggccaaaatctctatttatgcttagattatggaaaaagatgactaagaagagtataatcaacataataggaactacaggagttggaaaatctcaactatccattgagctagccaagaggtttaatggggaagtcatcaatacggatagtatgcaaatgtacaaaggacttgatataataaccaataagcatcccattaaagaaagagagggaattcctcatcatgttatgaatcacgtagattggaaggatgaatatttcctgcatacgtttgaaaaagaagcactcaaggccattgaagatatccacggtaggggaaagatccctatcctggttggaggaacccattactatttacaatctattctattccataacaaggtgattaaaacaggaggtagtgcaaaggatgaagagactagttcaacccttaccccacatgaaagacaaatgattgaaggacctccagaagaattgatcggacacctgaaggaattagatcccatagtggctgaaaagtttcatccaaacgaccatagacgtataagaagagcattagaaatatacttactgacaaagaagcctgcttcagcatactatgatcggcagagggaagaggaacgtcaacagtcgtcattgaggtttaacactctgaacgtttggctatacgcagatcaaacggtgctagatgctagattagattccagagtagacacaatgcttacagaaggtggcttagatgagattcaacaattatatgggtattataagtctttggattctcagccaaatctgcaacatggagtttggcaagtcattgggttcaaggagtttatcacatggcttaatgaaccttcagaagaaagtctacaagctgccgtggaacaaatgaaagcaagaacaagacaatatgctagaagacaggtgaaatggataaagaaagtccttgccaacgaattgttgaaggaaaaagcacacggatatcccaacggcggccaaatatatattctggaagctacaaatttaaatcagtggaaagaaaacgttacttcaagagcattagaaatcaccgatgcttttttagaattccgacacatagaacaacccttcgcctcaggccacctaattgacttactaccccaagaagcttcctcctccgaaaaggagagaaaaaaatggaaacactacgaatgcgacacgtgcaaagatgcagatgggaataaagctatattcgttggtgatcagtatgagatacatcttgcaagtaggaggcatagatctgcaatgaacaaactgaagaaaagacaggagcgtgagcattatattacaggaaaagatgctatgaagaaggccaagtgtgataaacaagaatctagccaaatttaattccaacgtcggggttccacagctcattagaataaccctttgaagacttgacttcactttttggttgatctgaaacctgatcttctagttgttttttctgaggagatttaccttgttcaaatacagcatatatttcctgctccagcttcatggcttcttgtttacgaaagttgtagaattcttgacatctcaaatagacatcatttgcctttccagtgaaatcattgtaaaaactaagtccctgtgtgaggttgtttaccaaatcaaggtatccgttataggcatcgtccaacaactgaagtgcattttggcgttcttgcgaggcatctatattccctctaagctgattgaattgttggaccaaagatttaatatgcttctctaactcgatttggttgtccctgtgtttttgaacaaatctgatatcagaatcgaagttgctaacctgtcgtctgaacacttcttcgaacaattccgtcgtgatcgtattaatgttgttttgttgtaatttcttataatgggaaactaccaagggcaatatggacaggtcggtgctttttactttaactgtattaataaaagtttccctttgcgatgcgagctttttgacctgattaacatcagctcttaattcgttaacgattcggttcaattctggaggaagtctgacgaattttgaatttggtacaaattcttccagtaatttagttgaattaggagcactcatcatgcttagtagtggcttcaattgttcgaagtcattccagatcacttgatcaccatcatgggcctgtttcaaatagccctctagtgcctgtacacttttcctgacatctgctgatgcctccctagagtcagcaaaattccacctctgtgatccatgcttccttctcatttcctcattttcggactcttccatttgtagcaattcgacacagttttggagaacttgctcacttttgtgtcttagcttgctgatatcttcgaaaaataccttaagtttgtccatgccacccctttcattgagtatttgacaatgttcaaggatgttggttggcaatctttgaggcctttgtatggtatctatcaacgccggaagtccattttcagcaaggattgtgtgaagaatctttgtcagcatctccatgggctccttgatatgctttacaacataagaatcctgcctctctctaaatgcctgtgcaatttcaatcactaagtatggcataagatcatggaaaaggattttgccgtatttctttgtatctttcgcacattcagctgaatttaactcaactattggcttaggttcaaccatagatgctgcaacaattggaggaagatctgattcattaggaacttcctgcagatatattagatcattatcacgttcacttcttcttaaagagtctttgattatcttcgaaagactctccaaatcggaagatacagagggaaggtgatacttggcttctctagatgctgtttcgcaaatggtatttgcaatccttaatcttgctatttcctctccatgtctagaagcagcgactgccacacaagcaagtctaaattgggccgcagccttaaaatgcagcttcttgcaactcatatgttctatccattcagactttaaaatatcgcacttgtaagccatagacagagcttcatcgtaaaattgagatacttgaaaggccaaccttgcaataacgttatcttttaaagtgttagaaacagccttttgccaaaaacattcctgggcctgagccagcatgagtttagccagggttttcataatgttaacactaagatcaatgggaagtgtcagctctttcggtttttgctccactagcttcagtacactttcgaatgccccactactatactgaaaataaatgcatgattttttcaagccttctcctgtagctctgggctcgtttaaacctatgattgaatacgtcgctgcgatgttgtacgctatattgattctttcgaaatagagggattttagagctacggggccagttacttggtatcctaatgttccaaaccagggatactccataaaataatcagggagtttttggctaatgctggctaactgtacatagtatctcttgagcaatgcaagtccatcattgtttggttctattgataggacatcatttcttagttggtcgatctcttcgatatccgatttgaacgcagcagatgtctggtagtactgattgttgataagctcttttaggctttcgcctaacggtatcggctttgacgttcgtaaaggaacacttagcaggttgaagctcatcacccgtgtttgaactgatacttgaaacgtaaatatcaatagagccactcttcgagcaaacccatttcctaagtattctttactggggccacctccggccttgggcccagaattttcctccttctcgaccacacatcttttcagccttccacgctctcccgtcttctttcttaacccaaccgaccctcttccaagttcaaaaagcagtcaaccccaggaccaatggatgtttatcatcaatttcttgaaccgacggtttgcacgcactctctgtctgcaaattttacgaactctgtcaagaatgatttgataatcgccaaggggacactcttacagatctttgaagtcatcaatgttaccatagaaaacaagcaggacgaagaacaaccagacttggagttaaatggtgctgcttttggtattggtgaaatcaatgaagatgcactgaatgtggcggcaattgatttttctcagaatgtcaagttgtcacttgtggcagaatacaagttggacggtcttgtgacagacctgtgcaagatacgaactatcgaagattcacatcatgattatgtgctggttgctacgaagggagtcaaattttctatgatcaaatgggatcaatcatcgaattccatatcaacggtcagtttacatcattacaaaaagattgtggagaattcgttgatagataaattcaatgtcgacacgaagttaattgcagatcccaataaccattgctcgtgtttgctagctaatgagatcttgttttttctaccgtttttacagcatgaggtggatgaagaactagatggtaaattcgtagagaacaaaaagctgtattctaacacttttttgcagttttccaatgacttgcagccaaacatcaaaactattatagatattgaattcctgcatggctactcggagccaactttggctgtcctatacacttctttccctacgtgcactggcgctcttcccaaagcaaaggatactgtcagcttacaagttttctcattgaatctacaaaacaaagcaagtaccagcattattgaagtaaataaccttccttatgacactgacaggattctaccactgtcttctcctttgaatggatgcttgctcatcggagcgaatcaaattattcatctaaattccatgggtaccgctaagggaataagttgcaacctgtttgctgccaagtgctctaatttcaaactaagcgatcaatcaaacttagacttgaggcttgagaaatgtgtacttggacaagtttataatgataaagtgattctgatcaccgagaagggtgccttttatgcttttagctttgatattgttggaggtgtcagttcgataaatgaaattcaaaagatcgctgctgaaaagtatcaaggtttagtgctttcattgccaaccatgttcactaacatagatgggaagactttctttattggatgccaaggttctgacagtgttctgtttggttccaaggcgcgcttgaacactcagaatgtcgatgtcaacggaaaatcaaaggttataactgaggaagatgccttatacgaagaagatctttatgcagacgatattcagaatgtggctcaaggaattgatcatatagattttgttaaactagactccctgctaaacataggccctataacaaactttacaactggttctattgagtatagatccaagctgcaaggtcttccgaatccaaattggaatgatgaatgtattatcgcagctggaggattacatgaatccggccagttaagtcttatacagcctacgatttctcctactgtgagatcttccttaacgtttaataatgtggagaaactgtggaccttggaggatgagaacggagattcgcattacttgattacaactgactccaaaaaagccaacactgaagtgttcttggttaaacaaaactacaaacattactcttccaagggatttgttactgggactttcaccaaacatatagcagtcatccctggtaaggatggaactggtagctatggagagtcacgtatagtgcaagtgactgctgagaatgtgatactttatgatttcaagctcaagaaacttttgtcattgagttatgaaggtgatgacatagtgtctgttgatacttttgaaaactacatgctaattactaaagagagcggtatggctgatattttgcactatgacgaagagattgaggcagtggagcatggtgataaaaaagagtcagatggagaaacctccagtaaaaagtccaaaacttccaagaaaggtagaaaaagacgaaggaaggaggagaagatggaagcatttagggtgaatcacaagctcgatgtgatcccactccctaaggctcttagtcaaaatgactatatttttattactggatgtattgctaactctgacattttgaacaaagtggatataggctacaacaacataattttagaaaatggagaaaaaggtaaaaaaagtcttgttttctttcttgttacagcagagaattcaattgtgatgtttcttgaaaaccataaggaaaaggtgttcaagttgagcgaggccaaagacttttcgactttcttgaacatcgaactaatcaaagtcggtgaaattggccaaccagatccctttatcaaacaaatcaccgttagtgaaattggtgacgaaattgaaaagcaggtatacctaactattttgaccattgggggtgaagtgataatctataaacaagtgctaaacaaggactcaggtacattccagtttatcaaagacaactattccgcaaacattaccattactggcgcaccagataacgcttatcctcagggaacaaagttagagagaagattgataaagttaaacaatataggagattccaagctcagcactctattcgtggtaggggtgaagtctttctggattacgaaaagacattcttcatccatcaatattcaccaatttacaaaactatctactatttcttgtgccagattcaatacatcaagatgcaaaaacggtctaatgataatcgataccaacaaagccgccaggatggtagaaattccttcaaacttggagttgtctcaaagacttccaattagaagagttccagttggttgcactatcaaatgtgttgcatttcataaagcatctagaacgtttgttgtctcaacagtggaagaaactccgtacaattgtgtcgatgaggagggaaatcccattgttggggtggacaacacaataaacaaacctgccagctcgttcaagagttcaattaagttgatatcgcccataagttggacagtaattgatagttttgatttggaagacgagcatgtgtgtatgagtcttaaatccatgactttgaacacatccagaattccaatgtttaagaatctgaaagaatatttggtactgggtatctctaattaccgtatggaggatcttgcctcaaatgggcaaattagaattgtcgatgtagtggacatcattcctgaaccaggcaaacctgaaactaaccacaagttcaaggacatctttcaggatgctactaagggtgcagttacttcagtatccgatataagtgggagatttgtcattggccagggtcaaaaaattattgttcgtgatttgcaagaggacaatacagctctaccagtaggtttcgttgataccccattttatgtatcagaaaccaagagtttccaaaatttgctgctggtaggtgattctatgcatagcgtaattcttgttgggtttgatgccgagccttacaggatgataagtctaggaaaagacgttgcgcacgttgatgtgtgtgcagccgatttcgttgtctttgaaggaaatttattcataattattgcagatgaggacggcatgttgcaccttattcaatacgaccccgaagatccagcatcaatgcaaggacagagactgttaagaaggtcaatattcaaaaccaatcaatatacgacctgtatgaaaatgagagaaagaaaatatgtcataaaacccccaaagaaccaattcacaaacttctcggaggcatttgaagttgttgctgcaaattcagatggctctttctataaggttaccccaatttcagaagctacatacagaagactgtacgttattcaacaacagatctttgatcaagaaaatcacaaatgtggattgaaccctagagaaaacagatacttgtcggatcagtattcgataccaaatcaaaggctaatcttagattttgacaatatcaggcgattcctggagtttgacgagattaagaaacgtgatttggtgcataaattgggcagaaacacttattctgagttttacagagatctcttgaatctacaggagctctagttaggattgcatataatacatagatattatgaaaactgttcttagtgatttaaattttcaagaagattgttgtacctgagttcagcctttcgttgaattttctttgcttcatccgcttcgtcttgaagtgcttcagttcgaacttggatcaccatgcgttcattctcacgaaagtgaccaaagacgttatactccatgtcaagtttaattgatagagtctgcagctcctcaaggctttgaattaattggttgtgtttgtcaatgatatcctcattttgtagattaattgtggattcgagttttgagatgtcatcaatgcgggttttcaaatattgtgatcggaggttcctgaaactctttgtgtactcaaatgatttgaacagatctaaatttctcagatggtcctgaaatttcaggaagctgtcctggttctttgttatttcttcaaatatctccaaatctgcttgttgtttctcttcctctgttaattgtgtgattctgaaccctggaacatcattgacctgattatagtctgattctatcattttcattatttcttggtcaactagatcctgcaacaagttgttcgtagaaggaattgctgtaggtgatggcaatggcaaccctcgttgaatcgtttgggatcttcttgaaagagatttgaaatactcttcctcttcatgaagctttattcttctctctgcctctcctaaatcgatgtattgatcacgaatttcattttcattaccagtaacaaaagcttgggattcgtggggaagagtaatttgaaaattattcttcggcttgggcagctgggagaatttggttcgaattagagcaaccaatcgtttcctctccttctttgcagaaacaggtgctggcctaacattgtccaatttaccattagtactttctgattctagttcatcagcggtgcttcctataaatgattgtttttgggatcgccttattaattgttgcgtagcttgaataatggcgtcatctgtgatttcatcaccgaccacagatccgggttcgggcaagtctagtttcttctttttagtgggataaagttcttcaaacaccactatttgagccatttgatccttcttcttctcatcttccttctctctctttcgttttctcttctgcttctgagcgtcctgatcttgaataccatacttgttagccctgagttggtaatcctccatttcttttagattggctaaattttcatcatcaacatcataagttccctgatatggagccctttcaaaaggaacatcagataaataatcaacctgattatcttgtttctttctttttttggttcctccaattcctgcctgtttcaattctcttcttttctgcaattcggcaatatacctactttcttccaaaaacttttctctaacttttcgtttggcttttttgccctgtgtattggccaacctggcccgtgcttcacttaacatttccaactcctcttcgtccatatctacagtgtcgagcatggcaggtttgttctctggattcaagttgatatcaccaagtttgaactcagcacctactggtgcattcgactcaatacctgggcctgaaagtcctagctccatgtgtcttagatcactacttactcctccagcttcttccaaaagtttctgatatcgctcgacgcattgagtcgccgttctcccagtaatattagaaatggacctccattggtttggcataagtctggccagtctcaacaattttgcatcttcatcccgagaccattcaagatggtttactctcgggttcaaccattcttcccatctagctttgcactgtttcgctgtcttcttagcaagtaaagaactgactcgagcccactgcgtcaacccatacttagccacagcagctttcaaaatctcgtcctcaacattggtccaagctcctcctttcacgtacacaggagccatgtctagttgataatgagaaggttctgatactaatacatcagctctcgaaatattaaacaagaatctggcatgattacataatcataacaacattacgaagccccagtatcgagagtaatgtgactaaagctctcttttcattcagcactcaaattaatggaaagaatgaaaagggggggtgtgtcctccaattaccagagtattgttattggaaaaaacactggaagtcttccaatccgttccaggagcttcctaaaacgccctgggcgtggatctgaaataccttctgctcaagctagccagccccaaatttatgaagaggaaacggatatggaattgttcgaaccaatgaagtgcgcagtaaagttccatgagccaagggcctccacggcacctgtcttattggaaggcaaggctgcactgggtatcaaaccaggaactattggagaattggagtctctagaaggtaccccaagaagattgatgttcctagtaaaatatgttgaggatgaaatacctagtagtaaggttaatacaagtaataatccaaatcagcctcaagtttcaattcaaactggctctttacaagaattactaatgttaaagaggggttctccagttcttcttcgattgagaaaacgtaaagatgcggaagcagatgttgtagagctgagaatcaaagatgtgcatctttcacgaggtgatatgtggtgtttatcatcaacgcttgccggcacttgcgtttataagcatgaaaaaaagtcatttattgacagctctatccgaaccacagtgagcaaaatatacgtcggaggaagatccgtgttttcagcctatgtcggaaagaatacacggattgttttcaggtcagagtctgtaaaactggtcatattaatccaaatttccagcgaaatgtgggattttgaagagactgggcaacaaatgttcaacaaattgataaactcattgtttccaaaagtatttagcaagtggactgaattgggtgcccaccatctaatcactattgtcttatttagtagcattgacttgggtaacaagtcttggtctttattaggatcaggagacagaccaccagatagaaaagactattacagggtagtagtagaccaggtaagcatccttttgtggagtgaaataatgagtgccttacgttttgaatttgccaattttatgaaggatattatgctgagggaaaataaggctccctgcaagactgataggaatgaagagtatgtcatacaaggtaggttcttaccagcagtaaaaggaaacttaatcgaggcaataaacctggccactacacttgttactgatcatttcagggatccagagctcagatatacttcaaaccattttattttaatttcaccaggaactggaatctacgacgtggattacaatttgatggctcatactagcaagaaaatggcaaaggtagatgcagccatagatgttatatgtctgagtcaaccaccattgcatgttgtaccacttttcaggtacaaagaatctaactcgaaaattcgacattgtataccgacctggttggatgtaagtttctggaatgattcttcacagtatattagccaatggatgccaagatgcaaaatatatgaaattcaaatgatgggagtagtggaaaatgaattaaaaaccattaatcttccgaacctacgaattaacccgaatagtaagtctatcaatgaagtcatagataaatatgacgaagatgtctttaaaccagcctctcctcacactacagaagtaaagaaaataccacttcatctaagccctgaagtattgcaagttcccaaaaagaactcaccaagcactgagacgttcaaaattaatcagacgaaagagtgtcagccatcaacgattgatgtgaaagctttaggtactacaaacagcagattaggcatctcagcaaggtcatctctgctaaactttatcaatgacgattcaaagtcagggatcggcaactttattagggaaagaatatcttcacttccggcctctttggttcgagtaaaaagtgcagaatttgataaagaagagcccaaaacgcagaccgtcaggccagtatcaatgtttactatgaaggaagatacaataaaatcaaaaagtatacaacctccgaggaggttagaaaaggtagtcaagaaagttgaaagtacaactcaatccccaccatcgttaactagaactaatagttcggtcagtgtaccagaggatgttaactcccaaagagatgataagttgagtccttactggacaactgttcagaatcccagcaaagctttaacctcagaactcttaaagatgattggttatggaagatggcaacacgtttttccatcaaaggttaagagaagggctgtcaagtggtcctcattatcaacccctgcttctctccctctcacgacacaggtttttcctaggctttctgactttgagtctaatttcactttccagatttatgatgttatccttaataacaatgatacaaaaataaacactggagatctaatcagagagatgatatatctgagactggttctcggattccaaatctgcactggggagaaggtagatactgttgagtcacgaaggaaacctggaggagatccgaatttgttgatcaagtatctggataaacatagctatcacgggtccagaatatacatgatactggaggatgaaatccacagaatcagttgtgattatcacggaaaggcaaatgtgcaattgtatcgccgatccaataaaagcatcaatgttaaagcagaagacgttggatcttacttcagcaacataagaaccagatacgatgatctttatcgaccatcagtagttgattgcttcaagaatgagatcaaatcctataattggaaccaattggatcaaattttggctggctactatgagtctgtggatgaagatcaaaagtactatcataaaatgaaatttgtaatacttccagccgatattccggagaaatcttatgcttttaagctgaatgaaaataaagaaaaattgagcccggaagaactgagattagaaggtcttcgcaaactgattgctacaatacacaagggaagacatgttgcagaacaggataaaactaaacaagctaagaaagaagaaattctcccagagatcaacttttacactggcgatctgttcacatttttgagcaagcaatccgaagtctacgatccagataaaccacataaaaacactatgctcgttgaaagtttagggcttaacactaacatttcaatgaagcaattagcacattatttgcagtcgaaggacggaattgttttagctgatagaaaatggcatttccgaattcaccgtcattgttttgttggtttggaattggttagttggatgattgagaatttcaatgacatcgactctcgtgaagaagccgaacgatatgggaataagctaatgaacaacggactgttcagtcacgtcgagaagcgtcatagttttcttgatggtcactatttttatcgtctgaacagtgaatacgtggagaaggttgaaccaggaaatactagtattaaaaccagagaatcccgctcaaattcgataactgatagttccaagttaaaatctcccatgttgtctccccaaacaactagggaacgatctggtacgatcaccgattcaccattgaagaaggtcaccagtaaaactactgatggagcaccaaagcggtttatgttgagtcgattcgtcatttacgacgttgatcaacagaagaaatcatatcgtagggagttggtcaaagtccactacgatagagtgcacaatccagagcattgtttccatatccgtcttgagtggctgaatacaacaacgaagttgattgaagatacagtaaacagttggacaaggttgtgcgaacgatatgggttgaagtttgtggaaaccccatgggctgagctttgcagcatgcctgaaaaaaatccattccattcattcgtcacgattagactggctttaaatccatggaacgaaaaggagtttactccagaggacaacaatcccttagacgaaaacaaatttttctaccatctttatttattagacaaatcgggctttatgctggacaatcgtacaactattttctttaccaaagtggagataaatgttgcatactcatggggaacgccagaattcaagtttgcccagttcatccataaaactggagcttatattgcagagattagagataacggagatctgtttctagctccgaacaacacacatgttgctagagtgaatatggacatcagcaacaataatatctaccagcaacaatcgaattatggaacatatttggacagtcaaagggttatgctggaatttcaatccacatgtggggatgcagaaaagttgcgaaaactattcaacgaggctagagtaaagtgggaaaaaagccgtgacattgaccaagccatatttggcagctgagagtcgattagaaacatttcatagtgattgtatacaaagtaaccatattaccttggctgtcaagccatcttaaccttattttactaagggcaaatagttaaacgtctgcaagggcaattcgctattcgatgggtcgttgccaaaaatccaacctcaatttcagaacttctttccacgaactcacgagcctgtttccggaagccgaagtcaattccaccgaatgctgaaactaaaacctaagcatcagcggtttatcctacaatgctatccgggagggaagagcaccgaaaaaaagcctaacaatgctgaacttagccacctgctctactacgctaccacccgccggacgaagctagaaaaagttggcggcttcttggaaaagaaaaccgtcaaggacgttggacatagtcgaatcggcaatgttttggtaactttggatatcctcaatcagctggttatccgatgttctgacaacttgagtgtctttgcagataatgtcattaacatcctcactaacgtgtcaacactgcatgatttgacagttcaagagcacagtttcattttattcaagagcttttgtgagaatgtgactgtcaagtccttcaccggagagaaaaaaataatcgacaggttcaataagctttgcaactactacatcgagcagcaggagttggcgactaagtcacatacagaatcttcggattggttaattctttccttgaaaacctgtgagattatcgccaagtgctatggtaactttccgagtctggacaaaaggattattgccaagtcaatgaacttgattctgagtaaattgtcgttgaatgaacatcagcttttgaacagaaccaaaactaacgtgtcgcacgaaattaatacagataacgtggaagaagttgtgttaaagtctctcaaagcacattttaatactacatcaactacatttcttacgcaatctacaaagtcagtagcagaatttattctcagatcaaaaccgagtattcagggtccatggtccaatgcccttttggaaatgttgacttcttggactccagttcaattaaggtttattgttttgagtagcctaatgtccatattggaccataagaatgaagccgttctcaccgagaaaataagcaatctgctgtcttcatctgtcagtttagttggattgtccgtaatcgacgttttaagacagttccttacgctgcaagcgaattgtttaaaatccaaattgaacttgacagaaaattacgtcaaatgcatatccagtctggctcttcatcattattacagatctcaagttccggatatggttaaagagatttctgtaaagttgaaagaaaattataacaacattgttctatttgctccagtttatgccaggaacattgaaatgatctatcaaacatcaaaggaaaaccccaaagatatgaaattcaaatacggaaatattgatagttggtctatactgttttccatccttgctctcaaaggaagttctcttaacgaagacgaacgattgcaggtgcaattaccatttctgaagctcttcattacgttcctacaatctttatacagtgagaactctgagtattctatggcagtacccaactataacgaatatctaacgcgaacgaccaatccactttcattatgtttttacatgctagacaaaattgttcctaatgaagagtctagtaaactattatcacagattattcccttgttgttaaagatatttggagtcaatgcagtgaaaaatggtgctccgtttgtcttggaacgacctgaaggcgagtcctcactattgttcttacattatgcagcgacctatttagatgaccccgagtttgaggatattgtctcaggccatatcagcaaagcactcaatgaaaaccaaaatatttccgcattggacttgagcttgcctaatggaacaaagaactcaaacttcagtccaagagacatagagaagcaagattttgtcaaagtgatccaatccaattttgtgtccgatattccgtcggtggatgaagaaatgttcagagtctcaaatggaaatcatgtgctgaaaaacatgatgatgatgaatcgttctacccgctcgttgtcatccccatattacacaagatcaagcccacattcctctaacaactctacaatcaacatcatggatgtgaaaagtttcaatccaagaacttttagtctggaaatacgacgtccacctcagatatcagatttgaaaagggctgtgagtggtcaagatcccactgtttcgtcggtaaccagtaaacttgttacaccgtcacttttggagaacgataacgaccttatttcacttcaagatttggtacaccaacttgctgttgattcagcagatgaaaaataccatcagataaatataactccataaatagtccgtcatatatgtacttttactcattatataagtatttctctccactttgtcgtctcatttcaactgtactcatattaccacgtatctctctctattcgctatcaccatcactgtccataagagcgtcaaatgcgttaaaggcaaccttgggctgatctacaagggtagaagagtctgcaggattcgaagaaatcttacttgacttgactttcaagttgagctctctgaattgctgaatttcaacatcatcgcttgcactgacggatttgcgagtagatttgccactagaaatgatgaatccatcctcgtccacctttggaggatctgccttcttctttctgaacacaggtctcgtgccaagcactgaagaacgtctacggccattaaggaactggtcatctggaacttgcgtctttacttcttcgacaagagcattgaatgcttccaaagcatctttctttgagaccactgcatgactttgtaattctaataattgttcttctgtgtatttgaccatggtaaaggatatctccactttgtactgttggaatgatgggcttttcttgagtttttttcttcgatagggatgaaatggatggcacacgactaaaactaggtttcctcactagatctttagattaaatatttttacttttttctttttggaaagatccctatctagcctcactcccagcagtaataaagaaatgcccataggaaagagtctaaggaaagtaaccaaaaatatttcaaagtcaaaaagtgctattcatccaaagggtagaaagttcaaacagctgacgagggcatccctaagagagaaaaaaattgcagccaaaaaagaactgagatcagagcagaaacaaaatgaccttctgatagttgcattcttccaggattctatactggagacgagccgattagacacaaaaatattcaccatagacgacatgaaagctttcattgagacattcatagctcgggacgatcaggaattgcaggacctcaaagattcaagaagacctgggagaccagccagtaataagcaaatgctgctggaagctagaagggaacaggaatgtggattctattcagctggatggagcgtgccagacctgaccaacgaggaaaacgtccagcgtttaagggcctgggaggggagctttggaggagtcacttctctcaagttcgtttcagtaagtgaaaaatcacagtaaaatgttataattttgttaagggcatgggatacagcactataaggacaaatacagcagccataccacctaataggtttctaccgagtttaaaagttttcgatttgcggtcactttctctctcaaaaaccagtaattgatcctcctggagaccccctccaattaaatgccagttctgcttatgcagtttggcaattttcttggaatagacctccggatcgcttaattgactcaagatagtaaacatatcacgaggaatatactttggacccagtgggtttacacttgactttgatgttgaaccatctctatacatgatcatgtactccttttctgaatgtgagtttgcaattgggaacaggaaatcattagacaccaccaccttagaatctaccagggttttcggaacacatacaggagtaaagaaggttttagtttcaaaagttcgattctgtttgttgttttgagtccattcatagatctttttagcattaaacatcgattctctctgtaaatctctcgacttcttggcgtttatcaggaagacttttagagcatcgatctcttcagtagttacacacgatttttcatctggaagcttcgtagtgtctttcttcattgtaggtacagcatcatcacgaggtctcatcagtaattcggcctgctcgttattaatttccctggtaacgactggatcaatggattggttgtatctatctaacaatatgcgataagcccccgagtcaccagagggagtctgctgacgtttgcacgcagttttatttataatttcgccaagtttagtgttctgcagagttagattcttgaagagttgggggcttttttggagatggctacacatatcattgatgcgatgtctttgtctcgtcgataacgaatgtttgtttttaacagatgccttgaagtctcgtataacaaattcgggtggagtgttctttggattagtttcacgcagaaacctagaaaagagagcccattctgccttatatttcttggagaaggccttcatgggtgcagaggaaagagagatcgggagatcgcacttttgataaaaagtgaggtactgacattagtatatggattgattatttttggaagacaaacatgaaggttccaaaacatcataatcaaaaatcatagagtggcaaaggcaattcggtgtgaaaccattggatggtctatttatatagtagaaattgtgaatgttattgagatttgttcttccgatttggttgctcaagttccaaggtcctgctacctccttccaagattcattcaattctaattgatagttcatttaaatatccagtctctatatcctaactactacgttaactcttccctgattggtctttttcattcgccaaatcattcgtctcaaaacgtttcttgtgggtttagatagagttttattctcatcaatggtatcagctataaggacatccgtagtactatttaccaccttcttagcaagcctactccgcaacttttgtctactagttgcctttcccgagagacgggactgacgaatcttggatatagtatttttatatctcagcctacgactccttcgaaatacacttggatctgtaatatgccccttcaatatggaagcaactattacatggaaaaggcgtctaatggtcctcaacctggattgtctcggaggcggaatagatcgcatagccgtaaatttgaaaggataagctgagtaagtttttaatatgcaatgttccaatgggcgcacaaatagagagaggaggttgaatgcgaagaagactagaatatggcacacacctgagataattcagtcttcatcaataaacccatactcgtattcttcagccaatgagagaagatggtcaacaagctcctctcgttcgtcgtagctgacgtatcgtttcacgatatctttcatatttaagagatcctgacgaggtttggtattaatgtccagtttgacgtacacatcgttatcgacaatctgcggaaacgtctgcggttgacccaatggggatacgttatactggttcattccccgtgaagaagttccttggcttttaagataatcgaaattgctgtagaatttgtttgtaggacctttacctctgtggataacacttctactgtaaacatactggttacgattgttaatcttgcctggacagagtgggcctgaaagaagcttgtcatcccaaaaaacatctcctataatgtttctgttactattcagcctaattgaatccacaaattgagtcattgagacctggtcttgagcttttgaattgaacaacccattgatactactgacaaccaccgattccacagcacttgattcatatagagactcactagtttgaaagagtggtaccaccagagagcagttgtcaaccataccgagaaagccatgtatcctagaaatcgttctctttaagttaacctccttttggaacaaaccataccctaggatagtctttttaggcaactcttctcttatatcctgcaacatctgggaaccaaaaccagcccaagcagagtctatgtctactataaggttaattccatccaataaatcactttgttcaagttctttcctgaaagaattatcaataaagctttgaccttcgtctttccaaacatctgctcctactgtaaaatcatcaaacttgacagattcggcagatcttaaatgcccattacctgaatcattttcccatttttccaaacattttattcttgtttcatcaaatatcattgtagagtatgagctccaaaactttgtgtcgtcgacgctgaatacaggcttgttctcatccaaggttttttggtagttactttctggtattggtggctgaacaattttttcgactttaaaatcagagtccaaagaaaaatcgggatcagcaggtgattcagcagaaactctttgcgatccaggaagctttccaattcctccatgaagatcccatagcaatgcccttggggtaagagagacataattcccagtcttgacctctctgaaaaaaacctctggctccaaatcacttttcccaatgcccgtataatcaaagtgtgattcttgctcgttgaaaaaatgagtcacaacatgattagcgtgattggatagacctatagtgaatatttcttgcatatcctaaggtgaagagcttttggaggaacttttcagataagcttcgagatgttggatggcagatataaggaaatagtggaccaacctggacaacccattgtccacccgagtaaaccttgcaaatactttgaccagtaactactgccatataagctcaccagaattttcttactacacacttcatcaagttttttgatgtattattcacgtattcatatgtacatagtagaccccagcaaatcttgaaaaatcatcgcgctagggttctttctcctctactacaacctgctacgtgtacaatgaagatatggctggtacttcttttagtttttgccacggtgtttgccgagacagattattataaagttcttggagtagctaaaaatgcggatgaaaaagatatcaagaaggcctacagatcgttgagtaagaagtttcatccagataagaacccgggtgatgatgaagccgctcaaaagttcattcaagttggagaagcttatgatgtgcttggtgatcccgagaagcgtcaaaggtatgacagatttggagcagaaggactggactcaagacaggaacaattccatgatccatttgacatgtttcaacagttcttcggaggaggtggacagcaacacagaggcaaaccaaagggtaagagttccttgttacatttagaattcagtctacaagacttttacaatggtgctagtaacgactttagaatcgaaatgcagaatatctgtgaaacttgttctggatcaggttcacaagacgggaaagttcatcaatgtgacacttgcaaagggcacgggcgtgttgttcaaacgagacagtttggtggtggcatgcaacagaggtttgaaacaatttgcccaaaatgttcaggaacaggaaatctgatcactcacaagtgtaagaaatgccaaggaaaccgtgtagttagaggacccagaattcacaatgtgcatttgggggcgggaactagtaggaaccatgttgagatcctggaaggtcagggagaccagtctccagactggattgcaggtgatctacaaatcatgttcaaggagaaagccgaaggcaacatggggtatagaagaataggaaacaacctgtacagagacgaagcattaacgctgaaagaggcattgcatggtggctgggagagacaaattgcgtttttggataaaatagagaacacgattactctttccaagaagaaaggagaggtggtagttgacggccaagtagacaccatcaagggtagagggatgccattacatgaccactatgacgaacatggtgatctctttatcaagtaccatatcatttacccgcaacaaattagagacgaattgtgaggcgaataggcagatagaaacagagtcgaggagtgtagagcttaatacagataaaacatgaaatgtacgagagtttatgaccgagagattcagagccttgctcatcaaccggagatacactctctataaacattgatctaccaaccacgtgaatctggaaataaaatcaacttgttttgttagaacaagatggtcccgacctcggcaatcaagttatgactatagaaagatgaactcataacgacgccgaatgattgttgttagtagagagaaattaaaatttagctgaactttgggcgagaacccagatcgtagtgaaaaactatgttaggatgtttgggaccggattgtgaccaaactcagcctcgattggaacctcggtagatcgcaaagacaatagcctagagggagtctcaaaaacgatcctgagaattatcagccatattcggccgcatcaccctcggatttcttctctcaactttgcagtgggcttctatctgcgcccgctcctaagaagagattacccttcgcgatggaatttgttctaaatctgaacttggtgaaaaacctttccgggggtttctcggtgcaccattcttcccagcatactttgaacatttctcaaaacacatccacatcgaccttaaatcgacactgaacacttatcactgacaaaagctggtaaaaagacctgtcaccttccatcccagtcacgcaaaaacactctcatattttcaaagcaattgacacccaggtctcccatagtcatagtatcagaaaacacatgtcagaacgtcagtccgttctctccgttggttcacacccgaacctggcgttctataattggcgtttgttcaaatctactatatgcgacctgactattgtaagcagtgatgggcctactgttcaatggtactccaagaaatttggcaattccaggtttacttcttcctcgaagttcacgtccttggatcaggtatttaattctggtgttaaactatacgatatggtgatcgtgtctgcttcctccctggatgaactatcgtcaatttgtactgatttacgtgattttgccaagagacaaatccagagcacgggaaaggcttttaacctgttagtagaatcaacaaactacgttaatttggaacctttcatcaagttgactttgcaagagccagaagtgaaaattttctctattatgagtgattttgatatcagatctgtcaagaaaaatacgtataaggtctgtgattcaaagaaagaaagcgaacttgtttacgttggtaaatctgatgagtcgaagcgagagtacgaggcagacgaagtcgttcagatcaacaaaatatctgatttgtatgaatcgtgtgaaattgacgtgtacaagttgggcactcctttggaatttctttcgtatcagtggaagtttgctttgcccaaaatctctattgaacctctatctatcatttttgaacaaccttttcccaaggatttacacggacaaatgctagccaaaccattaataagtgggctgatcatggaagttatcacagtaattaaagctatgggatgtaagctgttcaaatcttacgataatgaggattctctcattgagaggttgtgccaattatatccaagtgttccactaactgatgatctcatggaagcaccgaagctattttatgatttctaccatcaaaatgaactgtctctagatcttctattattacagccaatccttctggccgatgacaacaaaatcagaactccatatttggaatttctttatgccataatgtcacaattttcctcgatcaataccaattccaccgaaaaatcaatgttgtggcttcgtaagaatcctgaaaacttgaactctttaagagctcaacacgaggaagtcttgcgtctacgaactcaattgaaagaagccgagtctgcaccttccaagcatcctgctgaagcgcaaacaaatggccgtgactataaacaatttcagcaacctcatccagtagctcaaaatgcgccaattcagcctccatcagctgacgtcggtcctgaagaagagcttgaagaactggcaggtgttgttggagcctttggcgattctccggacattcaaaggcaagccaacttctaccaacaaaggccaccagttggaccttcacgccttacacatccacctccatcatcacaagttggaagggctaatagttttgtcagtcaaatgggaccaaaccattccatgactcagctgccaccccaaaacggtccttatggcagtatccctaccaataggtcccttggtaatttacacggacattatcaatcgcatggttacgtggagaatcaatatgatcagtatggaaatgtgatcaaaaagcctagaggccagtatccaaacaactcacaccaattaccaccccatgcactacctcctcaaggctttccaaatcaacgattcccgattggtgcagctcctcaagggtacggtgcaccgccattacaacagagctttggaggaccaactcctcctggagtccagtacccaaagccacccgtacagcggagagtatcatctgtacctcagatggactatgccccatctgaagcagcacttggcagcgacatggctcgttttcctcaaaaaactaaccgtaaaaacaggcaatccacattacccaaccttggttctgccagtgctgttggatacaatgggaatgatttcaacatgatgccacgtcaaaagggacacgcactgaatgcaaaggccagtcagagcacactcagacaaccgcagccagtgagtgttgctccacctgtgaatcatctctcgcaccgattgtccgtcatgggtatgccggaccagaaccattcaaattcagcgactccccaatcaaggctgcagcctcctaaccgacaaggaactaatagtcagagtcatagttcgaatagccaggggactgttacgcctgacagggacgatcgcgatttcactgatgacagacaatatctacatcctgggtatcaaaattccaacccggagctacagccaggggtggcagcagccggaggatcagcggcaccaacgaccgcaggtgcgcccggtactgaaaccactactggctctggacagcaacaatttgcgtccaagccacttgggctgaacgttcatgaacaaaaagccgaatctgacaaagacaaaaagaagaagagggggttatttggacgaaagaacaaaaagtaaaaagttgaagtttaggggacgcccagatgcccttttgtactgtgtatcactcacatataggagagataaaatgtaatttatgtttcttgacactactacacgaattcgtgttgttgcattcgttacccgattcgttcatagataagacatacatactttaaacagtgggggcaggtgcagagggctaatcaatatatatcgataagacagctttgaactaagcttgtcctgtaacttaccatggatatcatatcaagtgaagagcagaataacacacctacgggtcttttccgcagggagatttgcagtgagattgagggcaacacggattactgcctagagatgtggaaggtttacaataataaaaagatctatctgagcaactcacacagagttttgaatctgacgtggaggatgaccagtctgaagagtaaacagatcatgcagaaacgaaacagagagcactacttaagccaattcagcgacctgagcatgggcttggatcctttggggttctttaacgatgtgagtaactgcgagcagtttggaggcatcattgcaggaggcatcatcgaggcaggtctcattgatgacagttttatggacgagggtaacgacgacaatggttcgaatggctgctcccgctgctctgattgtggcaaccttgtctgcatatgtgctgactttgagtggatgaagttcggaaggtgagcccggggaggatcgaaggaggttctggaaggacggaaatgaccctgcagggggttttattcgtgggaaagaacccagagattttccttgcctagaaggcagacactaaggaaaaaacaaagaatacaaaaaaacgagccctctcccctcagctccgtctagtttgctagcaaaaaaataaaaaagaaagacagtataggatggtcccagtagtccaacagcactccaacaccaaactgcagaccttcaccatacctacaacgttgactatgcccttttttaccccagtagtcaacactacagtacctattttgtttatggttttcattacataatctactagatcatacaacagcctaatcgatgtccttgtcaaaggtctccccttcgaccaactctggaatctcagaatcgtcttcggcctcagctccctcctggttctggttcttcaaagcgttcaaagcatctgggttcttctgcaaagactcagcaatctgttgcaagaattgcaagttctcagcacccaattgtggcaaaatacctggaatcaaatcggtgatgttcttctcttgagcgtagccagtgaaagcataagtgttgtagttggcagcagcctgaacaccgactctgttgaagtgcagtacctttccgtcatctttgaagaagttagcctcctcgacaccagtcaaagtctggacgttgaacttctgcagagtggcttgcaatttggtgtcatcagcctcagcatctctgttggatcttttctgcttgagtctggcacctccgactcttcttgggccactcttttgtagcttctctaatttctgttgatcaattggcatcctatcgatggggttgggaaattgaaaaattttgtgaggtttcgaagaagagtcgtcgggaggactcgcgcacgaccctcgatacggctacaagaaagctaaaaaaaaaaaaggtccaataaaggtagtgccctaatctatatattatgctagggcgtctttctctactagtagcttttgggcggccacggggatcatcaattggaggattgtcgagtcatccatggcttcttgagcttcggcagcgtctttgagactggaaagcttctgtctgaataaatggtcaaagttcatgatctcctcgttggatacaaactgctggattaacgagttatcatccttaatgtcatcgtcatcttctggatttactttggactcaaactggtactccagattctgcaacaacgccaccctgtggaacgtttgtttgtgagaatccttttgtgacatcaattgaagatacaacggtgatttaatctcatatttgtacggatcttgcagctctatcaacgtaacagtctttccatttgaatcctgggcctccaaggtcttattcaatgtctctatatcccttctatgacgttctagaattaaaaatcccaaaagtctgtcctgcagacgagcggtacaagtcaatgggtcgtcattgatgttttggttgttgtattgaacccgaaactctttcagctctggttcaatttctgttcgaatatctttgacacctctgtaaacgaagatgttgaaatccagcggataatcggggatctgttgaagtttcaagcggatctcttcgttgagatctttaagctttggggaggggccagtctccaatacgctattgtaatccatgtctgagtggtggtagggtaagaaagatccagttcagagtgcatcttatcaagtcctgccctcgcgaaaaattatcactagctttaaagtgcttacttaacgctctctccacatcggccaagcttgccgactatctatcattaatattataatcctcacagagtgggtttctatctatttaccaaaaccgaactgcgaaaaaatgtcatggaccactcctttatccccgttgtctccagagtctgagtcttgtaaccgctgtttgaccatcagcttttctctatttctcttgcacgttaaagtatcaatgtgtctcttcaaagcgtctttcctggcgaagcccttctgacatctggaacagatattcggaagcacctccaaatggattttctcatgtcttttcagatccgacgagcgccggaacgccagtgcacacttagagcagataaagggtttatcaaccttagatgagctctgtgacgacatggaggatgtcggagaaacctgctcgtagacacgttttcggtatgtagtctcgcctaaagtatttgcagtagtaggtgtcggcgtcgtaccggcgacgctcggtatacttttgttggtattgttgttgttattgttgctatggaggttcagatggtgttcgtcataaaaaatgtcattgttgaagttagggaaatggttaatcgccagttcatccaccaagggtgtgttctgaacgacgctattgacgctgctcgcactgaaagcgttgcccatgggaacaccaccatgcggaggtgcagcgtattgcaatctcgtcaagacctgtttgatggaaggatcaatcgtgccgattttttcaagtgcctcattggctaactgcaaaaacttgatgtcttcctccgtctgtttgacaggcggcgtgggaggcgctatctcagatacttcaggggaggcatcgctgtgtcccataatcgacatctgtgtaggaagtctcggaaagtgatgtaaattggtttgctttggcgagtcggaattggtgatgaaatcaattcgggttctgttccttctatcgtcaccgtctctatcacggttgttagtatgccgtttgctcattgctatgcccacccacaatactccttccttgtagctttactctgttctagatgagtttttcagtccaaagaacagatgacatgtaggagtgttgtgatatataacactcgcaccgctcccatcacttttgatgggggtcttcacatcatattgataatcacgtttgttgttcgtaaaaagtgtggccaaaagtgtggatccctgatggcattttacttatgggaataggagttcggagggcggacttggtataataaacttttacgtacctctagggagtgtcgaaatgaatgctattgaaaatttcaaaggaagaagtacaaattaccttcttggttcctgaaagtcggaggaagaatagtcgaacatggtcactattgcactaggcctgagtattggtaataatagcactgtaatatcaatcatcacgtgaaattatacaagtaaggacggacaaaaagggaactttagtaaggacaaccgtttaatggtaggtacactaaagatgttagatgttggtatgcgagaaattaaggattgataaccagatcgttaagccaaatatgtattgcgacttgctttttcaagacagggatgaataggaacagaggcaaagacccatagcttgtgaatattgactgaatgtgagcagtttatgcacaggaaaagaaaggaaaatttgtcaaagagatagctttactgcgttgctatcctgtatttcagtgatcggcaaacctgcatgttcctgtcaacataaatcttagctccggcatcacatcgaaagaacacacattggtatcaccaactgttggaacaacctaggagagctggtacttcagttttgatcgattccatcactgaatgtagccatgtaaccatgttaccatcgtcgatacagttacaccatcatgaagcaaacctttttcaatccaagtagaaaacgtcaactttacaaagatctactttgtctagctgctagatccacgacggctgatgtgcaactttataatggcgttggcactctgaatggttagtcataatacaggaagatcaatgtgtagcaaattcatggaactatcagatagatgcaatagaagagtagccgagctcaattagccccaaccacgatgtgaagtcgttgagaagaagaaggcacaacaagatgctgggatgagctcgtcaaatatacaatcaagaatttgtgaaatgcaaatcatgatctcgttgtagttgttaggttgcaactgttgctaaaatcgagctcatcctcccaagtttacctgaacaccgttcttcaagataagggctttgacagtagttgtaaactaaattggctcaattaaaagcattcttactccgttgtcgtaagttactgaagtagtggggacgtcttgcttcttgtattttcagttcccagttgccaagtatgaaaagtttgtaatgtcatccgattttcattcaggcactgaaactaaattcttacgtcttatcacattgaattagaaagactgcactttacacattgtattccctctgtgtgcttcaaagacacaaaaggggcaaagactggcataagtacaacctgtcgaaccaacatttgccggccaaaaggataacattcccaaagacctttcctttcccttcgcctagcaaacctatttgcaaacctatttgacaacgaatcgttctttgtgcaggaaacttatctacaagggttcgcaaacctaatcaggtatgtgggcacaaacagaaccttgattagattacacttgcgatcaaaattgataaataagaattctagcatgagtttgcaatcgtctccgcaggaacgttcagttctttcacaacattgggaaactatggttacaacgcttggcttgtattcggcgaaaagattagagccaatgaaagcaggcccactaaaaactggcaagaattcatgttgcttgctttcggtaagataaaaggtaaggtttgaccctattgtgttaaggttctatttgtggaaacgctctgggttggtttttccgcaagattaagtacacccccactcccaattggtctagtacatggtaacgcaatcaaagatgcagcaagtccgcatgtaatcttcttatcccgaactgcacataccttcattgcgataacgagcttccatttctggttacattcgaagccgttactatgtcactatgagtcaaatatcattccgtgtgtaaactgactttttttttttgacagtgtatgcaactttctgttcctgattcagcagctcgagcgtgtcataatctcgtttgtgccacttttttcaatcaagacaccctatccacaacaagtccaattgatgatcccagttcacgctctatctggcctgtccaaagtatctactatctacccgtgtaagtcctgccaactctctttcccaaagcgtctgttacgctttctcatccagctcttgacggacgacatgattatatgtaacacgtattaccacgtttcaactccgagcacgtgatggcaactttcacatgccactgactgagaatttttatttctcctaatctcgcatcagcttatcttttcttataaatttagccttatccccctagctacaaaatcttttaaacttgctttttgacaaactaaccttaatgactcaaaccaccccaaatctgaaggaagaagttacttccaaggagcaactcaacaatccgctcaagactgttcaccatctgtcacagtatcctttgctcaaacaggcttgggagtatgtcgtgggatttgcttgggttggatgggtttggactaacgtcattcaactatatactatcctgagagtgaacgtggtcgatagggtcccctttgtggcttctctattgaatgcgctagatagttctttcgagtacctggttttacaaaccacagatagagtgcttccatttttgactgagctcacatatcaagacttaatcagcatcccagtcaaaaactatgaattgctttctaaaagggtatcaaccagatgggaagacctcaagcgttcagtccgacctgcactcaacccggtattgagaccagggggtgatgttctttcaaagtttgttacgagcccagaagattatgcggatgaagttgagagactctatttgattgcttccaaaacctacggaaatatttacgaaaagggccaaattgtcacttcgaaaatcaactccgcttaccaatctgagctcagctcaaaggacgatcagaagatcagtgacaaagcctttgctgctgcccgtacctccagaaaactatccaacgagttttacgacaatttcagacagacgaccaatactgtattggagcagactaagggcagcgtagatcaacttttagagaaggctgacaaggggatcaaggatactgcatccacgatcaacaagtcacttcgttctaacacagtttccgcaagtgcatagtagttatatctttctttttacacatcaatatccaatacccgattgtttaataacatgaattaggaattacccacttgctctttgtttctttactgtttgtatttatcctcagacttgctcctattatctggatcgaattggttaagcccacctaataatgcttttgaaacagcttctgttgttccaatgatgggtcgtagcacaaccacaggagttgctttcatcacctcatatgcaatattagatgtacggttgtcctctgataccttagagcttgctttggatatagcccgcttagcggagtcaatattcctaccaaacgactggtacgcaagttgcagcccttccttcatggtagtaggctggttggcatataagctgatagttttttgagactcgtcggtctcttgctcctcgtactcatcttcaatctcgttatcatccagaaacaattggctatccaacatagtgttccttaagtgcggtttaattttattcactaaatcatcttcatcgtcgtcgtcgtcatcgtactcttcatcaaaacgattggcttcccgtagcgaggtcttcccaatgatagactcgttcattgatgtctttttcaaatttctctcgtatgtttgacgatcggtaatgacatagaagttgccctcatcagaatctcttcgttgtttcctctctttaacctgaactggcattctagccagatttccttcaccacccaaaacttgctcagtattttcaagaatggtttgcgttccagccaccagcttgactcccagcttcagtagttcgtttcctgtggtctttgcaaatgaaaaggcccccttccgtactccagtaatcaatcttccatctcgacgatactcttccataggaatagcaattaaatccttgaatccggagctaattttaacaaccgagttgatagatgctaaccccgaaagaacacctttcagttgattgcgagtaatatcaggtgtccatattccgtttagtatgggatttaacttggttattttaaccccatacagtacaacatctcgaagaaccattgaagcctcatcaagtataaaaaagttcataaactcactagtctttccagatcttattcctgcataatcaaccgtcttgggtttataatctaactttagacgaactgggaaaacgtgaagtttagacacaaaaagatcatcgtcatcgaccacttgaggaacaaacctcaagtccttaaactctccaaacctagtcaaaaagtcaagggtgtcttggtctacatatagcctcaatggtaacacgttagtctctattctcatctctgtagtggccaacaacctagtgggtctaattgtagcaatatccagatggaccatctttgaattcaactctctagacccagcttccttcaaatatgttacaaatgttttccatgttgaggtgggaatattatcagtaattaagaaatcatccacctcaacagaaattctattgacaatctctgctgagttgggatttcgaatactcgatttatttttgattgttgtgggatcaaaagaacttaacagcttgaaagttatgctcagatttcgtaattccaaggcaactttatgaaaagtggacctcttgagtttcaggcgtctagtttgtggagacgatacctgcgactttgaactgacagaacttggagactgtgtcttgtctagagaatctgaactagctcttttgaagtttacatcattgttgaccctttcagctaacaaagttggctccattccaactgggagggataaatgtatggattgataaagggtttcttctatcactggttccgagacggaaccactcgtggcagagtcatcatcagtttgaagagagccttcattaccagagttggaggctgaggaatctctccgcaacttggtattcctaatcttctcaattctggaaagctctgcagctgctttggcttcaactcttcgcactgcgttcaaaatcgatactcgagtttccttccaatcataaccatcaaataacctgatgtatacagcttcaacactaagattaagtttgaaaggcacatgttctgtgtttcttgtattatccataaaagaagtatggtaaaagtgatcatgtttcatgttgagagagttttccaaagaaatgtcatcttcggagttctcttcaaagacttcaagatccccataagtgcgattgtctaacccttgattcacagattcatgttcgtagtagttatcaattatctccaacgaaccgtccgaatacacttttggtctgaatgcaccattcaacgctgtttctgaaaaggtacgtgtttttgtcgcagcaacattatttgagtcttttgttttctgtggaagaaatgcatcaaagtcaacgtctttaagagcatccaaaggagtttcaggttgtgtcctgtacttttgttcaaatggaactattatcggttgtcttaaatctttgattaagttaagcaaacactgtaaggagtcagcacatatatcgagacgtaaagtatcacacataacatttacattaacaggtgctatcagagatgcgctgctctcagtttcaaaagaaacggagaccgaggaaagcatccccatagagatatatcccatgtccataagcaacagcaagaaagaattacccaaaggatgtgagttttttgaatccagttttatctcattctttagattctttgtatcatctatcagtaagggcgtaatctcagttagagacgatgagattgaaagtctttgagaaccaaaagtcacagttccacatcctttcttgatgaacaaaacagctttacttttcaagcttactggattcaattcaataattatattgtttaggtggagactgatgacaaagttgtttgaatcacgagctctatctttgggaccaatatcttcttggcgcttcacaatttccctttccttcatattgcattggtgcaagaatgagaaccattcaccgtaataatgagcaagacaatcagccagttggatcgtcagagacgatgatttcaacctagcaattagcattggttttttgtttcctggagcatcaactttctccagtatcaattgggacgataatttgtggattctagcaacgtctaagctcccaacaaaaaagtcttgaaagcctttaacatgaaagttacaattaatagactttattctaccagagacatcaccaaatccattcaaagcttctttcaaaagaaatgaaacagagtttattctaagaaatgagactagtgacgaatgggaaaacattgcccctgtttgggaaccaagagccctgggattcctgacaggatttctggagttgaatgaggtccggaaaactgttttctccttagctatatccatcttcggatgattcacaactttcagctgctcaaaaaaaagctccaacgaatcaatcaaagaagtaaaatctgacattgtcatttctagctcaatcagttcaatttccgaagcattaggcgacaaatacgaacattggattccagatttatcgaaagttttcaccttcttcggcttcttgaatagataagttttcagaccattgattaatagtatcgatttataagagtcatctgaactgagagaagaggaactggaagggagatctttggataaatgggtaaaaccagtacacttctgttcgcttttttcacagtttagacaaaacggcttgcgttcgtcacacttgacttgtcttttgcggcaagttaggcatccagagtttgttgacttatgaggctgcattttaaatctatcttgagagggagggtctccttgtacttgattttccttgaatttacgctctactactattctctctacttctataactccggtattagagttaaatgatagaggaaaggaagttaatttcactttgtcagaggatgttaactgtaaaatgaattcaaaagatgccgtttgtaaataaatttcattttcctgatcattatttgagtttgactgtgggttggaaagcgatgccagttttgctttctggtactgataactttgcaacgaatgtaacgtacttggtatcttcgaacaaaatgataacaaatggttcaatacctcttcattgagattgaacaccccaggctttggacatagtatagtaatattgtaaaggtcattatcatcgtcaaggatcatttcaaatcgtacatcgtaattggaacctggctggaaggaaaacacttcactagtttcagacttattcattttcagagtctttagtgttccggagagattaccttcagagaccattgctaattcaagagattcgatactaagacagagtgagttatctattgcaaaagcaccattctttcccagtgctgaatttaaagaaatcacaatttcgttaattttcaactctttgaagccagtcgagctgctagtactgatttgatcagaaaactctggttcctcttgtagcccatctttagagctgaatgtatatgtagttgtgttacttgtcttggactttgcagagtgaactcttaaaattttaagtctcttggatagtgtttccagtaatgctgttagagattcgggaatcggactcactgcaacgtgaatttggtcaataatgatggatacattttcaaaactttgtaacccttcgaacgtgagcgtaccttcattaacgtgtcctagtgtaaccgaaggttttgtttcagatggatgacgggttgaatgcttcggtttcgtaagtagtttggaggttgcactcatatagacagaactttgtgagttgagcatactgttttcaagttcctctctgcttcctataaacgatgacgacatgaaatctgttggatgtgaatcaaaggaactactctcatcaaccgaatcatcgtcttcactatcatcttgtgattcaccttggggttgatctccaggataaactgaaggctttaaaacacttaactcagctcctttaaattcaatttttctaaccccatccgtagtatcaaaagatgcttcttcaatgcagatctgaaacgtactttcgtctgttataatagtcagattgatatcttttaactgaacctggagcctagaaagggccatttctacagccttggccatcatgttacccattttgcttggctgtttggggttctctttatcagcaagtgggcttgaatcatcatcattagccacattttttgaagaatcatgttcatcatccaattctttatctgtcttgggaagttcattgttgtcttggtcaacgaaaaagactgaagtggccaaatcagcagtgctttgataaagggaaaatgatagctttccagggtcaaaatctactccatttgtcatagaaggagccagagttaggttgacacccgttgcttcaatgttgacaccattcgataaagtgagagtcaagtccatatcatcgaccactccattacgaaggtaaaaatttgggatatcgaccttatcaggatctaactgaagttccttaagatgcaccttggagttggtcccaagagagacatctaaattgggaaggtcaatctccgcaaacaaagacagctgttgcaacacgtagcgcaacagccgtttttgtatattttgtggcatccaagctgccatgctgaggattgagggcggttgtgtttgtattgaatacttgtatcgcttgccctgatcgttgatagtgcaggctcgaagtggagcgggggatcgagggctggcaggagataagcctaggcggagtattccgcgctacaactgataggtctagtagggtgacaggggaattttgatcttgcgactagttacaggtatttattggtctatttcaccagttggatatgcttaggtggtttttgtcggtatttttcttctcttaaacgcccctttcctccgaatgcacgaagaagctgctggtactgagagggctcagtatccttggctaattctctaagatgcaactccatcttatcagcttctgaccgaatttcggaatttgaatcggaaagatcgtcttccttgtaaatttcggaatctggttcagactctgtttcattgtcatacaagcttctccagcaaatgtcttccttctcttttaagaatttcaaatacaaaaatttggccaaactggggcgcacgctagtaacgtaggtattcaaagcccagtcatcatctaaagatgtcggcattggatgagccatctttgaatgttttccattaaataagtggtcgacgctgatacggtacccaaaagcattttcactggttttctggttgatttcacgaaccatcttgcgatgctcaaagctcttgtaatttttttttaacagatcttcattaagcggtgattcagaggagtcattgtctccactaagaagtttttcgatgtcaatttgcttgtctaaagtggtattgctgatttccttggatacattttgaattctctgcaccatctgttcgtctattggagatgcaagaacaaacagataaacttttttcttgaacttcccggtcttgaaaacgattctgtagttatcactgagtgtaacattaggatcactcttcttattaagaattctgcataagatcctgttgatgatctccatgctaaacttatattctgtgttggcaatcttggtactgagaattcttttcagatctggggtgtgggttccgaggggtcccattatcttatcctggtcttggacgtcgtttttggtatttagtgtggattctaatgtgtcactgtgtagaatatagtcaatctcttccaaaggaaggtactgaaaaccgaaaactttttcaatattgtggtatgctacaaatatcccatccatgtttcctatgcgggcttgaagagaatatttcaacattgtagaacgcatcagctcgtaaaattcacgttcaaatgattcgtactgatcatgagctcgtacgatctgataccccgtgtattcatcacgctctacatgagaaatgtcatgacgaacggcgcagacggctctcgtcttgatatcgaacgacttgtttccgttcggaagtctttgatcttggcaatcaagttgtgatcgcaaaataaagttggaaattttgctgaaattgtaaacgctttcgccgtgaaatgtttccttgaccttttcaaaaggtactttcgaatcagctctgaactggttgtaaatctccggaggacatactaatagtcgctccatgaaatgtcccattaaactcaggactatttcgttatcagcagaatgatcagctccaattgcatatcgccttttcgaaaatggacaatctggaccttctgtgtcttttctcatggccagtacaacaccaggaatggtagcacctttcgtgaatcggaatcgcttttctttgaagttcttcgacagtacatctccattgatccccttcatattagataaaagaaaatgcatatgcgagagaattcccgtgaccgcacttgttgaggtgtaaaaattggtcttgtgttcttgacataacttcaacaggttcttatctttctcactcggtacaaaagttccttccagaagtttttggttcaattctttcaaaggtatcaagttttgaaggtaaggattaaaattataaacgctggatcttggatcttgcaggaagtggtaattgagaggctggaataacactctgtccagccgatgtgctaatttaggaaccttccgcacattactgaggtctccacaacgaatggatgtaagcgggatcccggaatctttaagtataaaagagggcctgaaagtggttggatggaaacttacaggtttcaaacgtgggcctcctctttttggagtggtccaagtggagtagaccctcatgtacgattagtcgaagtagttgaattcagtacgcttgcatggtacatgaattttttttcccctactcgcgtcctaagaagagatcacgagaattgtcacgtgtagaaagcttttttttgctttagaaataaactttttctctctcttaccttctaaaactgacacctcacgtgacatatttctcttcctcttctcctccgttcggcaatgcttgaacaaaacaaccacgtgacgattatccgcccgaacttctacataagtccgttaaattcgaagtacagccaatcacctattgacaatctgaaatcggaggtcaggtcgtgctaagaagggaaattttatcagattgatcagtgccatcgtataaaatatatattaagtaaggagggcctcatattacaagttttttccgccctaaagaaaagttctgtccgagtacgagtgataggcagagaagacagaaacacaaccgaactttgccatgacgacaatacagcctttggccccaaggatacagaacgattcaaagccgattactaaaatagtaacctccaaggagtgggtattgcctcctcggccaaagcctggtaggaagcccagtgtagacactcccacgaccaagagaaaggctcagaatagagctgcccagcgggcgttcagagagagaagggccaacagggtcaacgaactggaggagaaattaatggaactggaaaaagaaaagagcatcaaggagggtatattgaataatgaaattaagaaactgcaaagggacaagaatatgctattgaggagacttgaaaagttggagaaacagataggcatagaaggccagaccgacaggctactggcaggtaatgacggcgggtttgatacttctccacaacaacaaatatcacctgcgccttcatctactgggaatgctccttcctcaaatgctccctctccgaactcgggttaccgtccagagtctacaccatatacagttgacaattccatgtcggatggcggatcagacagtccagattgcggcctttgcatgaaagatgattgtgtgtgtgcctctattggcgtgaaggaaggtacgacgcaggcgtcgtccatggaactcttcaagcccatgaaggcagttcccttgaaaagacgacgtgtcggtgatgatgacgggaatgaagttgatttcacaaatgccttcaagaagacttcgttgtttgcctcacgggaaaacaactcatttgtagcactttctagaagtcaaactcaagcacagccgcaacagattcagaatagttcctcctcaaatggtaacaacgacatgtttgcgacctccagtgcggttgataccaatatagaagaatgtggattctgttctgatgataccccatgtgtctgcagagaagttgcgagagaacaggctcaacttgaaagggccaacaaagaactattagccgagaccagtcttccgcctatcatcaacggaagggccaattctctcacttccaacgccagacaatcgttgcccgttttgcatccaggtccttctgtctctcttaagacagatgccccagcaatcagcagacacgccagtaacaaggatctcaagactctcagcacggtggttactgcgctagccgaaggagaatctcaaaatagaggctcatgtacaggtaacccaggaacttgctcacaatgccaacgggatccgatgtccactttattctgcacaaccattgccagtaaggacgaagagaaggccccactacccaaaattcaggataacgtcttcataccatgcagcgacgcctacaagacgctgtcaagacatgccaacttcaacgaagtgaactttaacacattgatcgggaaattgaccaccaagggaatgctggttgaggctggaagcgttgccagtgtcctgagggaactggaccgaaagtttagtaatgcataagaggatatatataggaatgcagtaataatattagtacccattaagtgggctaagccattggaaggccgtctgactgatggtggtgttcttctcatttagatagtgcatttgcaactaccgtctgagattgagtttgatgtgaagctccagcgccaaaacagtataagaaccttatctccgcattattgttcttgcgtaaaagtttgtgtgaagaaacaggggtagttgcgcagattagttgtaatatgcgcataggatgggtcattgacttctttcctcgaaagagccacaccgttagctaaaaaaggacgcgcatctaccccaaaatagaatgtggggaaataggacgcgcaacttcctctcaatcactggacgtcagaaaaacaaatgcgcaatcgagtcaccctccgtgataccctccgtgataccccctctccgtctattctgacagcgtctccccatgacgtttcaatctacttagaaaagatttcgttttttttttccttcaattacacgatctcatcttctgcaagggtctggaggacatcaccaatctgcgactccataacttagtcctgagtttatatttacgcttcatctgatgagtaggaagaaaaagtttcacgaaattcccccgccaacttgcccttcggaataagcagccactctccttctgcccatagtaagcttgcgcgaggccccaacttggccagaaactttaaatatgccaaacaatctcccccaatctaagttctccctcttctaaaaaatggccctatctcctacctatcagggctacatatctaccactggcgacgcgttgatcgtgatccaggcagctctaaataaccatttgaatcttcttccccgaagaccaagagaaagagagcgagatgggctaatacgatcaggtaacgtatttgtttttgtcgagcaacggtctcatatcaaacgatggaccgatggtatcccctggtctccatctagagtccttggaaagttcttgttgtatcgggaactggacaaggatacccccaaaaactcgcaaagtgacgaagatactgaggaggggagaaagaggcgaaagacttctgtggatgtaaccgatccaaataccaggcagttggtgggatcattggtgacttcctatgacttcaaagaggatggacttattaaaaaaacactctccttgactttccagaccggtgctaatgaagaaagggaaacagtgcacttgattagttattatactccggaagatgtaacgaaccatcgtttgaacaggccgtctgacaatccatatctggccaatatcactgtttcagagtcattattgactgccttgagagagagtacccttggaggaagagcaacgtctgatgacgagctttctttagtcagaagtaactcgttagagtaccaagaggtaccaatgaacatatctatgtctttacctttatcaactccactttccttgaacacaggagtaaactcaactacccagctgcaacagcaacaactacaacaacaacaacagcaacagcaacagcagcagcaacaacagcagcaacaacagcaaccggtagcatcccttccaaaatttgatggatcctttctattacaacagggtgtaattccagttcctcatttcatggaccaaaaaatgggaagtagcaattcgtggattaacaattggtttcgtccaaattcgtcagaatcaaatgggctatcggttatcggacctcacaagggatatgacgaacaaagtccagcaacgagttatactttgaatgaacgttgacacagtgtagaataatgaatgaatgaatgagtaaatgacaaaatgaatgaataaatgacaatctttaactacacgacggtaccactccgagtcctgacatcgactccgtgcgaactcgaactgctcgtcattgaacgagttctagctaatctcatttccatttctatggggaattcaacttcgtctagaccgtttagcgtgtgcgctgaaaagtactcgtattcgattcttttgtagtgaataaactggcatgtaatgacgatgtttaagctcatttgaaacacggcagcaataatgaaaaatgcagagacttggtttgtaccaaatacgaggtatgaaatcttggtcatatctccgcccagccaactgaggagcaaaatggacttgaaatttcgaacagatttcactctgtagaacataaggatctggggcaaaggcaataagctctcgatcaataaagataaggcccctatgatgttcccatactgttcattcttgtataataacaattctaaggaaactattgtagtccaaaaacaacctaagaacttccaataggtctcttgttcctcccactgccaaaagtttaaagggcgggcgtagctgacgtcaaaaagaaggaacaagttggcaaagttgccataaatgatgagaacaaaaaagaggcgccaagtactgacccatgccttccagatcagatccaggcgctctggtatcccctcagagtcgttgatcaggctctctgataattgggccactaattcctgcattttatgcacaaatatcacgttgtaattgggcatttgtacaagattgtcacatgaataggtgtttgatctatacttcaaggccgttctcaagagcaatatctggatgataagcatgacgatgcactgcctcaacagggtgaattcatacttctcgttgaagtagtacatcactcgcaaacttgcgctgagcaacatggtggcacaaatatctagcgagaagcctgtacttgactggctttgggagatgccgtaaattgtggtgccatagctgagaaatggggcaaatgaaatgaagaaattgacggcgtcttgcaggtctgggaggtactcttccggaagtgtgaagtaggccatgataccagcattcagagaccaattagagcagtgttgacggagtatacagagcgcacggagttggtgcgggaagagaaggaaatcgatgcttagctatttcaggtaatgagatcgagatgcgagcggtacgaaagcgtcgtgatgattatgtaagtgtatggtctgcgtcaacggttacggcacattgaagaaaagagcattttagatccataaaaagattgggttagttacttagaaagatgaattaaatgctcctacgcactttttgagcgatgattaaacacatgtctactatctatgaaaaatgaccattatgctaaagtaggctccttgagatattatgaaaagaggatgggatatcaatcctgattgtttcccttactctcaagatcaagcttctcggaatttgctgcaagtggaggtgaaatgcttcggcctcccatagtgtacagagcggtaccgaccaccaccattgaaattccaaaatatcccattgcgttgaaggagttgtcaaagaagtaacaactaatcagcaaagacaccaactttcggatcattagaatgatggatagggttacagcattgtaaagagatgccgttttattaacacctgcaacacagaggaattgcgtcaggcagttgatgagcaaagatccatggttggacgtgaagtgttcaaactctcttttcagattcaaggaaacaaaaagaaataatggcaatgcaaatgcatgttggtagaagagattcaccatccatgttgactttccgtacttcttataagtagtctccgtataaagggccataacacaggttaaaacgttggccagggtcatcacaaatataccaaacatgtaatgtaggtctatagcagaccaatcaatgaaatttcccgtgtattcaacaccttttgcttcattttgggcaatttggttgtcaatcattgttataatgacaccaattgatagcaccacagaaccccaaatctgctttgcgttgtaggttttgcccaaaaagcaatatccaatcaacatggtcacggtgacactactacttctgaacacgacgtggacgggtatgccaatgttgaacacgaaaacgtagttgttcaagacatttgtcacgaaaaacaaaaaaatgttcacgtagtagcgtttcataggcaccttagattctggcagccaagagctgtaccaatcctttttggggcctgccaacagcacatcatctgtctttttgcctccttctcctgggagcatcacgaaaagatacgagactagagctacgtacaagaactggcaaaatgttaccattgtaccaacactgtaggtcgtcttagtcaccaaggtctccaaggagaagacgttgccgcaacatccggtgaacaccatcaaaaacggggatatatcgatcatcttgacgtgttttgggttcgaacagggaagggaagagaaaaataaatatagttcgacggtatttcgagcttcaactttaccgacaatagataacgctatctggtattaattcggaacacggtgattgctggaaaaatttgaaaaaattatcaaaggggtaggggagtttaaagggtagtgtttggaaggctggcaagagaggtatgtaaggattttgttttatttttgaatactgtcaccggtgtcttaaaacttgaattctgatcatcgtcatctagaacttggatcaatgtagttacgtaatatacccgttttattgttgtcgtgtgactagtaggacgataagcaaggggggcattttgctttattaacgtgaaaaagggccaattctgcttacgtaataaaactgccctttgtttaacgggggcactgcgcgcgggctgtcaatttacttgagatgttctctcttgtccactgggccagctcaatccattgaccagtgacctgaaaacaagatttactgctaccaaagatggatttttctcttacccagatccttccttcattcagtgaagagctatcacaactaaacaacaacttgggcactgtttttgagaacttttcttcagacatcaatgacgagatcgttgccagcacagaaagacagcaggatatcatcgcaatgacccgcaaattgtcaaaaacctgtgataaacacaaaaatcataagcttgtcgtgtccaatgacaagtccttgatgcaagatttggatgacataatacttagtatcaccatcacaaagagcagtttagatgagacgataaggaggctcaataaagctcagtctcagctgggaaacgaccattaccttcgaaactcggaaaaattgtaccggtattgcaaggaaaacaaattgatcacaacaaaagaaaaattacagcaatatgaacaattagaacggcagttgggagtctccacaaaactcagatttcccttgaaacaaaagtcggaaagtaccttatcgttgacggataatacggtgttggcagatttcgaaccctcacagactgagagctctctaaaaaagttgtttattgatgaagcttcctaatatttattcccttatctcctccagcacaccgtctataatcggtttgaaactctccaaatacagcctactattttcgtaactatccaataatgatgagtctttctgggtctcaatcatctccacaaagagtggatcaatagggatggctcccaagtatttcaaactcaactggctcgccaggtttttgcccccctcactactaaatatattagtacattcggcacaatgaggacagataaacccactcatgttctctaccagccccagaattcgaagattgactttgttgcagaaatttatctccttcttgacatcacttatggaaatctgctgtggggtggtcactatgatacatccttcgggattggcaaactgtaattcttcagcgatggcaatatgttcatcactagtgccaggtggagtgtcaattagtagatagtctaaatccggccatgttacatctttgaggaattgccttatcattgcagttttcttgggtcctctccagactacactggcatccttgcttccgagtaaaaaccccagtgaaacgatacttagatctttgttgtaccgtgctggtacccaaccgttggtagactggtgtatttttgcatcttctaggccaaacattcttgggatcgaaggaccagtgagatcgatgtctaatacgccgactttgtaaccttttaaaaccagtgaaagagcagtttgtgtggtaatagacgactttcccacgcctccttttcctgataggatcaagatcacatgtttgacattcttgagggagtcgggtgctgacatagtgatgactaagaagaatgctaaaatgaatattgagactacaccacctactgggaggtaccgctcaggggagggggtgacacgttacgtccccccttcgcttagttccttcaaaggaagatccaaggattacctttcgcgagacgaccctaagtatacgagctcatctgctttccctctctaatccacactttgccctcaggtcccattatagaccgccaggacacgtcttcgatcatgtcaaggtatgtatccaatgaacacatagattggtttttctgattgatttgatttgctttactaactcttgtttagtcgctattcgtcaaacttacatcaaagagataatcgatcgtctctgttcgaaacacgatctgcatcgccatatgatgatgctccatccaagaaggattacaaggctagtttgctctcccagttagaatcgcaaaatgaggacgagctaagttcaatgtcagaaaaagtcttgatgctcaagaacctgggttccagaatgggtgacgaaatcaagaactcccagctcaacattgacgacctacatagcacaatgacaaacacacaaacgcggctgaaaaataccttcaaaaggatgatggtaatggctaagaaaacaggtatttcatggaagttatggctgctgttcttcttcctcgtctggctttggttcttttttgtgtggcttagatgacggcaacagatcaacccaacagttcactatttccattagatctctttacagagccatttcaactattttccacactcataattatttaacatttgcgcctgtatataatggtactaatcgatctttcaatgtacacacggacctaaactggcttctttctattgcttgctttagcttcagctggagcaactacattgtaacatagacacttggtcactggtagataaccatttggcctctgtatctttcaggtcatgcccccatctgagaggatcaaatgggttaaatgccatcttttccagcttcttcaagtaacggttgtcgctgggatcgtctgccaatttttggataacttcgtcaaaaatccagttgcgtgggaggaacaggggattcactttagatgatatgtttcttctctccaagtcaacgtcctcatagccgtgtttattcaatcgctcgacgtaaatctgcaaccatttctccaattcttcaactatattgtcctcgttcgatttagtaatcgattctgctaggcttcttatgccttcgttatctatctcctttaaatatgcctcctgcaactgaacaaagaagttgttgtagtccagcttagtcttctgcaacatgtccctcagagggtcaagcaataactgttcgtcggcctcctcataactactcagtccaagccttttcattagtaattgtccgtattctttagtaacaatatgctcaaatagaatggcagccaattcaatcactgctgttgctcgagtcactatttgattttcccattcttttttgatcccctcttcggtgaagtgtggatcactcagaatcgtagggccagccccaatcaattcagccatatcttcacctaacctagtcaaactccaaaagacggcacctggagtgttgcggtgactgtatcgtaaagtgtgatcttcactattagacgtaaaatcaggatcaaacttgtccatgatcgcaaaaggcccaaagtcgatggaaagacccaaaacagaggtattgtctgtgtttagtaccccgtttaagaagccgtacgcctgccattgggatactgttttggcatttcttacgacaatctctaggtacatcaaatcatagatagaaaattcaccaaacttttcctcgtcccattcttctttgacaattttcgcaaactccggttcttgattattaaagttgttgagaactgcttccttgccaccaaaaacatcactaatgacaaaatctgacaaagttctcattccctttcgatctcctctccatctgtacaaatcgaaagtaccaatacgaatccaggatggagcaaaccgggtggtaattgcgcaattctcagcagcatatctctgggcccatgtatgaggaagtgttacaatcgctaaagctctggtggtgggtatcccgagcgcatgcagagattcagagatcacgtactctctaacactagatcgaaccactgctttcccgtctgcaaaacggctaaaaggggttttcccggatcctttcaattgaatttcatattttgaagtgttgtcgtgattgtcaatttcaaacaaattaacaacgcggccatctcctaattgacctgcaaaactgccaaattgccaccccgcgtagcattggctgtatggagttggatattccctttcctgcgccgttggattatcattgtaggcctgaccagacactattcggaagaactcgttgtcatgctcttcagagtcaggtaacccaagatcattcaaagcaggtcggctaactgtgagtaacttatactgatctcttttctctggtagaacccaggaaaaggcaccacttttcaattgtcttggcttatgagtgagatcccatttagtttcgtcccaagcaatcgaaggctcaggaactcgctcatctggaggaaaggccttggtaaaactctgtgttttgcttttttcggcaagtctgatcattgaactgtaatttcttctactggcgactaggaaggtgaatgtgaatcgtttgaagtgtaacgatcccgacctaagcatatctcagtgggaagcaagggtgtttatatatatatagaggtatatatatattgtggggaagaaaaaggagaaggaagctgtagcagtgctaacctaagcttggcccgtccaccaccttccctttgctcttacctgtaacgcgaagaaggtgagatcagttgattatataatcaacttctgtcataacttctgtcacagcctgaacgttatggaggatctgttgagagaagaatgtattccttcaaagagtccccccctcaccagtatttattaagcccagattaccttttgacgcccttttttggggccttctagaccactatttttagtcccgctgcaccaccccctgtgctaggcaccctacattccaacttgggtcgctaccccttttcttggtatcagacctcaggacttttttcccaatgcatcagcttgcatgcacctaaggtcgtgtttacgccagatcacctcagtaaactaaatcaatcaacacaagcaaactcccttctctgtcaaagtggtaatgcaggttttggatgctagccatcgtctggatattgaggtagaatctccgtttcaacctgactttgcctctccctcatttgccctgaacaactcagagggatcacacgccaccaaaccagctagtagtccagatctggaactagagacgggtcaaatatgtaagaagtgcgggctggtcatcacagagggccatgcctatgaactaggtgaagacaggtggcatgtcgaatgtttcagttgttcaaagtgcagtaagtctcttggatgtgactccaattttttggtgttaggcacgggtgctttggtgtgttcagactgctcgtatgcgtgcacgatatgctctaaaaagatttatgacttggccatattgacggggaatcaggcttattgcagctcttgtttccaatgcagagcctgcaagaatcgaatagaggatctacggtacgccaggacttcaaaaggtctattttgcatatcgtgtcatatgaagttgttggagaagaaaaaacgtcatgagcaacagaggaagaaactgatgatccataccaacaacagcagctcctcatcgacaaagccctctgctgataattccaacccgaactcagcaacaacagctgacacctccgtgaagaataagcagttaccggatttacccctgcctgcatcctctaactacgccctgaaccctcctgtcaaagtccatcccagagattcagcctcaaacgttaacacaatcttagactcattggatgtagagacaccaggggacccacctcagccggtccctccaccattccccagattgaggcccaatagccctcctatctctcaatttgtggattatactttcaactctcctgtggagctaaattctgatgaagagcgtgtactcttcaagacatctccttctacgaagcaatttcttcaatctcccgacgtgctagaacatcgtaaggcagttttgattgacgacgttgacagtgatgttcacgagtcttctccggaggtagagccagaacctaaatctgaaccgacttcagacaccgatgttgttcctaaaggcttgaacatcaacacaacctccaagatttttaagaatgacaccgagttgaacttggaaaagtccaccaatcaaaaaatctttgcattatcctctgaagagaacgtttcacatgagaaggaaaaactcacgactaagatttcacggtcattatccatgagatcaatctctagttccaagaataagctaggatttaattttcacaggagaacttctagtaaagacatggatacagcagctatttcacaactcaacaccccaaaagctcgtcaaagacaatttagtgcctcgtcacaaagagtcccatcatcggtttcatcgcacaatcgcacggcctccgatcttatgtttcttaagaactctagtaagactgaactagatcacttggaggctcaaatgaagagaattcaaaatgaagttaatcaactaaccgttcagaaagaaacgttacaaagtgagatatttgacttggaaaagaataaacaatcccttcttgtaaatattgatgaaatcaaatcaagattcgaaggactccaaaccagtttaaatgagtccaatactgctgagcagcccacagacacgcctttagaaacattagtggaggctccaattactacaattatacccagacaaaattcgactattgatgaatcatccttgtcagacaatttcaatagcggttccctttccacatctgcacccacatctaattcaaagaataaaccaaagggtaggttctggagaatgggaaagagtaacaagaaagatattcccaactctacttcgaattactcactaagcaatgttttcaagagcaatccagttttgatacagtccaaagatccaatgaatgagaaactgaatacaaatccagatctcacagagagagataattttttcacttcaatgataaaatcaaccagcaccaacatactgtacaatatggccaattcaaagacagaaaatcatccaaatcacctctttaacatgtcactacaagaacgtgccacatacgaaggactggaagtgcctatcattgtaactaaatgcattgagaaagttgaacaatccggtttatcctctgagggaatataccgattgagtgggggttcatcgtctctggaaagagtggaaagctgttttagttctctttcgttggaagatattacaaacgagaaatttgacaggctacacgagagtttgaatggagacatcaacaccgttgcaggcgtattaaaaagatatctctccaagctccccgagcctttggttacgtttgatctctatgaggagtttgttaatatcgccagattggatgataaaattaccagcctgaggacgcttgtcaataaacttttaccgacacatcgcaagaccttatacatgctgtgcaaacatttgaacaatgttgttcaacatgggaatgtgaacctaatgaatgtgaacaatattgcagtggtttttgcagcaacgttggcaagaagtcgagtagttaacttggaaaaggaaatgtctgatatcagtgccagacgaaacgttacggagactctaatcagccattatgatcagatctttcaacaacattagagatatttgggtacactgttgttttatagtatatacatttttaacatccacaatgtttgattaatggacatctgttatattatcatttgaatacatctcaagcctcctatgtcctgttctcagtaaatgttctatagtagcaaaatctctctttgggattgccctgtacttgtcgaattgctcgtggacaaatcgtacccaatggtcctgattttcctagagtgtcagtgaaattcagaatgcaggagaaaggtcgatggaaatacttactgttggtttcttgtaggcctgcctaatacaggatctgtacaacttgagtacctctttctggagtcctgagtatttcatatgttagatagtcagcatggattagtaaaacaaatgatttggatgtagcgaattggatagtagatggtgcaggaactcttggtaggtggagaggattaagtaagggtgtcctacatggccaattctagatggtacggctacactatgagatcgttatcctattaaatacaatatataatacaaagcctcgtccaatcctactggttgatgcagtaatccaacattttatagatcatctccctgtccttggagtcaaacacccacagaccgtagactgttcctaagagatctttgacaataatgagctcgttctgctgttccactatcaactttttatcggactgatttgcaataaacttgtttggaataatcccgatgctgaaattctcaggtttgtttctgttgaaaatgataattccgaactggaaaagattatttgaaataatagttttcgtgtccaatgaatgctgttgaatgtttgattgtttttcatattccttacgggaatagagacagatggttccctggtaatccagtttggaccaatcattatctatgaactcgtagaccacacaatgagaggataaatacaatagttggttcacctgtggatcgtatctcgagaggatgttgaaagtcattgcctttctatagatatcaaacgtttgttgctgctctgttgaggtaatgggctcttctttcggcatggtagatgtgtgtgacaagttcttgaagagatgagtgtttgtcttcgtctgcccgcgataggttgtccttgtagatttttccgtaccgttcaagagttttttttttccttctccctcccactgctcggcctatcggctttttatgcgccctcccaccttctcgcgatggtaaaagctcttaaacagggtggttgtatcatacgacgaatcgttcattatcaatgtccagcgttgtctactatgtcaagggattctttgcattgctagcacttactagctgcgccgtttatggtgttattgcatctactgttttgtccttgctaggcaaaagaaacttatcccaatggtccactgcacgggtgttctatgccacgtttagcactcttttcaacatcaagattgaagttgacagacctgaaattcttgaaaaattgcctgccattttagtgtcaaatcaccagagtgaactggacgtcttcatactgggaaaggtctttcctaagagatgttctatgaccagtaagaaacaattgaaatgggttccatttttaggacagttcatgaccttgagtggagtgttcttccttgatagagcaaacaaaagcactgccatcagcaccttagataccgctcttcaaaaattgaagaatgaaaagggcgcgttatacattttcccagaaggcactagatcttatgccttggaaccaaaacttcttcccttcaagaaaggagctttccatatggctgttcaaggaggcattccagtgatacctttagttgcatcgaatacttccagtctttattctcctaaaactaaaaccttcaagtctggagtgatcaaaatcaaggtgctagatccaattgaaacgaaagatctaactaaggacgacgtagccgatttggctcaagaggtatatgataaaatgaagactgcggttgacttgttgggttattctcccaccaacgatcagctagaagctgagactgacgtcgatacagaaactgaatcggagacaggaaatacatacactgatacggaagaggatatcaccgtccctggcgagaccactcagctgttagataaataggttaaatgtactagtgtatatggttatccaaatgtggaactttccttcacaaggatggtgtacctttgcccttgcaacatctcatctgtggaagccttcgcggttcacaacctttccccaccaaagtacatgatatttgatagggtggtcaccgtgaatgctgaactgtttaaagagaacgagccattaagctacgctaaggagaaatgttatatacgcttcagcaatttttcactacaagatcgctggaaggatgttgagaagaagttggaccagctaatatccacaagccatcccctggtaacccaactggaaagtatcaaccttaagactgtacaaaatgatattctaaaattcattgtgatgaaccctgaatgcgacaatattgatgatttactaaagagtgatgttgacaacgagagtctgtacgatcaatgtgtaaaactattgtacgaaggaatgaaatttcacctggatattgaatttactacagcggaaattcctttaactgcacaaattgaactgaaggatatcaatttccttagtagcccagaactaaaggacaacattaaatttttatacaagattttactttttggatcgtacgactccaagggttataatctacaggttcactgcatcatatcagaaaacggtaaacccattaagatcttattcaaggtagtagaatcgttgttggttaataagccagtcttttcaatcgaattaccttttaaagaggacgtagaggtggatctgtttgagtttctttctatttaccatgagaacatgctggaatatcaaaagaatacccaacaattggtttatttgaatcagctacttgatctcaaactccaacaaaatgaactaagagtgaaaggaatgaaagagttggttgatgaaataaaatatgaacaggaatcagcatttgttcagctcctgaatgaaaagaaggaaaagcttagacagctaggggtgggggatattgacgactttgattcgcattcttggtcaaataggcctagaaagaaaatgaatttgggtcttgtgaagcaagaaaatgacactagtaaccaagaaatcaaccaacaaacggatcagcaaaaactcctggtctctcaaggtaaagtagacccgcaaacctatgcagacgtcaacgtcaaagaggagcccttgactcaacatgcatccgaacaaacacgagccctatcattgaatgacaatattccccacacggatacctcttcaagcaccaatgcttcgcacacagacctctcagagtccgacgatcaaactgatgttagtgacggctagttttgcggttccctgcaagcacagccgcacatacagtgtgcggcacaaactaaagtgaaacgaaatttgaaattggacattgtacagaaaggatccccctgatcccccatatttgttagtctgagcaactgatctaatactcaaatgtgcgaatcaataaagaagaataaattttaaggttggtgtcaccccccacaactcgtctttagtgccgatctttttcatttatttccaaaactgtgtggaagtcacgctggcaaaagtgtacaacttgacagagcaaaaagaaaagcagccagatcgtccagaactttcaaacgccagagattccttccagaacctccgcaatgttaaccatctacccgacctctctagcttatctcacattccaccaaataatctcgaacgttaatactcctactaaaaataatcccctataagaaaattttaacctactagataaacgagctcttcgcctttaactcttctgccgagtagcctcccaaaagtttacctacttgcctctatcgctttccaaccgttcagttcatagagaaatatttcttaggaattgcacctatttatcctattccttgagaaccatttctgcctgtttcattcgtgttttttcagttcttatctgcattagtttgtcatgtcattctttcctccccagttccaaaaaaccaataactcccaggattcaacgggccgtgagtcatttgatttgaatggccagtttgactatcctgaacctcataatttgaatgtcgaatcagggatcttgggtagatcagtacctcagtttggctctgtagccgaacaagacatttaccacggaagccctttggatttggctaatagcatggaagctctcagcttggataaatctggcccacagcacttcaatgggggcttttcccggcccatcaatggttccgccgactcattagccgctccatcccgtaccgtttatctgggtaacgttccgactgatctgacaccaaaggaactgttggaccatgtcagatcgggtgtgattgaaagctgtaagattttacctgagaagaactgcgcatttatttcatttttagatgaaaactccgccatgcttttccactcggacgctatcctgaaaagactgactatcaaacagaatgatattcgcattggatggggaaatcagacagacttgcatcccatcgttcatgaagctgtctccaaacacaatgctacaagaaatgtttatctgggacaccttccgcctgacatcaccattgacgagatatacactgacttgtacatttatggcgaaattgaggtcattaaagttatcagtgaaaaaagaattgcatttgttcattttactagcattttgagtgctgttagagcagtccaaaatctgccacttaaaaaccccaagtacgccactagaaaagtgttttatggtaaggatagatgtgcatttatcaccaagactcagcaacacaatgccgcccaatatttgggactggaccccaaccttgaaaattattttttgaacaatgttgatccagactttatatcaactgcattagtgcaacaatccaacgcagcagctgctattgccactcaggctggcggagttaacaacctgggcaatagaactgtctatctgggaagcttgcaaccagatgttaccgttgaggaagtttgcaatgttgtacgtggaggtatattagagaaggttaggctaatctatgagaagtatgcctgtttcatcacatttatcgatcccattgctgctgcccagttttttgcaatgagcagtctccatgggttgattatccgtaacaggaaagtcaaaattggttgggggaaacacagtggtcctctacctaatgcccttacgttggctgtaagtaacggtgcgtctcgtaacttgtacatcgggggcctagatcttgatgataatggagaagtgtgtgagggagaaccaatcaagactgaaaatggaccaagcacgtctaagaaagttattgagtgtgctaagaaactacgagctgactttgaagtttttggagagattgaacagatcaacttttttgtagaaaagggatgtgcttttgtcaacttttcaaacatctccaatgcaattaaagctattgatggaattaagtataacaaggactatgaaggactgaaaattaattttggaaaggatcgttgtggaaatattcctaagcaattcaataataatcataacattgcaaccaatgattttaggagaatggataactaagcgtttaagggtcaccagtattagtatccttccattttttttaaagcttccgaaaactcctcctcaggaatattataactaagtgatataagaagtagatcatcaggtacaattgtgtacttctgttgaaaaagggaagaaaaatattcattcaattcttgtccctgagtcaaatgcatgccattttctgcaaactttgaagcatcgtctttgcaaataataccacagtagtttcccagacatcccttgatgtgaacgacatcttgcaaagtatcctgtacttgtttccgtctatgtttgtagtatagagatatctctcgtagagattcttgccaacctttccagtcattcatcgagcttagtactccatttgctattatttgcgacatgccagacggcgaagttgttgtgaactcggcatacgattcaattgcagtaacaatcgtatcgtgagcaataatgaatgcaagatccaaattaaagtgccgaaagctttgagcggagataactctacctttagaatcatgtttcaagtagcttacaccttcagggaaagtgctcgtttccacaaccataaaattgtaaatgtcggcaaacttaagcacttctttcatagtcgtgtctgattgtggtattcctgttaggccataagtagccgtaagaaggagtttggggtgattcttataagggtagaaccttctccaattttccaataacttggatagcttagtagcgtttggttccgagccgtaaatctggttcaagttgataaaatgaatgttaggcttacaaactgatagtaggtgggcaacatccaaatccaattgagtgtcaaccaagatgacatcagattcgtcaacaaaagactccagtattttagcaatactattacaatgatcagtcgtgacaattgggctccaattcttatatttgggtggaaaacaatgggcgacaaaactagtaattctatccaacaattcagacgttcctttgaacgctgtatagcccatatccttggaaatggaagtcttgtccttggacaattgaggaactttgattgttccttgatttctacttatttcgatcgaagtcattgggtataacgagtaggccggttctccaaactttaaactcaggggaggctgcttgtcttgggattcggcgactactgcgaaggttgacaaggaacgagagcgggatgacttggaaagcaattgcttcaaatctttagagaagtccattgcctgaaagagagacgtaaattaaagaaagaaaggaagaaaacactccatggatccaaggttgctgacggcaaagtaagcggaggggtagtaaaacaagaaccaactgttaacatcaggagatggcgatgtgtgataatgtttcaatccactaacattaaccaacagcgaaatgcacgacattattcaaaatgtcgtaccgtctgagggtgcagagatgtagtagtgtgaaaagagggagaaaacagtggatgctggatgttcgatgtcggacctgtgagtttgatcaataggtcaattactgggaagatgaaatggatgcttgtgtagcgtttaggtgctcaaagaagattgatgttggggcgagagcctaatttcaaacgccaacgagattgtttgttggtgagcgggtccaacttccaattggatcattcctctgctcgagccaaagagacgttattttttgacgcctgctaagctttttttaagctttttaaggatctttcgtagtgaagagttttgagtttttttcctgaaccaagctagataacctgacttcatctgagaaaaacagaccacaacggttaatcaaaagttgggagatcaaatcaggagatttctccagttaccatgcgcatacacaacagataaccgatgattatgagtcccctttttctttctttgacaggtcttttgatcgtaaaatcaaatggacagtcataagtgaaactttgatagagtggtggcgtacctattgcactcactaatttgcagtacagtttactcgcagacacccgtagcctatcaagtccctttcccttacttatttcaaaaaatatgcctctttcaaacctaccatgactcgttcgttgtaaaaaggaacccctttagtcgggaaaaaagtctcgcaatgagttagatcggggtagtcataaccgtagccatgactcgctttaatcattgcctgtttaatcaccgggtattaagcaaattgcgttcactaaccaatatttatccgttttagtcgcaagaaaatttcaaatccgatctgcaaggtgagatgagtcgtcgctagatgcggttatataataagaggtctttccccatactacaatcacttgacccaaaagtagtagaatttcactataatggaaaaaaaagcttccagtgatctggagttagaaacggatagcaaaatctcggagacagagaaaaggggtccagtatcaaagttactgaacggcctcaactatgtctccaagaagctagattcctttggtggtgaatccaccggtatcgaaagagtttctccagatcaaaggcggaccaatatgacgaggattatcattcacgttatgggtctgtggttatcaggatgtggtggtataacttctatgtccagtttttttttaggacctttgatttttggactggggttcaaagatagtatgataagtggattagtatcttgcacattggggtgtctcttagccgcctattgtagtacgatgggaccaaggtcaggactacgtcaaatcgtcagtgctaggttattttttggtccttgggctgtcaggttcccagctttaatcagtgctatcggtttcgttggttggagtgtgactaattgcgtccttgggggacaaatactgtacagcgtttccaatgacaaactgcccatagaaataggcattgtgattatctcaatgatatcgttggtgattgccattttcggtatcagaattctcttgcatactgagacgcttatctccattccagtgttcacggtgttaattctcctgtacatcattggctccaatgaataccccaattacttgaacactgtatccattggggacactatgacgatcagaggaaacttcttatcatttttcgctttaggtttttctgtgacagctacttggggaggatgcgctagtgattattatacactattaccagaaaacaccaaccagctattcgtatttttcatgaccttctttgccatttggataccttcgtttactggagcggtgctgtcgatcttacttggcaatgcggccactgttcatgagccgtggttggaagcttatacgaacaactcactgggtggattattgcatgaaattttttcccgttggaatgggtttggaatgttccttttggtgatattcttcctttcacttatcacaaacaatattattaatacctactctggagcattggaactgcaactgataggtggaccactttcatattttccaagatggttcttgagtgtggtcatggttgtaatattcatggtttgttctctggctggtagagaccaatttgccacaattctttccaatttcttgccaatgctggggtattggatttccatatacttcactttactgttagaagagaatgtcatcttccggtccaacaaaactctaattaaactttatcaatatgagttctctaccattcctggagagaagcaagatcttctggagggcaaatccagaccatattacaactttgacatctatctttctcgggataggcttactcacggatttgcttcttcattggcgttttgttttggtgtagtcggagcaatttgtggaatgtgccaagtctactacattggacctatagcatccaagattggaagccatggagctgatcttggtatgtggttagctattggatttactgctgttacatatccggtattcagatatattgaactaaagaaatttggtaggtgagagagccaaccctaattctttgaaaatgaaagccttaattaacttatcatcatgttagacgatagttcagccgttatcggtatagtaaatacactgtttcggtccatcatgattagctatggatctcctcagtcctaatcttcgaggctctgaaaaatcaatcaatatgataaaatctacaggagtaatagtctgccattttgccttactttttatacgccagatatatatcattatcgaagaccagggacagtaaatcggtccaaatacatcgatccaatggaaagagtcaagagacttgttcagaatttgggacaattgaacattgagtgcactggaaagtcaactagtcgctgttgttattctccgatggtttatgaatgaaaccaaacaattgccccacaaatcgtcttacgctaaaataattatttgagtagccaaaaagtctcaagaagaggaatttgaaaaaccaaggaaaagcatagaacactttagccactgttttaggaggattctgcgactctgaaggagattcctggtcatggtcgtttgttgttgtcccgttcttaatagacgagatgtggaccatatttgagatattctgatgaggcaatcgattggaagcagtattagaggacgacgaattatgggggcttgttggatgcagctgaaaatcttcgtcaatgaacgggttaaattcttctgctttattatcaactgttgattgaacggtgttattgtgcacacttgattggtcattttcatactctgattctgagtctaccggcttattagccttttcattctttgcatcaacaatttgctcaccactatgtccatccactttctcttcttgctcctcctcaacagtccttgccgtagagggatctttggtttgcaacctttcaagatcatcaacaacgttgttctcatttccactctcgtcggtcactttttgatacatatctgaacagcaccagttttctgaaccatcaggcgactttatgataaacttaaacaccaacggctcagtcacccctttcggatccagatggatctcccagtgtttattgtcccttttgagtggtaatttctctgaccaatgattgaaggatcctgttattgatacctcatcgtcaatattggtgctactatcaaagcttataattagatagctcatgcctttacagacttcaattgctactggacggttggcgggcaagattaaaaacgtaattcactacgttttgtggggtgagaacacggaaacccgtcggcttcctatagtataattcttacgtaatatttattcttcactactgaattaaactttattggaagtagatcagttcatagttgtggatctactaattgattaggaagaagttcccttctacccccctcccctgccccttttttaacttgctgcctcggataattaatttacttcccactaagctgccttcaactgataaggccctattgttgagatatgtatagcctacatttgagtttggacactaccatatattttttattttttttcctttctggcgaaaagtatagagtgaaaaactactctattttgcacctagagacacaaggtaaatcccagactacgacagctactaagtgtttctccttctattaatatgaatggtaaactcacaacttctgacgcagtcacgcgatatctccgcggaagaaatactactgtcgaagaaatcatagatgtgtcgactaaactcatcaacaatgagttaccagtctacctgccggataaagaaacttttatctttaaactattgtgtgacaggttgaatgatcccaagaatgaaaaatttcactacaattggagagtttggaagttatttcatgaaatatactatcaactaagcgataacaagaatctcttaagaaatctgaaagctagtgaagtgttaagtaaagtggccgaagatatcgttgaaaagaccattttggataaggagttgattgatcaggtgtttgatgtgtttgaattactgctcaatgagctgtttattggatctagaaatgctgtcaagattttaaagtatttcatcagcttgtgtctcatatctatgaacgaagatcaccagtataccgtttttagatactactcatcactgcgaacgaaaacagaagataaagtagcgggtgaaattttcaaatcaagttttgaaaacctcctgcgtctctattctatatctcaaggtaagatgactaaagaaatgattgagaaatacgtcttatacgcaaaaaaaagtcatatcacagctttcgttgagcaaatcaccactgataactctgataataggcaaacggtgaacgagggcgttatattttttggaagtcttttggtggataaactgtcgaagaatactaaagatatgcaagacttaaatgaactctattcttccatgattcgatactattccactcaagagatgagggtacaaatgctagaagagttgattaagagaaatagaacattggagccttatgtcttggatatgttggttttggattctatagctacgaagagcttcatcctcattgaaactatctgcaagttgaatccactagttgtcatgaatcgtactgccgatatattttcctgctacagactgaatgacaatgtttcatcgttaaataaaacgctcactcttgcttttgtcaatgccaatgaactggacaggtttattagaatatggagtttacaagccacatcgggagttgcagagaaaagttttctggactcaagtctgatgcaagacatagcggacaatattcacacactttcattttttcagttgaatgctctcattgaccatcttttagatgccaagcgtattgtacctttaaccgtggtggcaaaaggaatgtgctttataattaccaataggctttatgacatgactatagtgaaccaatttatcagtcacgccaataagttgaaacccaaatttgatgtccttttcactgcaaaatggctcacagacccaagtatttgggaattgagatacaccttactgtgtttatatgatgcagacctcaaggttgacttcaagtcattgatacattgcaaggataggaatgaatattatttctatacatgtttcaaagctattgaaattgacccctctattgaaaaccccaaaatattcagtcgctatctcaaatggctgtccaaggaactcaaatccaaaagtgcttttaattcttctcttgtatcattcatttcttttaggtggattaagatcattgaaatctgtttttcaaattcccaaattaaaaaattgctagctattttgctgaaaggcaattgcttctttgaggctcacccatttttcttcgaacaagagagaattttggatatcatttttgagtatttctgtgcttcatcccttgaaaaccccgaagttttcattgaattctttgaatccgctcccattcaagttttttccaaacaaaacagaatagacatattgaaagttttgaatgatctttgcattaatggctctgataaattgaagattctttcgatcaatcttgctgtcaaactactaaaatattccatcatagagtcaccattctctgacctttcaaacttgaaagtgttattcaaaaaatttgcacagtttccggccgaagctctgtctttggtgagtagtctatgttctaatcagacatccgaatttaccgagagtctttcatccttcttgctgaagcaaaatttgcatgacgagtcactaatgttcaaagtgtcccacacagtacttataaactcgaaagattctgcaagtcagaagctaaatgctaaattcattgaagttgctcgatcagatattgtccgctatgcaaagtatttagttgatttgccacttccaagtaacgaattctcaaaattgaagaaactaataattgaaggaagtaaaggagttgatcctgccgatcctagattgttggacttgctcaaactttctataagaatcaactgttttcgtccaattcacattcttgccctgtatttaaatgtcggaacagagtcatttgatttgacagaatgggtatcttctttagatgatgaagccttcttctattgctttgatttggtgataaagtcactcggagagaagaacgacaaatacccattactgataaatttactgcaaacttttattgacaactccaacgaatccccaatcgtccctactctactctcgagatcattgtcatcattcatttcgcagtacgatccaaatgaggaagaaagcaacttgattttcttgaatgccatccaaaaatcattagttggatcgaataaggttttcactgcgtatctgattgaacaactattggttctattaaacagagtatattcgagtttggaaaacgggtcctcaatggtctttgtaaaagcttcagatattttttcattcattttgatttaccatagatccaaactgtaccggcgtgatcatctactgttgacgacagttatctgccaattgaaatgcctgttcaagcaaacgtcgcaatcttctgcggttgcttttgaaagggtcgtcactaatttgtgccaacctcccaacaaactctcgggaacccaaagtttagtgattcattctgacagagtaaaggaagcgattaggccatatcttcccgttttggtactaaattacgtatctctaaagatcaaggatcctatgaattttactacacaagagcgtaaacaaaagctggagagtgccatgtttatcgttcttcaaacgttgaaagaagaggaattgcaggtcatcaactcatcattagatgaatctggcagagtgatattcaaaagtttatacgacacgttccgcaaagatcacagttttgattgaatcatagcaattaaactatcatgttcataaaatagataagcagatacatataaaattcatctatttaacagtatgtcatactcataatcttccaagtcatcatccccgggttcttggtcaccgaggaaagtggtgaacgcaagatttaatgcctcctgaatacctcccggcattgtaatcataacagggttgattggttccgctacaatttgagaatccccaaggcttcgggaaatatacaaagctagttcaccatccaaccatagctcattcagatttcgaaatcgatctctattcaggaacgctttgcgtatcaagcctccatgaccagaatgtgactctccatgtgtggttagatatgggctgctcaatgggaatgcaaatgtactgtgatatagcgagcgatcagaaattcctcgtggaggctgaatctttagtaaggcagtcaatttattcaactttggggttaagaagatacattgtgcttctccatatccagagaaaggacaattcttatgatggtgaaacaaagtaagaggaacaccattgtacccagggaagttttcaatttcattttcagaatcaccgctatgtttcactcttttgccacacgttaaacaaacagaaaagtttagattaactgcatcttgggtgtcatattttgaaaaagtaaaagtgttcagttctctaggcaaattcacaagataaacgagacctggatactcaattgttgaagggagagtggattgtccttttaatataagatcattttgctcctccaataggtttccaccaggaattccagatcccaaataactgattatactggaaaggttaaaaaatttgcacagttggccaaacaaatagtggtcgtaatcattggaattctcgtagtcacgatttaggcataagtccaagggtctgcacatgctgattatcagaaacaactgtttaagatacactgtggtggttttctccaaaagaatatacagtccaaccaataattgttcgttgcaagtaatgaatgaaacatcagaggtaaaagtggccgttgacacaaactttttgaaaatggccagttctgaatcattaataatagagtttgcaccgctcagcatccttctgaaatgctcattatctccaacgttagtcaatagtaaattcaatgaatgcagaattgtttgcttgtaaatgcccacaatagtttcttgaagtgagtcttcttttccaagtagaagtgaaatggcaaaatcaataattaatgaatttggtttattcaaaaatggagacagatactgctcttcaggataagattgtttcaataagattgagataaccgagacacattgaagtaatgaggttattaattccgaatcttttctcttcaagtttcctttctggggaatcttctcgggggataatctgagacgaatttcagtatttgctagggtattacccaataatgttgacatggccaaaaatgagggaaataacccttcactcaacatgtggtcagaagcatctggggcgtctttcaaaatgtctttaaactcattcaaatacatgaactggtccttactttcttccgcaataaatttcaagaaggaatcattgagaagatatttcgatacaatttgattcaaattcaacttttcaaagtgactaatattcgaagcagcctcctgaaaagcagggctagcatcgtttttcatggcaaattgtggaacaaaagcattaatggcagagcgacaaagcggacaagtgctaaacttcctgctgttttctagtaactcagaaaaacatttataatgcatgtggtgcccgcatgacttaacaatgtgtcttgaagatatcggtgccatgctttttacaggagtatctttttgataataaagatgttctctaacctcattgttggcatccgtttcttcatgcaattgtttcatttgattttcaatggttgttaagcatctttccgtataggttgactcatccttaggttgaaaatcccaaaacgtggaaactttttcaacatatgcagggattccaaacatctcgttgccctcctgagcacgttgacaaagaatgcactcatgaaaagagtcctgggaggaactacctaatccttcattgtctttggataaatgtgtagttacatgttccgcactcttttttgcgtccaaattctgcttcatgaaagacttttgctgtttagcaaatcgtgatttgatcttctcttgtctctccttggctaaacgcttttgtttagctcgtttagtctccagaacttgagatcccttagattttttaaagttttcaatgtgcttttcaccaaaagaatcaaccaatgagtcaatgattgactcgtcccgctggatcaaccaattcaatagaacttcagcttttttgcagacaggtcgtgaaaaatcattgtgctcaacaactgataacagtagatcacacacaggaatttgaataaagtattgcactggatcttcgattctgtacaattcatgttcatctaataaaactgcttgaatcaaatgtaaaagttcaatgacgtaggtctcattgctctcagaaagagcagattgtaacaatttataaaacagtttgactacagatttgctaatgaagaaccgtttcaatctgctcaagacacggctgttggattcattcggtccactgatctgaggttcaattacaacattctcctcttttatttttcctaaaattgaaagttcctttactatcgctgttgatacatcatcgaaatcacccgagtccacataaatagacattggatccatctttttgtaataacttttcttgatagaatactttccagaatcattcatagttttgggctcttcgtaaacagcaacctcatcaaggatcttgtcaaaaacagtaacttccacggagataggaaagtcggctgtcagatctgaaaatgacaaagatcctttacaaagcgtgtataaaatgtattgcgttacctcatactgggttttctctgtgaaatttgattcaaactggaagttaactctgtgtgaaaacatattataaagaaacttaaccaattcattcattaggtaaaaagatcgttcttcgaaaacagtaccaagcacgtcctgatcgttatagaaccaatctattagattgaatctatccaaaatgtttaataatagacgatcatcgtcgcgttcttcgagtatagcaagttggttcaaatgaacgtcggctatgtaaccatattgagtgaacctcgtgcagtacaattgcgcttgtttactagtcatggatccatttctaatccagtggccaatttttatctgtgaactcaaagtaattgcttctaaactcttcgatgagagtttcagatagtctaaatcatctgaaaatgagacttcgggattgatactccaaaaattaatctgagaaacttgacgagttaaaaatgaaaaagaattggcccttacggttgttaacatgttagacagtaatccattcaatggattaataagagaggttggtttctttgttacgtcatggtcaataagttgtttttcgtgcaccatatgaaacttataaggttctgatgaaattaaagtggccaatatttgtatgtttgtttccacaactttccaatgttcaggtttacgtatttcaggaacctgcgcaatttcaacaatacctttgatgacatcattaaggtagtaagatatttgcaggtaggttaaaaattcagtggattccctggtaatatgttctccttcctttctgaccaatgtcagggcactctggaacatcctaaaaagcatgattatgtaaatgaagttcttaccctgaaaaagtaccaaatgttcttctgattgatgggcagtggtgattaacgtcactagatcagttaaagaacgcattaaaccaaatttgagacctttcttacgtgataagagttgatatggtcgtttccacagcaaatggtttccagtataagattcgaacaacaaaatgatggggacgatgatgcttctgaaatattgtggttgtaataaatggagagatgttttaggacatgtaaagagttgtactacagcattgcccgcattgctgagaagccactctctatcttcctttgccatcaatatcaacagatgcgagtatattttcacaaactgttcagaaaaagtctttttgtattccaagtttgaaaccaaaacagatgtcgttagcaatttcaaagattttcttgcctttttccagaaccgcagatccatatagaagaaatactgtactcttgagccgactagagctgaaggttgttcattaagaaaactggatagttttctgttcttcaagtcatcaatagacaactcgttcattacatcctccaccaatggggctggaattctgtttttgaaatccagcaaaccccgtgtgtctgaatattcatcttcccggtagaaaaaatctccttcgtgaatgtcggcatgaaactcttccaaaagagattcacacaaactttctctaatagcagtctgaatttccggccttgaaatttctaacagagtcaataaccaatcaaaaatagtatcaataataatcaatcgggtaacatctctatcagaaagaatcgtaatagtaaacccggattcttcaaccttggcgcacctttctatcagtaaaggcaaggattcacttcttcttatgatggaaaatccaaaatcattaatcttttgagcgtcagcttgtcctttagacaatgaacatctactaacttgctggatgcaatcaatagcctcatcataattatggaattcgtcgttccacaggactacgttccaggactgaacattcgtgtcttccactccatatctttcaatgggcagagaagaactatctgaagcatattgaatagccatttcatagtcggatgggtcttccttcatcatgtcctgaacagcaggaagcatagatgcagaatgaatagtacaatccaaaatgtaatctaaaataatatccattgtttcccttatagcagatttaaaatctggattaacttctgaacttgaatggtcatcttgttccagttcactctggcagtgtaattcgatattccatgcctgaggatctccacaatcacagataccatcgttggaggacgaagcaattgaaatggaaacctcgtggtctcgatgttgctccctattaaaacaatgcatgcacattacacaagtctcgtcaaaaccacattcgtagcaccggtatatcggctctccttgcttgaactgccttgcacaaggtcttccatgatgcttatagttagggcatttgtacattgattcagccaatcttgagtaggaatcatcttcagcctctaagatttcggaataagatgatggcaaatccattggcaagtccgttaccaaggaacccagatattcacctctctttgtcagcgagaaatatagagcaaggttcagtcggcttttcaataccgaagactccgcatcgtacttaacattggagggtaaactcacaagtagacgtcttaggctgtcctcaggatcagacaatgacatgctttaagaaataaaaaaaaaacgtcttcagaagttttggggttgcgttatgcactttactcctcttaacatcttacccttcaatcgattacgaaagaatatggagccagagtatcacgtgaccacattccaagaagaaagtttgtttgaattctgcaatgtattcgcggccgatacacgtacctatatgtcctgtagtttccaattgagcctcgttccttctccaccaaacctcaagatgtcgattcgaaacataatcaacgacccctttgccactgggtccctatctctggccgccatgtcgtggatcataacgtttatcagttctatcgtggcggatgtccagggatccttccccaaactgacgtggtggggtattgtgtttgagctgttcgtgatccttttcctcgcagttctctacattgttgatgacatccaaccacaccgtctgagcatcgttggattcttggctattgccaccgtttacaccactaactcagcaaactctctggtttactccaatacgtctgcaaaaaactgtgcggccgctggatcaattttgctatccatgatcaacctgatctggctgttctactatggtaccgacattgctaactcggtccttgtagcaagagtatttggaaaagtagctcctggattctcgacagaccggaatggcgtacacttggctctccatgaaaagcagggttctaacccattcaccacgcctcaacccaatcggacatacactcctaatgacatcaataatacgaataccaactacatgtcatcgggccaactaaccggtctagaaaagggagtcgattcaaatgcttatggtaatcatgatgactcagacgatgagctatctgctgatgaccattatccaatcacagtaagggcactctacaactacgatgccaacccagaggatatcaatgaattgtccctcaaacagggagaagttttcaaagtgaaagacacagcagggaaatggtggcaggctaaaaaacaatccggtgagctgggaatctgtccaagcaactacgtggaaaccctacattagacacaacaaacctctttacactgtatttttttctctatggaccgacccgaccgcgtttcagtttttctttatgtactactaatgtttatgtttactgattatataatcatttctctggcccagctttatgttttcgcgatactatttatcagacttgatcttggcctgccatcactcttcactggaagacaaaggtaaagacatcgtataagggcctcctcctctagcagaagcacccaagaaccctgccatgagcgtccaagaatacaacattcagaagctgcggggtatcgtgtataattgcctagataatgaacagctggattcggcgcaactgaacgtggagattttgtgtgctcaaaatcctgctaaccttgattcgatacatcttcacgggcttgttttgtatcgaaggggtctctacaagtctgcctacaatctaactgctaataaaatgcacatgggatgtgcttatgtttttgcattgtgtgcgttaaagttggaacatccccaagaaggaatttatgtgctccagaaaatactggatactatcagagaagaaggcatctcagaagaatctatggaatccaatttgggaaagaatgaaaatcaacggagtgtgttaccagatatcccttctttttataacttgctgggcaagttgtatgcctctatggatgacgatgtcaatactgtggtgtgctactccaaggctttagaactgaacccttttctttttgaagcttttgagcgattgtctaagttaggggccaagatcaaaattggcaaagtatacaaacccacgtctaccttctcgatgaatccgccagctggtagtgaattatttgagagcatagcacctgatacttcggtggaactaaaacagccagaagactccaaacctaaggggcgatctcttttcggaagatctaatattatgggcactccggagttttccaagaataaagtcaagaacctgactaccccaaaagtacgagagctcaagctccctgaagcacctacaagaaagactagaagttctgtaacttcagatgcattcaaaccgccgccagcaaatacatcaagctcatttccaagaagatcgaatagactttcagcttccaaggttacgtctcgtttgctgatgcaacctatttctggcttaggtaccccttcaacttatgacaacgataatacaactcacatggatagcatcaaaactaacaaagactcatggttgaagcgatcttataatttttctaacatgccccctgctccaaacaataatagtgacttccgtaattttaatgaggttacgagtgaaaacgagttgattgttctttacggacgaattgcaagagcttacaaggcattttgtcaatacgattgcttcaaagctatcagactcttcacgtctttaccggagcacgtcgttgatatgccctgggttctggccaagctaggaaggttgcattttgagattgtcaactatgaacaatctgagttctattttcaaaaactgagacaaattgaccgaacgagggttgaagatatggagtattactctacgcttttgtggcatctgcacaaagaatctgagttgagctatctttctcatgagctctatcaaatagacaaatatgctcctcaaacatgggtcacgattggtaaccttttctcattgaatagggacaacgaggaggccgttagatgtttccaaaaagcaacccagttagaccagaattttgcatatgcttatactcttcaaggacatgaacatgttgcaaatgattcttttgagaatgcatttgaaagctttagatatgctctatctattgacaaacgacattacaatgcattatatggcttaggaatggtccatctcaaacttggagactttacaaaggcagaatttcactttaggaaagctattgatatcaatcctgtaaacgtcatactaacttgttgtgtaggtatggtacttgagaagttaggaaaacgggagctttctttgaagcagtacgattttgcatgcaaattgcaacctttgtctatgctagcacttttcaagaaagctcaagttctcttagctctccaacaatacgacttagctctcaaagactttgagaaactgcaaaagcttgctccagatgaagcaagtgttcacttccttcttggagaactttacaaacaactggggagaaaatcagacgccatcaaacagctgactattgcattgaatcttgatcctaagggctctcacgtcgtgaaagaatcactagagggaatccaaaccatagataccatcgacgaagagatgaacgaccattgacgtatttagttcgtttaaatatacagtattatacagattagctataatttcacttgttgaatcttttattcgatacaacccttctgactcctgaaagcattccagatccatttttttctttcttatccagacctggaatcacaggaggttccagcatagtcactgtgggcgttgcccttccgttctgtcgtaatgagtgagtcctgggtgacgaaacatcagaatcaaaagatccttggactgactttggagaaatcagggcaccagttgccataggagaagtagtcgaaatccgcatttttggctttgtaatcaaaggagattcagtagatgtattaactgagtcaacatctggtccactgttcctcaaagcttctttggaatcgttcaatcctttggcactgtcatcaactgtcaaagaaccaagcgaagggtcaactggagacagcgtaatgaatccaaaatcatccaaattatcatcagttttgagagaagagttttcaccagctttatcttgtgctttggagtttggtgtaccttcacgttcgtccaaggccttgccttctttctctagttccatatctttcaacatggcatactctctgtttcgagccaaaatttcctgggccttatccaaagaaacagttggcgtagcacaagaactaataacaggaatactttcatccagttcaattgttgccttcatcaaagcagccatccattttcttaattcatcacgagtttctaaggcaaaataatgaattttctgttgggtaaatgtcaaccctttcctggatccaggtgctggtggaacaagtttgaaaaaatagtttcctttaccggttgtggcagcatacagtgcactgaaactgtcatccgtttctttgctgggcaaaaccttgtgagaagtgatgtcaattagtcccttctcttgcgtatctttcagagagctgaagtaagaaagtctagtgtggtggagagtaaagtatctatgcttccattgaccaagactaccttttttgctcatccaacctgaaaagtcggccgtctttgatgcctcctgaggggtgaccatccttattccttcctgaaaggcagaagtttgactcttttttcgataagttagagttttggttagtggttttggtcttacatcagaaacagttctcttcgtggattctttttctaaatcagaagtaatcgatgcactattgttagagctttctttggcagatactgatcttcgattgattttaggtgatttcaattccaatacggatgtgtctgccgagttcgagtcatcgtttgcatccgaaaatgttgttaaatcgtctgcaccatttttctttcccttagcctctttatacctgagaagagatatttttgaagggcttgtcagtgcattaattagagagcttcttttagaaactggctcattatctggattcaaatgaggagtggaagcattgttggacataaaagaaaacacagaagaataacgtctatgagctttatctttgacatccacgctggattttcgtctctgagactctgatgggtttcttgaatgtactctactcccaggagtttgcagttgggatcgttgagaaacagaagaaacgtttctctgatggttggtttcaaatgtatataatgatgaagcagctctggaatgactaaactttctttgatgaggaagaagtggaggtgtttgggtattattaggagtcgcagggttggccccaaactgatatgaacgatacgcaacttgtggtggttcaattgggggttcaggagctcttctggggctcgtaaagtcaccaccagggctttctggagtagatgattcagcggaatgcgggagttttggtggggatataggaggcggggcaatgctaacagatttcaatggatagttgggggtagcaaatgcttgatccattgattgggaacgctttcgctcatggtaaggggtaaatgggtgggaattttgatcatgcctgggagtctcgggttgtggtgttctaatatttctggagtttttctgtaatcgacgaagctcttcgatttctttaaaaatttcaaaacgggttccgaatgattgaatatccaattccttcaaatagctaagctctagttgaagaagaattgacccattgattttatgtcttgcaaactgacctgcactctgcacatcaaaattcagagaggaaaagtaggtagtgacgtcttccggtgtccactgctcgacatccagcggattcaacttattgttgagtggtgatgaggagaactttggggttgaagccttttcggcggtcaattcttcaagcgcccgatcaatgtcattcatagttttcttgacggaagattggcgttgctccaggccggatccatttaccgtagtggaagtataatcttcgctgccttgagacatattctgtaactctgagactgagtctaactcctggctcacactattgccacctgagtttggagtaccagaagccttgggaaattttgggaagggttgaaaattgggggtacttgtaaaggatgaattattgctactttgcatcttacgagatctggacctcaatagcgaaggtctgtgactatcattctgaattatcttggtgaagtcttttgggtatagacccacctggccagtggagaggtttttaccgagataccaaccatcgttatattccgaatcgtcgctgataacctcaacttgttctcctcttgtcagtgtcagctcatcgcccagacgagcattaaaatctttgatcacctggtatagctgccctaccacggtcccattctcaggaacttgaaccggagtatttggagaggatatccttgagctgtacatgtagtttgactattatggctgtggcaatgatttcgtttcaaagggacgaggatttttgaacgatttttcgaacaaaagatttgacacggttttttgggagccttcaaagaagatgtatgggtattattggtgattctatccgatgtctctcgttgaacaaagaaagaggtttggtgtgcaaaccgtaacacgtaggagccagccagtaaatatattgagtgatgcactattatgtatttaacgaagtctagaacgaggagcaacgcgacggggtactaggtacggctgaagggcgagcacctgcacgataaagtcttggggaagggtgattaaacattactacctggaaccactaaagtagctatgtagctatccaaagtttccaggaactgtgccagtagaaatccgaaatctgtcactatgaacttcatgagacatcgtgaggtgaaacgcagcaacattttgatttgctggaacttaagatactcggaggtttcaccatacacgaccaagtctgagtctgggaataatgccctgaggatttcgtaatgtttagtcaatgtgtggattgtgatgtaaagttcattgatgcactttggatataaagtgtcgcctaatgcagtgtagcttgtcgatttcttgggtgtagatttgtttcgtagttccctcgtcattatgggagaggatatgtggagatcagctgaattagtcctcgagtgtttggacagtttgagaaactggaattttgagctaacctggggtgatttggtaggcgatttgttaggcgatttgttaggtgatttatcagctgctttggtgggcgttctgttagggcctggagactgggacccgttgataatgaacggtccaggaggttttggtgggtgacgattgggaattgtgggaatgtaaagacctctgttctgatcggaggatatgactatttcgtaagcactcaagagttttgtatgatgctggatgaaaacatcaatcttttggttgaaaacagctagactgtccctggttatcttagccccaaacagccgatccagatatgtatgcacttctgtattaaagtggtcaatcacagtaaacttgatttccaaattggcaatagaattgacgtccacaaagaatagagaactcttgttgaaaacctgacccgcagaagactttgacctatattctctacgtacgaactcatcgttggcttgtttcagaatttcaaacaccatgtccggcaaaagatgtttatcagtgcagttaacgacttcaggatgaaattcaaggttgaaatcctccaaaatggccttgtttacatgccgccttaattggaagagccttagcatgttcctctggtattctaaggccaatacttccgttagggttttggttggatgatctcctgaaaaattcagcgatgaatacgttgagtcagagtcagacttcgaatctcctataaagacacattgctctgcatcatcagatccagatacgacggaatcaaaatcactgttcattaataggggatcggagcaaatacgagtatcaactcggaattattgtattgtttttcgtatgtttagcgataagtcttacctaataagtatttacgtcccgtcagtaaccattactgatagatcggcgaaagatccgaaatttgcggagagaagaggaacaagttgaatctgcaggaatagagtcgttgaaaagtgtcagatatgaactgcaagtgttgttgacatgtagcctcaagcgccttctagttgttgatggacttgatgtggaccctgacaatgcatcttctgcatcacaacgattccccaatgaccacgtcaacttgccccagctactcagaatatggtttatatcaggcagttcgttagtactttttttcctgtttcgatttggtctaactcttatcgttgagccatgagagatgtgcgtttggaatggctcattttctacaatagatttctctgtacagtaactcaagctggagggtttaattggtaaattcacacaaagcctgcatagcttgctccactcatggtttcgatgacatcttttgcctctgtcatcaaaggttccccgaaacttccccaatgtgactgtcctatattgacacaatccgctaccaacattactcatgagcttagcgttggaacccgttgtcaaactgtggttccttatttcaacaggagatttgtcgatggtaattacggcagcgtcttcaaattgattattgttttcagcatgtgttggatcgcatatattcatgtgcccgatcttaacctctcgtgtataatcgtatcagttgataccactccagtaggtaaaaaaaagctagcaacaacgtcagccgaaaaagcatccccaggtataggatgcaaggtatctctgtggacggggaactgagccgtaaacgagaatgctctgtagttggggtcttctgggtaggggcgcttcacttcgctatctgcgcatcttcaaatgcaccagtccattccatgacatcactttgcgacacaaactacaatgcccctgctgggactgagcattattaggtttagagcttgccatggctctatagatacaattggcacaaaatatatgaccacatggcgtgactaccgcttcgttgatggcgtcaaaacaaataggacattctgtcatcttgaacagcttttgattatcctttctctttgcagacgcctctaacagttctatagtcgatttgttagcagctggatctttttcgccatcggatcccagcacaataacatcttcctcctcttcctcctcctcctcctctatctcgtctccactagacacctcagtatctgacccgtcgggtacttccaaaacagaatgctttctcttattggtgcgatctctttgctcatcgtcattaatcacgatctgctgattctcctcttgttcagatccagtatccacaacatcgcttagagggctactgctgccatcaattggtgtaatgaactcctggtcagaatcctcaaccggagtaaaaagtgaatcttcctgtgcattcattctttaacttgacattcttgaataagctctaatttacaagcagttgatgatccagtgctgatggaaaccctgcttatccgatgtagtcttaatgtattcagaggggaggtagaggcaggatagataagaggaacagtcttagtaatcatcacgtgcacttgttcagggctctcttcgggttttgtttcaaagattcgcgaactgcacctattgtcctacatttcaaacgaacccagagcagcaatttttgattcatcgcacgacagtaattagttttcgttaaaaaaaatatccaacttttacctcaataacataatcatcaactatgtcaggttcaggagcttcaggtaacaaattccgtatgtcagtatgtgattttagagctatcataggggaaagcagaatgagatgttttaagcgatcagggtgtattatttgtgagaatcttacaagttattgacattatccaatttcattttagggcaaccatgtagtgtttgatttcggagcaatatccactctcagccagagaaagggtgttgattgtatgccatccaacagaagtggttgaacttgctttccctgtactttttgcattatcaatagtcatttttactaacatccatatagttgggtctcccagtaggagccatcattaactgcgccgacaacagtggtgccagaaacttgtacatccttgccgtaaagggtgttggtgccagattgaacagattgccagccgcctctgttggagacatggtcatggccactgtcaagaaaggtaagcctgaattgagaaagaaggtcatgccagctattgtcatcagacaatctaagacctggagaagaaaggacggtgtcttcttgtactttgaggacaacgcaggtgtcattgtcaaccctaaaggtgagatgaagggttctgccattaccggtccagtcggtaaggaatgtgccgacttgtggccaagaattgcttccaactctggtgttgttgtttaaatgaataatatcatagtaatatcaaaaaaaaattagtgctttgggttatctcttatttaaacaatacaatgagtaggtgaataaagtagattgtagactgatgtctagaagcgctctggttttacgtaatatgatgtatggctcttgaagtatctcacaagtgatctcttcgtttcctccagaccaactacttgaaatgctttgtcatgcctacaattgattacaaggcactgtccagtgagtaatatatgttccaattccattacatgttctaacctcatagttttattgagatctaccaagatcaaagacaggaacgaggcactagatcagttggatcagattgattcttcctggtcgtataacacagataagtctcaagtttccggcatattactggtcattgactccatttgtgcagccattgacattgaaaagactttgtatctgaaatctcttctggtcaataatgccaacaggacagttgatacaaggttggaaaggagttcaaacagcataaggcggattctatccgcactctttaaactctccaatgtgctaccaaaaatcaaaaccaaacactatcagtcctttcttggagggattatggattgtagtttgtctcaattagactctggagattcaattatagtgctaccagttgccctgaatagtttcaaatcattagcattcctcttggagttgtatcccttcagaaatcatttgaacgtggagtttctagactccgtcctgtctttcatactaaaatgtcttcatttgctggactcaacgaagctggaagcttcccgcactgctcttaatgagagacttatacgagaactactggtttcattgtgtcttctaataaacccagaagactcgtcaaacctgtccatttttaccaacaatgatcatattttttccatcataaattcagttcatttttattactctaactattttgttcacacaaggcgtgcttcatacacgattgtgttaatctttcagataatcaacaaactattaaccaatacttccattgttaacatcaaatactgccatcaattatacaaactcggagtatcttacctcaatcatactgagtacttcaatatagactctctcaaggatcaactggtgattttcttgaatttaatacctgactttattgacctctcacatttccccaaacttattggcgatgattggaactttagatcccatgatctcaatgaactaaatttgcctgactcttcattgtcgctttttgcatctgcagaaaactctgagccagttgatcctatcactaactcaaattcaggtgagttgactcaactagtgatccgtttgctgagactgctgggagaaaatacagaatttcaactcaacgtacaaaacattggtttattcctttttccctctgaacagctgaactggtttgcgttgaatcacatctatcttgactcatcctcatccccaaaagggtggttgttagcttctggggtggttgaaattctaaatcgaatgtacagatcgaacgattcagtctcccagtccatttctagaagcaatatactccatcctccagctagaaaaagacggaaaacatcacaaccagacactcttgaaaatatattgcatgctgccgaaacagtagaagaacttttgctctccatgataacttctaacgagaccagcactattttgcttggtctccaactatgttcttttcatttggagaagaacgtcaattatccagaatcaatgcatgatagccggaggacggtatcaggtatgagcatcctaccgcctctactaagggtcttggaaatacaaattccttcactttctttttggtcactactatgtattcgttctttattgagtcatgaacgtcgatgtgaagatcctggagacacttttacagatcgaaatactgtctatcaattggtaaagtactccttagaatcgctgaaggaagtatctactgtgagaatttcctctctggtattatccgaacttatatatcttagctccaaaacgtccatgaaccaaaaattcattgatacttggagttttgacgaaaacatcattgcactttttgaaggaatgattgatatatctgaattcaacggtccttccattgttagtaaggagtctctttttttctggctacaagttagtgaactagagtctaagcttataaaatctttaaaatcttcttcacgaacaaggctgaccctgaagattcaactttggttgttttcaaaatggaacactttttcatggagtatacaagaggaagattatcctctgctggttgattttatatcatggctggcaactccgattgcaatctccatcatttctagccctataactgttcgtaatagaacttttgctgcctatatggatcttaaagttgcctatgctcctttaactagtttcattttaaatcaaacagtttctcagaaggcagcaagtcaaactttcgaatatactacttcacaactgtcccaaaacttggagcaaatcgacctgctatttacaagtctctttaagaaaatagacgatatgaggtcttcgtccgagaactattctttcgaactgtgtttattacttcgtttacgagaaaggattgagggcaattcaaacacagtcaactatctttcttcaattgaatacaaagtaaatgatattctctccaagcagttggcaaaaattgagactgaacgggaagagttttttttgagctcttcaagcttgtgaaccaaggttgtatcaataatgattctattcattttattgtacaaaaggttgatgtggacgatcttctggctgattgtattaactatcttaactcgccttcaagaaattcaacacctgaagttttaaatgaggagcttaatctggatcatagttttggggaagatgattttgatgatctcccccataaagatctagccagtaaagtcaggtgggatgttgttcaactaaaagagactccagagaaccggatgataaactttttcctacaagctttaacgtttgacgactctttccataaaatactaatgattcttcaagagttaacatctaaagaatctctacttattggttgctcgtgtgtagtagcagtcttggagaaggaatcaagatttgtgagggacttgtcaccccctgcgctctctaaattcgttcgtttgtttgctggaaaactattaacaaattatagtacagagaggctagagtcaactattgtgacaggctgtaaattattaaggagtctttctgaagtttggctgggtggttcccttgaacaagactgtactgacatctgcaatttttttatacgtttacaacaaacacatttgatctccactgaaatggccctcatagaagtggggaatctttatctgcatttagccgagctggggcttgatgcggcgagctcgggtaatggatatggtgttgtaaggtttttagagcttttcacatcctacgacaataatttcttcaaaatttcgatttccaatggccttcgatctctcttgacaaagctaccatatagagatcagcaagattactatgaaaagctggagaaagtttttggaactccccaggaaactgtggagaaatctgcaactttttgcctcttcttgacgtccttgagtctctctagtgatgacatactagctcaagttttgcatagcttactcggactttcaagttttgctcatgtaaagtgctatctgccttcttcttttaagctcataagcaaccttggaaatgaaagttcgatcaagcaccttttcagcaagataaatttgaaaatgttcaaactatgggttgaaaagggaatctctttcaagaaagttccatttgatctgttgggatttaagtctttcaatgagtttcttaggactaatagaaaagaagttgcagctgtttatctctcaaaggatagaatccaggatttaactgagttgatcaacactagtggaacctgtatcccagacatcgttggagaatcatttccattgagcatagctctttcattcaccagtggtggagtgagggatgaaatattttctactctgaggaaacttttagggaacgataagaggctcacagaagagataaagttgcatttggtttttgttatttggcaggttttaaagttcacagatttttcagacttgagtagaatcggagatatgctggggaaacctaaccatgtatttcttactatttccactggtctaagaattctgcctgatcccgttatttcttccaagacatcattgcatttttttaaagctatcattgaaaagtattatcaaactcaggacctcttttggactggtccagttatatttttcttattgaggagatgtttagtgcagatagaattgacagataatatcatcaagaagaaacatttcattcagaagattatgttcttagttctcatagctccagcttcgtttggcttcaagcacatcattgaactacttatcagtttgtctccgcttttggttgtcaaagaaactcatgagcaagtcagcctcttaatagtagaggtattgaaagaatcctcttctgcggccgtttcattgattccaattgcttacgccttgttgtggaaaagtcaacatagacatcctagtgattattgggttcagtatttaacccagttgacagaagaagaatctgaactaacgatcaaggcgaatgtgtatgaacgttgtttaaacgttttgaaggatcaaccatttaaactcgatgcatcttttttggaggaattactacttttttctgaaacttttgaacaaaaaccactcaagaatgctatagttttactggtctctttgatgatggatttcacgaaccagacttcgtttgcgcttgacatagaagtcctagataaccaattgataagcatgctgactgggattaacgatacagacatttactccaacgcttttaacttgtggagagctagaattttaggccactactacttgacaactggacaaatcgcaactatgagctctattgaactggattccaagctactggaagacacatccaatatctttccgaaagcaactgatagatttgacctcttggtagctgaactactccaaaactcagatccagcttcaaacctagagaaatcacattatgagtctgtaattggagcccttcttctgacaacaaattttgactcaaaacatttgaggtccatgttgaatttcgatacgttgaaaaagtcgaaggaatatattcttcctctgcactatcacacatgtttgttggcatcttctgaagttgaaacgtatggaaagagtttctttaagaaaaagatatcagaatttcatattagtgctgtaagcaattcatcactggtatctggtcagtggattagtgatgtatgcatggcaatcataaatgaaatttcagactcaatcccagttattaagttgtttgccatacttgttcacaatagtccgcacatagtttcgaagattttcctaccactggttctattttacgtagctacatcgaaagaagctatacatcatatgcatgtcatcatagaccaattttttcagatcaagaaggaaactctttccagtgattcaatcaatctcattcttgagctgatcttactgatcagagttggtttttacaagaaaataaaggcaatggaaaagctctacagaggaatgaactttccggtcattatcaagctggctcaatatgcaagaaagccgaaaataagtttagtgctttttgaagattatcatacaaacatgtctcccgctgagtttagcctgggaaatcactctccttttcttcggatcttgtatcatgacgttgatgaagcagacattttacgaggattacctgtaaaaacaaatattgattatgcagtggatatgttgagccaatcgacggaggatcgatggaagaatatggtgtttgatatcgccaattttgatgttagttttattcgaaaaagcaaaacaggtcaaaccaatcggttggctcataccatgttatccgacggaatgactagtttatcgaaacttactggagagtatctttcagagagtaagcaggatagtgttgcaggtacccaaattttagaggatcaatattgttggagttggagactgagtcaatgggacgttccagttcctcaagagctggatacaattgataaatctattttcaaactgctaaaggaaataaatgaaagacccaatgaactccgtttgatatgtgaagactcattaagaaaatgcttggttgacaagcccaagttcatccgcaagaccatcttcaagaagcagaatcttaaaagctggttcaactgtctagcagttatcagatcaatagaagagctagataggttgaacgattctaatttggccaaagagttaaatcattattcaagcaatacaaagtggctagacaacgcagatgtcgagcaatcagaccatctgctgttgggtagaaagactgcgttggagttactagtgggttctaagagactgagcactactaatctgaaactttcaatgctagctgaacttgctaggtatttcaatctagctaagaaggaaggagagatacagaaatcagtctttgcatcaactttcatggacagtatctctcgagatttccccaacgaggctgacagttccgtaattacattcgtcaaagacatctccaagttttacttagcagcttcattttggcaactacaacaatccagtttctctgttacagcgctaaaagaaattatagacaaccaaaaagttttgccacacatctcctccttctccttcaaattgttagaaaaaccaagaccgctacttcaatcgatactgatagaatggatgtctgtgtcaagacaagatacagcggcttcgattatgaaagatatggtgacccccatgttacaaactagtcttgacgatgttgaacccatagatagagcccaaatctatcatgtcatagccaacttttgtgataaacaattattgacaaaatcaatcgatgagtctattagtaaaatggaaaagtactacaaacaacaaaaaaaggaattgaatgatctctcagaatttgtacacaataaaggtaatgataaagaggaaagaaaagaggcaactcgagtttacaagagaatagagaaacaattcaaggcaaattataaggaatacgaagcaatctccaagtcacgtaggcgctacattgaaacttccatcatgttctacctcaaaacgattagcgttcatgattgctatgacaatacagacgttgatcgtttctgtggactatggttagagcacagttcagatgacaaactgaacaaagtaattcacaggaaacttatggacgttcctctgtacaagtttatcacttggataaatcaattaatgtcccggctccttgatgaggattccaactttcagagaaacctgaagactttaatattagaacttagttacatgcatccctttcacacgctctacatgttgaaatctttaagattgaatgacttttcaaatgatctctccgtgacttctcggaatgaggctgctaataaggtctgggaaaaattacaacttagagataccggtttcaatcatagaatacttagtaaacttgatgaattttgcgataaagctgttgctctggctggattgaagcttgggaaggtaacagaaatttctttgaggtcaattaccaatggacgttggtggacttcaacattacctcaactagacgtcacacctccaacgtgcacaatacccattaagaaagatggccaatatagagtttcagaaatggtcaccatatcctcagttgaagaagtgattaaggtcgcaagaagcggaataagtctaccaaagataatgaatattaagctttccaacggaaagtctcataaaatattgttgaaagggggtactgatgatctaaggcaagatgccatcatggaacaagtgtttgcaaaagtgaatagtctattcgcaagggataagaacactagaaaaaggaacctaaatatccgtacttataaagttgttcctttaggtcctcaaagtggaattattgaatttgttgacaattccatcgcattgaatgatattcttcggaaattacattcccaatctgacactttatcttttgaagaggcaagattgaagatgaaggaagttcaagatcaaagtaacgaagagaggttaatagtttatcaagaaatatgcaagaatgtccacccagtactacgaaattttttcttcagtacattccttaatccagagacatggttttctaccagaatgaattatacgcatgggatatccagcacctcaatcacaggacatgtgctggggctaggcgatagacacaacaataacatcctgctggatttattcagcggggatccaatccacattgatcttggagttgcttttgaccaaggaaaacttcttccattaccagaaactgttccttttagattaacaagggacatcgttgacggctttggtataacaggtgttcaaggctgttttcaaactagtgctgagcattgtttccaagttttaagagaacatagtgagaatatcaagagcattctagatgttttgaggtatgatccactttattcatggtccgtctctcccattagaagacaccgtattcaggagatggagaatatagaggcagctgtgaaagctcaacgagatggttcagaagcccaaatagcgattgaaggagttttgagaaagttgtttgccgatggactaagtactgaagccgttgtccgtgagttaattcaggaggcaaccgatccggcaaacttgtcactactgtatcttgggtggtgtccattctactaaaactgtgtactccaactgagagaagatagaaagacaaaagtgaaaaaaaggagaatgtattataaattgaaaactagtagcaacccctgagaacgttcgtcttatctctgtctttgattgcctctgtttccgccagaggagtttgcgctatatctattgttgtagtttcttctctggttattattgctgttgttattattattccagtttctggctcgttgttccttttgcctagcacgatctatgatattttcatccattcttacgccctttatttcaacgccgtgaacataaaactggggaaactttttgaaatgctctccagtagcgtcgacctccaacacattctccaaagtcagattcatccatgaatcacaatccaccagatatccatttattgtgacattattcttcaattccacctgaatcggttcacctttagcggtggccagcaaaaataggggaagcattagttttatgtcaggttttgggggttcaagatggttttttctgggacaggtgatgaaagtgagtggaaacatcgcgatggcggatggcaaaaaattataatctgcaattgatatagtgagggcgatggagaaggagaaggagaaggagaaggaggatgatacaaacagtcaattaggtaggaagtatacagtgataaagtctattaatcatctttgattgcattgtagatcgtgttcatcaaaataatggagctgaacaatcccactgatccacaggcgaccccaacggtacaactaattagggccatgtagatcaggtagatcaatgtacttgtaaagtcgacgactttcaagtaaaagatcagatagaaaatgctgtatgaagtaaggtaaaatgccacagatccaccaataatgaatgatctccaatgccaattatagtttcctttgtttacggacaagaatgtcgctatgatggctgtttcgacgatgacgatgcataatagacccactgtaacaaacaggaacccgtacatgtaatagtaggttgatttctccaaccacaatgaacggaatataaacaagagttccacgtagattattccgaaagggaaagctccaaatagtgggacagccacgaataatttgttatagaatggctgtttgggtatcggtgttttgataattaaatcatttgaagatttggttctcagaagagaactcttgctggatcccttgagagaccaggaatatttcagccttttactaacataacctcccatgtaagagagcgggatttctatgactatgattgagagaaccagtatcaaaattgtcctgattgggagtgcaaatgaagaagatttggcccacacaaaaaaattgcaaaacagaattgtagatagtataacacttgtacaaaacacaccgcacagaattgaaacttttctccaaccagctgtcatgtgagggtcacttttaagctgaaaatagaattgagcacctgcaaagccggaaccaaatccagctaatataaagcttgcaaaagagatagtaaagaaatcacctttgaactggggtctaagcactcctattgtatagaatatgataacagaaagagctgtcagaaggatctgaaaaccggatccacctaagatagaaagtaataaggggtgagaaggtacgtggaaaacttcattcctaattgatttccaaccatcagagtcgctatcagtatgttgcacattgggaagaaactttagttcctccgtgacggcgtcatgaattcgatgagaagacttgaactcgttgatatctcgcgttaacgttttgtataaaaccacacctaccactgtagataagaacagtaccaaaacaaaagaattgactaatgaaaaccaatgaatgtttccttggttgagttcacttacaaagtacatggaccatctgttttcccacgataaatctttctcctctctccaatagacggcgtaagtaaaaggaatctgagcaggttcggttgagttgatatcaagtttatagttgtcaaagtttgaactagctccaggacactgataatcactcacggatcttggatatacctcaaacccgacaataactttcttggcgggatctgcagcttcagtgtgccatctgataactatcatgacgtggttgtgtaaataagtgtctccatccttgacgaagccgagaggaaaacctgatgcataatatttggaattggaggaagagctgataaatgttgtggctccaggtaaactatcgactgtccactgtacgacatagccctgtctgatgagttggtcggctctccttaatgcttcgggttgcgttattcgatcgcataaacgtttgcaactctcgtcgatcccaaaatacaaaccgtaattggaatcccatagtcgatctccattaaatacctctcctagagacattgtaacaggtttggcatcgtccatgggaggacaaacaaaaggcaagtcgtagtaggaatagggaagctgagtctcatcagattctattttgttaaccagtaaatggacacgctgcccttgcatgtaacggtgaacctgagagcctttcaacaaactggttatgctaaaacatctgaccaactggatattacagatcagaatccatataagtgatgtcttaacagttaccatagtcaaagcacttggaatatgaaagaatgagtaaacgaatgaatggagtatgttagtgaatgacggtaagtggtgaaagatacttggcgatttgtatctggtacagatttcccgtttagattttgttactagtttttgtatcgcttcacacgacagatctgaaaggggggaaaatgagcgatagtagggatatcttgacagaggaaatgcagtcttgaacagcgcatccgtagctacgtagataaacaggtattgtgggatatgaggataaaggggcttatgttggactctgtctttaccgggaagtgagtcgattttgctggtttttgaataggacttagtggccttataagggaagaatgcagttagtgattgttgaagaatccacagaacaggtttctcgggcacggaggggcctcattgagtagaaatctcgtacagccgcaatttactccatgttggttacgtatttaaagtcttttattcaaatctgaagtgaagtggagagctggagactgaaatcaaaggcaatcacaaatgacttttgctaaagaaaagagcatgtactgtatcgtatcatatgttttgagggtgttccaattatatataacggtgataattgcctgagcttgtactgtttataagattgtcaatatttctcaaacatagtgcctcctcaaacgagtcaacagctatatgagttcctacaaaacagtcaattacttaattgcgttacctttaataacccacaccaatttaatagaaagatcttcttttccatcggttcattataatagtattttttaatcggaaatttgcatcttaaacagcttttttgctttcttgtttatagttgatgcggtggctcaatggtagagctttcgactccagttggaatacagtgcaatcgaagggttgcaggttcaattcctgtccgtgtcaaactttaattttttcattttttgttactccgtgttggacatagtaccaacctctacgttttaagatcaatcaaatcactttagctacatctattagaacttagtatcaagctcgtcctctaactcgtattgatcctgttgtcccacccttctcaggacctcccttttggagctctcttgtaatgtaccgtccaacagtaattcgtctaagatgtgatatgctttctggaaattgaagataatatccagttcgcagacatttccatatgctttgtccatttgttccacgtatctatggataatttcaagtgtcaataactcattatcgtcaacatctatgccagcaatgaaaaataaagaagcataccttctataaacaattttgtgatctatgcaatcctgttagtaaagtttctaaagacacaggcctcaaacgcaaaactcacctttatattccaagacattgcacatctttgcctttctattcagaactatagctgttaattctttaattaattgaagcttttccttctgagaaattacggtataccatttggaaagcctcacttttccctgcttcgaaagcataatcaaatacttgatggccattgtctgtgtactactaatgtgtgggcggcccaagctgaggtagcagagatctaaatacagagagtgcggatatgctacctggaagtaggttgattatgtaatatttgtatcctcatctaaactgtcctgaaactaaatgcccaaaatcaggggttgcttccctgagatttctgtttatctcttataatgtcctgatagaaccttgtacagctataagcgtccatggtaaagtcctgctttggatcacatgagcattttttctctaacctcacttcttcagaaagcgggcaggaaaggtacggtggatgcctatatccaatgtctgaaaaccacttgacatcgttccattgcatgaataaacttactgctatggaatgaatcggagcatccccccatctttcatagtagaaacctcctttgctatccaaatagtcaaagaattcattgtactctcgacctctgaaaaaatccaggtctccaatttcaaaattggaccagaaatgacacaatgtatagtcacccgatagctcatcgtatacaaaatcagataagttatcagtatcctcaagcaatcgtgacacccccttcatttggaggtaatttttcacttctttaaacaatgattcgattgtcttttcaaattccatcattgagatgacaaaaccgtatctcttgccattttgctccattgatttgaacacatcgtagtcaatatcacagtataacttgacatcaggttcaaccctccagaagtatttgtaaccttgaagaagtccatgcttataaaaaaaaccagattgatagcggcacatgtgtctatagcttatgcttttagcataaggaatagggagccccagataatcgcctgttgtgttgtctgagtccattttatccatcgactcgtatactttctgctgatcaatatgatccggaaatctccaatgagaggccggtacttgaccaaattttgcctcaccacttattgcatgggagattacccttttgaactcatcagtgaacgggtagtcattcagaaatacccaatcatacttgaatttactgttaaatctgtcttcatagttctgaactgtctccaacatttgatagagctcttcatttcgacaaagtgtgtagaaggtggcatttgctcgttcatttgatgcgcctatggtgcctatgtgttgagttgtctgtgaatttatgtttgattctgtgttttcaatatttccacttgtctcaagggaccctttttggagtccgctgcccatgaaaccaagttttagtttgagtatttggcggtcccttgcaagaactttcggcatctccaaagagatgaaaagaactgcaactgaagccaaaaatacggacgtaataaagctcaagttaactcgttcaaggcttaatcttgctcgcatcatccctacagcggcacattcaggaactgaatcagatcaaccaacttccgaagcaccctatcccaatttatttatagacctgtatggtctgtattttatgaccttattagttacgtaatcaacttggcgcaatataaccctctggacataggtgccgtcggacattttcagttttattctctggagaagtgcgtggaaaaagtatcaactaacatcttcgaaatatcttcctactgagtttttggtttggattcacccctatgaattctggaagtaacgagaacatgtcataccgctctttgtatatatcaaaaaacttcaacctattcaacaggtgtgttggcctccccattcagtaccgaaatgccgtagctttggataacattagatatgtccaaaccaaagctgctaaagaggacgtgctgaatcgatataaagaaaaacttgagaaaaagatgaaggaagaaggtgcagagtcaattgaaaaacttcaagaaaaatacaaggataaaatagagaaaaccaagatagagttgaacaggatggaccccttgacagatctggaagagtatgaaaggaaagctacaaaaaatggacataaggtcacaaaattaagatctcctagatcgcctgatgcgccaatcaagccttataaagtactggatgatttcctaaagttggagaagatcaaagacctttcgccggatcaggttgaattcttgtggagagccagattccaggagaaggaaaatgtgttggttgctgttattcccaaagacgtttatcaaaaactatacaccaacgctagggagaacccttctttcattttaccactaccaaaggaagacgaaggtgtggaaattcatttcattcaatgggctttcccaggaccaaataccacccactgtatgttcacttcgttggccgagtacaaacttcacaaggaatatgctaagccccataccactttgatgtttcaccatgatatcagcgaagacaaaaacattgttttgatgaatggaacagtggagcaagatgcaaacattacgttacccgaaacccaactcctggtgatgaacttgcagaggttttatggtgccttagctgaatctcctgcatcaaatagaagacttcaacttttgaaagacttcacttccggaaatgaaaatttttcgttagatttggttatccaagaagctcaatccctagagaattagtttgtatgaaaatttaaattagatatatactactattactatttaatcaaggaggaatattaacaggttgaacttttaactattgatcatcctcatcatcatcagcttcttcttcatctctgtaatcttcctcgtcatcagtatcttcttcttcctcatcatcgtcttttgtgctatcgcttgctgcttctcctacgatctcttctgctgattcctgattatctgctacttcttcttcgaccttttcttcgaccttttcttcatcctcttcctcatattcttcttcgaattcttcttcagtctcttcttcagtctcttcctcaacttcttcttcatcatcttcatcatcttcaatctcatttccaagagtttcatcatttagttggacatcatcgacattaatttcctccttatcgtccccttcctgagctttgagagtaagctcttcttgccttctctcttcagcctctctaatttgaaactgcacatttgccttggctctcagaagagataaatattgcccactttcattaactagaacataaagagtatgatcccactcagtcattgcttttagaaagttttccagcttaggtttctttgtgaaaatatcatccctgacatctaaaattttgtctttcaaagcaacgaattcactccattcatcccaagccttgtcactgttacgagatgtttccgttattatctttttggaatattccgtatacgaaatatcaaaatactcttccagaatggtcacaaccttgtctctgattttgactatgtcatcttctagcaaacctttgtagttagagatcactgcctttgcggcatcggtctgtttttcaaccttttctgatagtctctcaagttcgtctcggacatcttgtcttgtaacatacttgtagggtcttacgtcagaatcttcactgttagaggtgtctttaatcctgttgatatcagcaataagcaaatgagttttctcatagtcgctgttgatggtgtgcgaaaggtctcgcaacaatggttttagcttatcgtttaacttagcaataacttcatcttcaagttccttaacagaatcgtcaaactgctgttgggccttgctagaaatgttagttacaaattctttgaattcttctagtggctgcaattccaggcttacggtttcattttcactagttggttcagaatcttcaacggtagtaaaaagggtaacagtctgacgttgagttacaatttcgacatcgtcatcatcaacgtcgacatcgttaatgtccacatattcgatttcatcctcatcatcgtcctcatttggtggcggagactctctgttgattgtatcagagtaggtgtcgtatacaatttcggtctccgtttcaatctcagtctccgtctcagtctcagtctcagtctcaatctcaatctcaatttcagtctcataaacctcagtttcagcatcagttttttcagattctgtcgaaccctcagctgaaggaacgcctgaaacagtcgctgcgtcgaaaaaatttcttcttcccagctcttttaaatctttcaattggaaacttgcattgaagaattcattaaactgggatctcaaaaactctttcttagactctacttgttggttgaaactaatgagtagttcttctctctgaaatgagctaaggaggacgtgcaattttcgaatgacagtcgaaacgtactcccacacgagaactattggtctttccactgtctggtaatactcagtctgcgtaaactcttgaagtttattccaaacaagatccaacttcaataagtgggcaaccacgatcaatcttggtttaacatcaaactgatagacatccttggttttccaccaagtgatagcataccatttgtacactacaggcagaacttcttcatgcagatagtcactggatttatgaaacaattccttagtcttgggaatgattgtagtctttgtataattgtaagattggtggtagagagtgatcgctctgggaatgagaacgtcgttcgcatacaggtcaccttttttcttcagctccacactctttagagcggcaaatctaaaatacgacttagcatggactgagaagattttgaagtaatattttgccttttcagaaaggtgatcgattgtaggtgagagatactgttgatactgagcatctatggcttgagtataaggggagatattcttgttcacaagttgatagtgctcagtgtgctgcaccctctcaacaaaaggggtaacgtattcatatgactgatgagtcaattgacaaaccaaggaatctgaggtggcaactggatctgataatggacaggtggtgttgatgtagtacaccagatacaacagcggtcttaaattgataagttagtaaaatgagcagtaggaaacaaccaatacattcaaaatacttacaagaggacagttaaacccctaaaaccaaacatcttttggttagtttgacagttttggatggtctaaaggagaaaagattcctcgtttcccctagtaatcagtataataaacaaaaacagagcaacgctcataaccgcaccaatcagtgtgatggtggtgagaagagtcgctttttttggtagccagaaagagccctagcactatcatttacttgctataactgtcaagactggaccaattgtatctaagattaccgtgccatcagccattttttcctaggtaccacggctttgaagtgaaaaaaaagaaagggtttggttgttaaagacaaatttataaaaggcctttcagaaccatgcatcattcatccactgaggtatcagctatatggcccttcttcaacaatagctattcgaatgtggctatcaataaaatcctgcaagaaattgagaatgaagaacatgataatgatcaggatgcagggctgactgctgttcaattgttgcaaaccataagggagaacgatgatatccagaaggcaaacgacacccaagaaccaaccaccccgtcaagatccaaagaatcaaaaagtaataaatcttcaaagactaccagctctggccatttaaacaaaagattgttgaacaatttgctgatccaaccgaatttgatcaatgagctaaatgcgggaaagaattcgaagctgatagcctacattacacaagaaaaggtgctgagcactttaatagattattgcttagaaagtttggatttgaagacagactatgttgaggacattgatgatgacaacgaggatgatttcaacgaagatggcagcccagttggacacgatgaggaagagatcacatttcagtacgatgaagacaataatacaggtaaggataacgagaaagctgccccagcagatcaatctgacagctcatctaagagattactaaagagggccacaattgcaatgcatattctttcatccgatcaaactcctgtagtgtataatcagtttttgagttcgcatcaatacggcctcatctccaagatttgggaaggagtgttcaaccgggatattgctgagtatttcattgacaaacggcataacatagtcatgatgaatggtttcatagccatcatagaaaatttggccgagatgaatgtcaatgggctcatgaattttattagatttcaacaaactaaagacagtgatagcttaagcaagcattttgtcaactttatcccatattttccccagttttctgatctcttactgaaactcatttctatggacaaaccttataatcccataggtttgattgaacttcttgttgatcaagacctcataggtcagatattagagaaattgagggtttactatgacgattgcataattcaagacaaccttctgatttttttgaatggtctcgtcaatattagttcaaacgttggatattgggacgaccaacaaaacaatatggaaaacgaaatgaatgacggaaataatggatccaatgaagcaaatataagtgcggttaatggaaacaatactgctaacattggacctaacgatttaaccagagacatggtatcgacttccaaagtcaacacaatgataaatataatcctcaattacggagattatggactggtaacatgtatctcattgtttatcgagattataaggaagaacaactcagattatgatgagtttgactggatcatggctgccaatgacctaacaagcactccgaacagcagggaccctatctatctgggtgtaatgctgaaattatttattatcaatcttcctgctattgtaaataagtaccttactgatgagtactatgaaaggaaacaggagctgaataccttctcgtcggaaggtcaaaggatagattttgatggaaagataagaagaaaaatgattgtttcatctataggaaaagaaattgaacccctaggatatgaaagattcaaaatcatggaattgattgcggaattattgcattgttccaacatgatgcttctgaaccaatcaagcaagttggattatctccttttcaaacgagatgagcttagacgtgcaaatcaaacagagaagctggttcatgacgctttaacagactctattttgaagcctgttgaagacgccattgaagacttaaaaattgcagacgatacaagccttcactcttttgagaccctgaaaaaaatagactcaaagtacattgagtgtacgtacgatttgtctgtcggaaacagttttaaattctcattgttagtctcacaggcgttgccaagaataattttgaagatggataaatttccctggaataactttatgcacaatgttatttttgatcttgtgcaacagatattcaatggaaagctaatcgacgatacggaaggaactaatgatgatgaaaatcaagatggagattccgaagcggaaaaaagcactgagtatgaacaaaatacccatggatttgaagatcctctttgtttcaacaagctattaattgtctctctttttggagaatacgatgcctttgaccaggatttacctcctgatggtagatttgctagacccaaggagattccaggaagtttcaatttgcctgcttatatattatacgcctgtgagaaatcaaaactaagcgaagagcaggcaaatgttaaacttggatatatgggtcaccttgttcttgtggcacaagaggttgtcaaatttcaaagcattattgaaaattttggtatacataaggaacagctgaagacaagaaagttagaaggggaggaaattgcagatgagactgacgatgatgagggagaaacggaagatacagaggaagaagaacagaatacagagaatgggaacacctatgacactgtaataacgaatagtgaacaattttctagcattaagggtgacttaccagatatttataagatatcatctacaaagatttatacaagactgtacaaacagctttgcacttcgttcggagagggaagattccaaaaatggacagattttatcaacaacgagcttagtgtcgtcagagaacaatacaatcaggtactcggaggagtgaatgaaggcgaagttgaaattgatgaggtgcctcgcaaccccaatgctattgttttagacaatggcgactctgaagagttcaggaagccttttgacgaacaggaaagtgaaacagaaactgaagacgaagagagcgaggaagaggaaaacaacgacaatgatagaatacgagaagatgaggaagctattagtgatgataacagctcctacgatagcgacgaataattatatttctttggtgatcataccactctgcaagcaaattttcatctttgatattgagagtgatgttttatttccttctacgtccaccggatttggtagctttataaatggttttaccgttaggtaaagttttggaatcccctgtaggtttttttgtctttctggttttatcatctaaattttccttcttgatctcctttggagatcgtggctttctagcaagctggggtatcagcttgactattaatttacctggaagagtgtcctgccaagatgggagttcaacttcttccggatcaacatggaaggttttatcgttctccacataatgaacggatccgtcgaaacataccaaaaaccatttacgtagatgttcgttatagactttgacgtccttcacttgagtgacatcttgaacaccttgtggccaagccagctgtttgttctcctctatcaacgaactcagtctttttctagattgcacggccgacaatctgatgaagacaaagtgggttaacgtagctaacgcaaaaaggatgaaaattgtgagcaaaacggatggtctaaacttggcataggtgtaatcgttacctttatagactgggaatccatgtttgacaaaataatcgtaacgctctttgctctcggatcttaagatggatcccacagcactcaattgttggtatctttcggtagcctttttcttcaattgctcaaattgttcctgggatagtttcttctgtcttatcttatcggggtgtaacttacgggatagtttcttgtacgcgttgtcgatatcttcaaacgtggacgagggaccttttggaagcttcaaccattcatagaaattaaaattatctccgtattcctggcgtaattcatggttgagctgaaagatttctctgtcaacagcactgaaacagtagacagcagtgatcaaacagagaatcacaaggtgtagtttcatgaatttgggaaagtagattggaagttagacgaaatgaaaatacttttgcgcagtagtcatatgattaaatttcatcaaaacacgaaattgtgtggttacgagtggtgtaccaatagtgagaacttactatatatttaaagagtattggccagttgtggagaggacattcatttcaagtattgagctcattatatattttatcattcaagcgtgcactttagacattccatctaactattatgagaccgtttgtggggacttgatattctggaaggagtacacctaggaatgaaccttagaagcattcctgggaaactatccagcgcgatcttttgctaaatatatcttctttactttaccactaacagcagatcaagaaatgaaagccattggggtcaaatacctccatttcttctatggaatgagtgccatattatgggcatgtgttgtagttagaagtttgcttttacttcctttggttggtcttcgctttttccccggtggagtagcagatttctacctttctatagcgattggaaatgttgtccttgaaaacatcaaccatgttatattttgccgaaagttgaactacatattggctttggagctcatagggaggctctttattgggcttggagttatcttgaattatcctatcatagccaagaatgctgcatttcccacactagttctatcacagggtataatagaattgttcagatacagctacacaagttacaaactaaaattcagaatacccaagtcgttcaactacctatacttggcagttatactggttggatattctgtcaagacgctaagcgagatggttttgatgtttttgagcctgggatatgccgatgacagatttggtacgttcataaaaatagttcttttggtctacattccatctgcctatatgtttttcaagcactcatacgccaggaggggatgatgaaagtaggtggtgatagaattgagttgtacataggtaataaaaatgtggcttaatcgttggaaagtagttgacgggggttgtccaatttatgaacggtaatttagttgacgattcaaaccagcttactatttaacgcagtctagctttagtcaccggcatggttttgttgctggctaacgctaaccttcgagttcatcgttaaattagcgaagcgaatttattagttcactgttcatttcgttttgattcttgattcgatattgaaccctggtttcatcaataaactccgatgctacgaagactcattcgaccaatctggagattgcccagggcaccaaaggtacaatctattcgtcacaactccactttgaacgaggaatacttggatacaaaaaatttgcctatgagatgggagaaaatggagaaagaggctcaggaagaaatcatagatcatttatctgacttgcaagatgaatcatggaaaaagctatcaccagacaacaagagggcctgttattatttggcatacggagagtggggtccaagaaacaaacaaacgatgacagttccggaggtggttttcaagcttataacaagtggtattttgtttattgtcttgggagtgactgcagtgaattacgccatcgacaaagaaaagaaagaacaattagagagcggtagtaatcaatcagctgcccaagtaacctgagttcatgtgacgttgagatactgaaaaatcactcttcatgtccactgtaaatagctaaatctttttgtaaatattaagtcagacagcaacgaaaacctcatcgtatagaggattcagctagctgataatctatcggtttcttgatgtgcatcattctatgagcggttgcctcaaaccgcatccttcgctaatgtttcgttccaccctccagtatgtccggagatgatgacatcggatcctcatcagagtcagaaatagaaggagggctatcacttttatcaaattctagactaatcaaggactccaagccctctcctccagaaacaactccattcaatgatgtagaggtaatctcaaagtactcagatgataaacttatcaaagatctatctaagtatcagtcgaaccaagaaacattgtcctatattgctagcaaagctaaacaaaggcaagatgtatttaacaagcgatctaatctggaagagaaaattaaagctcaagtcaatcctgaagtcttcaaagagaaccctgcatacttggactacctagtaactcactatgaaggaaaacatggtattaacctacaagattttttcttcgtcaccaaccctcagccatttgtcatattaccaattgagggggtaggtaagattcgcagtgatcaacttttgaaccatttagcttatgagacaagggaggaatttattgacacaataggtgcaaagcttgacgacgtacatgatattagccttttccaatgcaagacatttctcaagacgattggttgcaaaactgaattaatagaccaaccttcgtctattacattgactttgaatccacatgtaaagactatacctcagagtctaatagtcaggaaagtgtggtacttaattcaaagggtctccaggtccccatgggatttgacgatacaaaatcttttactctatactgtactctatttcttcatggataaactcattgctgatggttctgagaatacctcgtgcgtcgattggcttaataaatcaatgatctctctaatgcaatggtacccatcagatacacagctgaccacaaatgagtcctttcaggagacaatgtccctattaatctcggccatcaataaaataactactgatgtaaatttgatagcgaggttattattgaacatggataccaggaactcaatatcccgatacatgtgtcacgcactatcaatgcactatctttcagtgccgatagaatatcaatctgtcaactatccgatggaaagaatcaaattggattgtgacccagaatcgattaataaagaaatcctcggacttttagagaagaatttagagaaattttgtcattgcgagcttgaagtgtcgataccaagggataagctggtctataaacagattcaggccagaatgtcaatactctcatcactcataaactattatctcccccatttatcaagaacacagtctcaaaaatttcatgaacatatttcaagcttaagtcaagactattttcatatgcacaaatcacaaattaacccgaccatattcgaaacgatcaattcattgaaagcattggaagacaaacttttcgacaaaatattacaatctaataattaaaacaactcagaacaaactttttccaactctaagatgtctctgatgatgacagtatttgccttatgcgtctcgtctaatttttccatgtcatcatcggtttcaacgtagtgaatcacttttgcaaaccctaactctcgggcagccttgacattgagagcactatcatcaacaaaatacgcattcttagtagacttgcaaccggccgctagtaacgctttgtcgaatattggtttcattggtttgcacagaatggggatcttatcatattcacaatacgttagaccgtcaaataaatcacccaaacccaatagataaataactcgtaatgcatgattcttgtaggcattagtaaacaaccaaagtctgtcgactttgccacttttcttcaagcgtaaaatcatttctcgtaaacgtctattgggtcgcaaaatcttctccaatggaagcgaatcatcaactttgctattgtattccatggcatcaatattgttgtgacgaactagcccctccatactcagtccatattgctggtagtacttgtgatgtaagtcccatgcttctttatcattaatctgtaaagtgtccttgaagtagcgatgtatgtaaatctgcatcagatcatgaatcttgctagatcgtttgtaaaggcaattgtcaatatcaaaaaagaacaccttgccgtcatctaatgggaccggcccgacaccataagtcaaatgaacgttaggcaaagacgactccagagggatattgacctgggatgagcttctatccagtacttcttgttctgatatgacatcttctatgaaattcgattctaaatgaggatcctgtaactctggaagtgataatgacatcttgatagttgtataagtagaaaaagaaagtactaacccagttcggttaactgtcagttcccatccttaacttcgcgaaaaatggaggagagtttgttaaagttaattaatccggggatcttagacggaaaaggttatctttttgcccgtttgaatcttttggtcgattgagaaaaatccacgtggatgcgcctgtcatcaattattacgttatccatcttgcggtaggcctcttcgcaactttcaacatcggcaaattcaataaagccatacgttttggacttgccggtgctcctatccttgacaatttctgaacctgttatttttccgaatcggctgaacacaacacctagatcctccgctgtggtgattggattgagtttgcatacaaaaagaactttttcactgggttggatattggcatgtaccagatctcccatcacttctaacgccagctgacgagacgccgtttcggaagttaattctgagatcgtgttcagctggtcaatatccagcagtaagggagctgataccgaaggcaccgatatttctggaaaaggattgtgaagtacgtacgatctgaaaatacgaatgtctgtaatcggttcgttctttgtattggcatcacaggaattaatctcctgaaggacggagaaaccctccgttacgtatccaatttcaacaacatttgatctggtcccttcgtttgtcaagctaatggttatcaaagaatcaatcgaaggctcatcattcgcatcattcacattgaatagaaccaaccccacggaattttcgatatcctgagggtcagcattaaccacactagagcattttcctttatggcccttttcctttagtagatcttgatagctggttcttctgtcttggttgggataatagggaagacctgtggagacagagtcgtttgtgatcctgttgtgaaaggagactagatcgtaatactttaacaagttcaaatatataaagttcttcacatagtcgtctttgccagaacagtcaatggtgatatccccaaggctagtttgccagagtacactcattcaacaacttcaagagtaactctactagggaaacttcttctctgcgcgcgagacagcttacaatcttgaataataagcttacataataagttatatctcaccatagtagtgtagataagctgccatagttttggcaccttcaatgtagttctttacatcaatcttctcattgatagaatgagctccatcatcacctttacccaaaggcaatagcaatacattggtcttgagctgttgttcaaaggttaaagtgattggaattgaacctccctctctagtcagatcaggctcaactccccatacgaccttggtggccttcttagcagcggtgaaagagtcgttgaatggatcacttttccaataagcaccatcgtgaattaactcaactttgtaagaatttggagtccccaattctttaaacttggcattgacataatcaaagacatactgatccatcttcttactgtcgatatctggaactgttctaatggaaaactttccaatgaccttagcagggatgacagtcttggcccctccaccggaaaatgccccttctattccatgtaaggacaaagatggatatctccatctatgcataagaatgtcgttcttactttggtagatagcggtattagatccggaagcagcattcaactcatttacgtcaaattctatatcatcgtacagtttctcctcagtttcagttacaggagcaaccatttcatcaattcctggaattaagatttttcctttgacatctactaattgcgacatgaccctaatcaaatccgtcataggctcgtgaatcacaccaccaaagatcccagaatgtagatccgcaccgggtcccgaaacaataatctggtaatagttgcatcctctcaaaccataagtcaacacgggtttcttggtacccaaccagtaattgtcagagatacagcatgtgtcaacacctttgaagtatttatcagcttccctaccaacaagttcctctaaacctagcgagccactctcctccataccttcaaaacagaatataatgttgacaggcaattccaatgaaagttctttgtgcgcttgcagtacgttcaaccaagcgataacaggtcctttatcgtcagtagatcctcttccatacaatttgtcgttaacttcaactaatttgaaggggtaagtatcccaaccatcgtctttaagagcaggttgaacgtcataatgtccgtagatcatgatcgtcttcttggtttcatccttaccaaccctggccaggacgatgggtggcaattccagattctcatcagttacaggaggaggctgtttcccaaggggtttgacctgaatgtcataggctcctagagattccaattccttaacaagaaattctgacatcttaaaaacctcttttctcagtgattcatcaccagagacggatgggatagccacagcattggccaatctctcgatgaaaactggttttaattcgtccactttggagaacacagattgaagtttcttttcaattgacatggtagagtatgatctaaatatggaaggaggtattttcttgtagttgattgtggagagaagcctcgtaaagttcataaaatgagagaggaaggtcttgtgagactgccacaagagaggcacggttcggcgagcattcctgtggagactttgggcgcggggggagaacctagggggaatgcacattgggcggataattacattactatctttataaatcaagcagaatcttcatccttgtggctacttctttgaagtctccgtttgttgcccaaaagacctcccggctcgcccgagcctccctttctggatcgtcctaggttggcaaacaacgactgggtatcggttttggccgcagctttatagttattttttctatccttgaaattcctaccactggaattgtggttgctggaaaatggaccgtgtgaattatgattggatctattccaatgcctattttgatgaggagctttatagacggcattataatcattctggaagttttggacaaagaatctcttgctagagtggtgaaatctataatcaaaggcaagctctgaaacattggccaaactttcaattttatgatcttctagaggatcagccccctctaatatcaagtcgcattccttgatcacggaaattgctggtgcaagaattttgttcactgtatttaaacgtggagtgaagtttgcatccgcgttaagtttcccatctggttccgcttccttctctccatcctggtcaggctcggtttcatcctgaggttcattcgttggcttctgcgacgatattgagttcttattccaaatgtatatcatcacctcattctttcttacactcagggtaatgccacaaatgtcgtcttgaaactcttcaaagtcagcatctgaatagtttgagaaataggtacctccacaaagtctcaatatcaatcgttcccagatcaaagaaaatctctccatggttgaggcatcgcattgagctctcctataacgggacttgattaaccatcttccaccagccttattagcaggatcctcccaaactggcttgattccacttttaaacaaaaagagctctgtgccaactggaaggtcagatactttcctcaaattgctcaatgattgccacaactgttcgcatgagtcaatattggtagtagtagtagcaccgccattcgccactgatggaaactctacttgtttaacggtctgtaaatattggtcaagtgtgttttgccagtcatttctggaagcctccgaacttgtctctttattttcctgttcagaaggctcagctacactaccagatgtagttacgttttcggtctccttgcccctcacatgatgccaaaaagtccaagagtattgcattggatgaggagcggcaacttgtttcgtcgtccgagatccattgatatcctcaaagaacttggacattgcagttttgggaaacctggagaaatatgttcgaagcttggtgtcggatggacgattttcaagttggagcgcgcatgcagagaaaggtcaatgctagtagcgctaggtatgccatttgttcgccttgtaggatcaaagagttgagagttggagccgggtaatactgaccattaattccattaattcatacctatatcgtttatataccaaacttaagccagtctagatcttccgcaatgtttctattgttcggggttggacctgcagtgccagggtctttggaatttcgtctgggaccgcatgttttgtcctctgggaagccctcctgtttgacatcaaaaccagtaacaacgtgctgagtttgaagactaagactggaaggacgtctggcagtctctggaaatctctgctgaaacgagtttttcagaataggggaagatggtataccgcgcttcatttggaattcttggtgcaaagagctggagatggagttggagaacccatgcccatagtcgttgctgggagatataatacctaggtctgagttaattggcgaggcagcgttcgtaaaatacgaagcaacagccactggttgctgtgaagtaaaactggaaacagaggaaggtgatgccggtatagatactccaggattattacctgaaagactgatttgtgactttctgcgcttgaatcctgctgaatgcggggagaacgaagtatagggagagtcttgttgttgtggcatcatgggaacgggaatgtttttattgctgggacccctggaaggcttgggcaaaatgggaacattcttatgcttttgagcgttgctgttgagactgttgcctctcattagataataggaatcttgtgaacctccgtagggagaaaatgatacggctgttgttggaagagaattattataggggtaaggataaggctgttgctgttgttgttgtatttgcttttgagtttgagtgctatgagaaggttgaatatgttcatgttgttgtggctggaattgaacttgttgttgttgctgttgcatcttgcagagcccgtgtgttaaagaagattgatgttgttgtctcttggaatttcgtttcctaatgacgtccgttttcaaagacaatggcctcacagtaccatgaagtttttggaaaagaccacaagcattgcacaacgtattgccacttccatctcttctccaaagaggagtcttttcagtcttacaatttgagcattgagttcttgttatactttcgtcattgtcagctttgggggatgatgagtcactcatatctttctgaacagtcactgttgttgtgatactagtagtctcggaagtaggtttcgctaactgtagtttatgagaagctccgtcactcaagaattcttgcaaagacttgtcttggataatatcactaaaatctcctcccataccatcttcctcaccatcatcattgctatcgaacttccacatcgagtttagatccaaattgttggagtcatgcaagggactatcattcatagatgagggcgtaaccatcattgaaggttttggttttcgaagttcggatttaaccttggaatctgagtaactagacggagccccagaattattttccaacgaatctggagaataatacaggccaggagcacttgaaataatctccgtcaaatcagcagagtcatctagttgcaattcggaaaaatgtagtttgccagaaaggctgtcttgttttgtcatctgggttttcttggattcatttcttaatgttctgttttcaactcgggggtataaatctagtagctttttagccgaagaatataccccccatatggacggcgaatcttcaagatccttcaaagatcctgtattatttcttctgtttccttccatctaaatgaggccttagggcatataattagagaaaggacaggaccagttgagcttcaatgctagggtggtgtaaagtaaaaattttgaccctcagggatctccaagtcatgttaggagaagtgtttttttggaacagacacgaccggggtatttgtgggccaagactaagcaaacggcaaacgaaatgtgggtttgaaatggagaagcgctgcttgaaatgagcagccgtagaaggttggatggcactacatgtatgaactagaaggcgttgaattttctagatgtacagagggagatcttgattgcatgcgaagcatcgtcgtcaggctccccttttatttattttcccaccgttttttgtcccctttctcgctaaatctcttccctctcgacagcacatgaagttactatccttggcacttctggtgtctttggtgtctgcggatactttctacactccaaaggatgatgtaatccagttgaatgcttataatttcaaggatgtcgttttcaactcaaactactcttcggttgtggaattttatgctccttggtgtggccattgtcagaacttgaaaaatcccttcaagaaggcagcagccgtttccaaagactaccttcaggtggccgcaattgactgcgatgctgccgaaaacaagaagctttgctctgattaccgtattcaaggatttcctacgatcatggttttcagaccccccaagtttgatcccacatcaagcaccaatagaagatctggtgctcatgctaatgaggtatacagtggtgctagagatactaagtcaattgttgagtttggagtgtctcgtataaagaactacgtcaagcgagtgtcacccaataatattaaccaaaccctgggaaattctgagaagacccagcttctacttgtgacagataaggccaaacctagtgctctgataaagtcaattgccttagactttttgaatgacatagagtctttttactatcctttcaacgacaaaacgaagaaagcattgactacacgattagaggagtatcaacaatcgttttctggagagagcataacttcgccttcgattttggtgctacatgaaaatgaaatccacatttttgatgggaaactggataagctgagcattagcaagtttttagccgagttttcaactcccctggaaggacctctcagtaagagaggtaagtttctagagcacattcgcaggggaattaaacccggaagaaaagcgaagaagggcaagaagggcaagcaaaccaaaaatcacgacgaattatagatacatacgaagtttttttatttttttttttgcttctttcattcatatatttacaagttgaatatttttacacaattgtagaagtcaccctaaccctggatggattcttccaactgaagttttctggaatggcgatcaaacaggttgctaagctcgttgaagttcaacgatgttgggttgacatctaacgtctttttgtctttgtaggtcacctcaatgataggttttttgtttgactggctgttcaagacttcgtagtttattgtgcatgatttcttcaaggaactgggcaaagctgcaagaaaaagtcttgcgcctttagcttctggaccaaaagggttgaatttgaccgatactttggtaaagtacttggtaatcatggagatgcttctgcaagaattgggtcgtgatgagagagggtggattttttcgaagagtatccgatattgagtttcgcccactaccatgatatatttttttttctgacttacctccctctaaataagaatcacttcacccatagatatctacatgaaggctcagaaattttccaaggcttcgttactggatgatgaggatgactactcaactcagcttgacagaattcttgctcggaggaagaagagtcagaaggaagactctggagatctagatacgatttcttttggctccttatcaaaagctcaagcaagattacaaactgaggagagagaatccaagaagaaggtaaaaaaagtcaagaaaccgaaagtattgaagaaacaggaagaagattttcaacctcccagtgacatttctgatgacggtgagttttttgaagagccatctcaagaccatcaaagtcgaacttcagataggcattccaaggaggaacctagatctaaaagtaagcacgcaccctcagagtctagtgctaagaagagagtgtcaaaggtgagggagattcctggactcttgaacggttctggctcaagttcattgtaccaggatgtcagattcgatacagcgtttggtaaagcagatctccaaaaggctagagaaaactacaaattcttagacgaatatagggagaaagagattactgagctgaataaaattctacaagacgatatgaccgagcagctattaagtgaacgagagatcaatacaatcaagtataagattcaatctctcaagtccagagtagacacattgaagaacagagacctggaaaacgaaattgtgagagactacaaaaggaatcataagaatttcttcttgaaaaacagtgacaaaagaaagttagttcaaaaagccaagttcgattcgatgaagccaagccaaagagaaaaggttatcgaaagaaaaagaaagagacaactgggtagggagttcaagcagttagagtttaaccagaaatgacactgactcaaaactaaatgttatgtataaccccatgtatattattttaaaaatgcctaatgctccaaaatagtaaggttacctgtaacaacaacattttcaagaattgatccgttagggatgtcaattctttgaccgtcagaacacacgataatgacagttccttttagctggactcctttaccaaactgaacattaccggtaaccgtaaggtgatccaattccaagattttaggcatatggggaatccgatcctggaactccttgaccttcttaaagtgagaacccaacttaataagtggagcagccccaaaacgggcaggatctatttttagtgaaccatgttcaagatagaacaggtcagatttgactagcagtagatctgaacatgttttaactggcaagaaacgagatcttgataccaccacaccgtgtgcattgcggaaatgtctgatagcggcaccaacagcagtctccaattgcacaacgttaacctcctgagagccaacgcggatagtcttgttgtttggaattatttccactttgattgaatcggattctaccagacgcttgatagccttcaaattgatccacaagttattggtattgaagttagtaaatttcttgatagatttaaactcttcaacatgctcttttggaacttgggcaatctccaatagacggacttgaccatcgtacgagatcaaagtaccacccttaacatcagccctagttttatccgtaagctccataatgtattcagcacctgtttcaatcatatggttcaaaatcttggtgtccacagttgctcctaagttatcaccgttggagacaaataagatttccttaccttgctgcaatagtacatctaactcacctgaagctaccagagattcaaagagatcaccgtgacctggaggataccaggcttccaaagaatcatcataagactgtggaacaggaagcagtgaatctttgaaaatacgtggatatcgagattggttgaatgtgcggatacgaatacgatgaccctggtacttctggatcaaatgatgagtgtcatcatccgtgttgaaagagttcatcaatagcaatggaacatcggtgtcgaaagttctgttgaggtattcaatctgacgaacggaaaggtccaggaaggattgtccctcacgaacttcgataacggatttcggtccaacacaacccattgaggttcccagaccaccattcaacttgagcacggcaagcttggacaagttgtcagtgttttcaacgctcttaagatcttggtacttaacgacttcctctttggtgggggagttgattttgtcccagtccaaagtagaaccggaggccttgtcagctaagtagcgacgaaacaacccgaagaaagtgtccatctcattttcgaaacgctcccttgtgtgctcatcggctgcatgcacagagtcgaccaaggtgttgagaacgtttctcatttgagaggcagcaatgcttgttgtggtgttgtcgaaagcataggcggactgagtcttgacgtgtttcttaggagattgataggcgctcatgacgactctatagtggagattgaatatggagtggtgcagagaaccggaagtgtacaatagcaagtattctagagcagcaaatgtatttacttaagtaacatgatctctgtgtgagcgaacacgactctggtggggtaagggctccaaacttaacgtgagatttgacagagggaaaagtccagaatttttgccgtaagagcctcgctgtgaccggctgctgcagggcgttcccattgcctgtaaggagagctcatacttgctggtttacggggatattggggttagttaagtggagagatctgcacgattggagcatggacggcagaagtccatgataaatgtccttcggagtataaaaagaacttaaggtttttggtagcccaggagaccgtgccgggcaggaaacaaagaagatcttaccaatgcggcaggtaccctacaaggtacagaatgttgcaacaggatgttagatggatgcgcgaaatgcaagtatatatttttttttatttccctttttctttggccttagactgaaagattaagtagtatggccaaggataagaaggatgaaaagccagataaagaaggagttaaggtgcagaagcagctgagtagtagtgaagaagacgactcagttgagagagctgaggtgaaaaaagaaaagaaggaaaagaaggaaaagaagagaagtagagagtcaaaagagttagaggagctggaaatcaacctggatgatgctgctcctttgtccaagaaacagaaaagaatggcaaagaaggaaaagtcattagaaggtaaaccaaaaaaagaatctgataaaccagcctcaaagtcagttaatggcgtttggatcggtaaccttacatttgacaccactagagatgagttgagatcatttttgatcgcaaacaccgaacatttagatatgaaaattacccctgaaaacatcactagaattaatcttcccaagaagggacccaaaattagaggctttgcatatgtggactttgacaaaccagaattggtcccagtttgtatatcactatctgaacagtcattgaacggcagaaacctgctgattaaggacgccaattcttttgaaggaagacctgaaaaaagtaagcaacaacaaactggtggagatagtggaaagaacaagaaccctccctcaagaattctttttgttggtaacctatctttcgacactactaaggaggacttggaggagcatttccagcactgcggtaatattgttaaaataaggatggcaacgtttgaggattcagggaaatgtaaaggatttgcatttattgattttctagatgtggaaggagcaaccaatgctctgaatgataaactatgcaagcgaatggttggaaggccgttgagaatggaatatggtgaagacaggtctaagagaagcccagcgttcaggaaaccggttgaagagggagagattgatgattctggaaatgttatcggctctgccatcgaaaagcccaaaaagaagaccttttcagactttgacgaccctgaagaacagaaccaccaaaggtccgcacctcaaaaatcatttgcatccaagccaagatacaataccaatgagccccagggaagagtcaaatcttcagtagttcttgccaacgccccccgtcaaagtgctgcaatcgttccgtctcaaggaaagaaggtcaaatttgactaaatccgaatatgtactactccaggtttgtatttcgctaaacctcgcactcactataaatagtatacaccaaaaatccctttttcgataaagtaaaaaaaaattacgaagactcacatttgtaagagaacgttcacttccggcctaaacttgaaacacatcgaaataatacattcaaacccgaatatatgtctcagctgaaaccatccaatcatgtgcgaagatatttgtaaaaagaaagataactattttgttaaaaggtatgctattaccaacgatacagtgaccactccgctatcctcaaacaacacagatattaccgtaactgagagcaccacaatcatgccagtgtcttcagcccaatactcccttttatccgcatcaacgagcagttatcagacgtcaagcatggtgacacctacagcgacatcgcaagacgagtcatttcttgtagcgcagtacacccaggattacgttgttacagcagaagagaccactttcacagtaggaataagaatgacaaccacagtgctcggttctcagaccgtaactgcggaaccgaaaacgaccgatttgccttacttcaaatccgtgttgtccagtcaattagaatcacagggcatggaccctgactcttattatcgggtctcaaaaggtagttccttcggaaggggccagattgtaggggtctccataggtagtttttttggtgtccttttggtactactggcccttttcttgctatatcgaaggcggaaaaagaagattcatttgttcccacttccagatttcgaaaaaggatatgttccaccaagtctacccaacgaaaactctcccatagttccaaacagaggatccaagccctttttattttctgaagaatcaactgtacctgagacgacggaggagagagaggtctctaccaccggcaaccaggacgatgagttgggtggactaagatttgggattctggcaaaccaggacatgtcaaatagtccacccttgtcaccgaaagcaacccaagaaggatcccgccattatttggggtctcctgttcctgaaagtttaaacgcttctgtggacaggaccattaacgttgtctttgaagaaggttcaagtcttgaagaggaacctgtgctcagtgagaagggacaaaacaccatagataagcaaattcgaactccttctcgctatgcaaacgttggattagacagagaaaggctcaagtccatgtcttcaccacctccggtcccgagaccacgtaagaatatacatttaggccaagagagcaaccaagacgacaatgaccaagaagttcacgatactttacagtttaacacccgacgggtgctagaagaagaagagcttagcatcggatcatttgagagctctttgctcagtctcagcgattcacagagtgattgattgagttgcatttcatagttcatttcccctttcctttccatcatcatgcacttctatcatccttactacacctacctaaccttttgtattgtattgtattaaattatattccgaatacaccccataagatttaaaaaaatgaatgtagaaactttttccagcattgcattctgagcccaccaaataaataatcaccttcctgcggatacttcctccaagagttccagctctatgacaaactttccaactttgtaattctccttacgagaatcgctttctaaatatttccatccaagacaactccgacactgcttacagtatacgttggttaccaagtactctccagtcagcataattttagtagatggcttctcatccagctctacattaagaaggtgggagaccaaataagctttgccatgcttcccatgaaagttatcgctgataatcaatggcatttggcagacttgtgtatagcactggttacagagcaacagattcgaatccctagagaggctataaggagaatcgttcgatacgaggggtagtttctcgtctacgattgtttccgtgattgtggagtcgtcatctctaaagttggttaaagcagtggagaagcttgaccttgagaaaagtgtgttatctgaggatcggcgactattgcttcccgctccccatgaatctctcctatcaacggtagcttcggggactttagggagggtaggctcatctttgaagtattgaagatacactagtcccatttcttacagtcggaattgaaagaaaaagacagtgtaattctgaggttcgcttggtgtggcttggtcttgttttgttctgaaatgttgccctggtattctcttccgttttatcttttatgaaggtgagtgagtaatggtatcacaccctaactgtggggggcagtcgagcataaggtagtgtggttgtgccagttcagagatagcagatgagactagacccgatcagtcgcgcaccaaccaatatgggattgtagtactgtcgcgaccacagcggtccatgaatctttttctctaggatcgctcatcagaaaggtcagaactaccttgcaatattctatgttggctggatctctttcaaggttgacgagtcttggctccagaaggtttttcggagtatcttctatagcaaggcaatctttgtttggtgaggtgaccagcttggaacatccgaaggaaaccttggaaccaccaaaaaacgaaaacgacgctagcaaaaccgttgccccaacagatggtaaggctgatttgaggggaaatgctatccagtatattgacccatcaaaagatgagaagctgcaagaatttttgaaatcgaagccaattcgaagcgtggatgaactgttatcacccttaaaacgtgaattatatctggccaatgttaaacagaatggttttttcaagaacaggcaacaaattgaactgaatggcagtacatacatggtgaaattgacacccgaagaggttaaggcgttagaacccagtgtttatttagagtcttacagaataaaatcgactcccaaaaaggctaacattgtgctccgtgctcttaaaggacttagattaaaagaagccattacccagcttcatttcatgcgtaagaagattgccacagatctttatattttactagaaagaggtttaaaagatgctgaaactttaggatataacccagaagaactgtacatctctgaggcctgggtaggctcagattcacataagtcgaagagagtggaatgtaaaggaaggggtagaactggtattattacccatcgtcatgtcaacgtcaaattcgtgctacgttctgaccaaacgttgcgtagaattacatgggaaaaatcccaacagccaaagaacaacaaaattccagggtccgtgattgatcagaagatcagatcaaaaccttctggattctacaaatggtaattttatcaaatatgctgtaaatagagaataaatataaataaaagggaatacctgttctaatcttaatcgtcgtaacccgtcagtgtcttgtctcttgatctatttggaagtgggtaaccattggcaggcaaaggttcatgatcatcgtacaaaaactttcttctaagaggggtggccatcatgaaaacagggcctagcgcagcaacagcaatagcgtaaaagacatggggacgagtgtgagcatgataactcagccactttgaaaatccgagttagttggagtttaaaatgaagtacttggtaaacagaattaacgacttactctaatgggctgcttataatacactggatagtcaccaatagccatttcggacaatatgatagatgtgtagtttgatgtgacttggaatgggattcgatcgctattggtggataaaaaaactatgtggaaatatattgggaagagtacacgacttaagctaaataaacatagataatacaataatgaataaggttaacagttaagcctttctcttctgagcggtagtagcagttgatttagatccagaagtggagcttttcttactcttagatttgtacgaatctggctttgcttcagattcttctgctgccttatcttcagttttttcgctttccttctccagtttggcctcttttgcagcctcctccttcaaatacttctccttgagtaccctgtctgcgtgtactgcgtaccacaaaccaaattgtaaaagcagaataccgataaggacgaaaactagaagcccagtagaggcagcaatgacgttgattcctgtctgttcgtccacgtcgccccattcacccttctcagcactcaagatacccaaacgaatattggtcaaatacatgactgtggccactacaaatagaaccaaagttccgtattcgaacaatgattgatctgggtctggcttgaagatcttgataaaacaaccaatgtaaccgagaccaataactccatgtaaagtccagtgtacgaaacgtggaaccttggaccacagaaggagatggtccaatgactgtttgaatgcctcatcccctccgtcagagtatagagtgaaataatcaaaaggccagttggaataggcaagacccaagcaaaatgatgcggctgaagagcaattgttagtactagatcaatagtttgttgaaagcagggaaatcacttacatgtcacaataagaccagttcccagaggaagcaattcttggtagctgatcatgatgttgtgctactttgataaatgaaactagagagggaaatgccgtgtggctgtttgcagacagtggaggaaaataatgtgcgcgaactaatgtctgacgagtccagggctatcttaaggatgattataaagatacagttatttcgtttatcctacagaattaaacagtttaagcagtagcttgctcctcagcctcctcagcctcaacgactggctcagcaacataagacttgacgaaaggagctggaacctctctctcatcctttggttcgtggatcttgacaaagtcaggaagggccttaggaccggttctggcagcagcagggtctctcatgatcttgaccttgatacccaaaacaccctgtctcaacagaacgtgtctggtggcagtctcaatgaaatccttggctggttgaccggagtggatcatgaaaccatcagcgaacttcatagacttggctctggcagctcttagcttaccggaaacgacaacctcaacacccttggcaccagagtccatgacgaatctgacgacaccgtaagcggctcttctgatggccagaccgttcaacagcttgtatctcaaagactcacattgggtaacagcggacaaaccacggtcttggactctctcagcgtagaggataaccttaccctcatcgatcttgaatctcttttggaccaaagcagtcaattctctgattcttctaccgttctcacccaagacagagttggtctgggtagctctgatgatgatctcagtagtggttggggtgactctgacttcgacaccggagtatccgtcctcagcgagttctctagtgaagtactcgttcaattcagcgtagaagacaccgtcagctacgagctttcttttcttggagatcaaaacttctggcatatttgtggatgttgttggttaatggggagaagaaactaattagtgaacgttagaggtttttttttcaccaggagagagaatatttttcaggaggtccacgaccacgcaaaaaaagagtctttgaataatacacgacttatttgacttcgcgcaaattgaatagtcaactcttgattcaagattacgtaacataaacaatatgcgacgcactccactgcattggagagctcagatgttttgtatggaagaaagttcatccctgctttgacgtctttgagcgcaacatctttgctaaacacatcgccatacactatatgggccttgcattcttatccgatagtggcaacagtagatgggagagcatctccgaaatctaattcgacatcaagttaaatatacttactagtatacatcacaaccatcttctggtcatttgagattctaaaactcatcatgttcagtgctaattttcttggcgctggcagaaacttcgtctataacctgctgtacttcattatcgtactgaatccattctggaattcttcttgctatgtccagctttggttctttggttaaaggattattgcaaaagtttatcgtttttgcatctttcaaaccctcatcactacaccaagtttcacaccagagccattcttgagggagtgaaaaaatttttaatttgggacttggcattgaagattattaggcagatcatctatttccaacttacactttgaatctcgagagaggtggtaaagttgccttaaataaaaaccagcacctatgttcctaaaagtcttcaagtcaatcacatacagaccactgctgtgatacttaaacgtatcacctaagtcctttagccagcatccctgcttccaaaatttaaactctgtcatctcttccctgccatcacacattggtacatacccgtaaggcgcaccttcaaggtccaaattcacaagttcttttaaatcagttctcactatctgatccgcgtcaacaaccaccactttatcaaggctttgagggagaaaaacatccaaaaaaagaatcttgtatctcaaaatagctcgctgtctcttcctttgaccttctaaaaatgctggccatttatagttgatcagttcatactcaaagccaaacctttgggaaagaaaaggtaaattctctttaaacgcaggtgacatgtagttttcaattagccaaaacttgacggtatgttctgtgtgtttcattactgagtttgccattattgacaaaaaccgctcatcgaggtgcccactggtaactgtgaaaatattgataccagcgttctttgattcttcttggttattccatgaaatccaacgtcccctggaactttcttttttagtggtcgttgtattgccaattagagaagcgttcttttggccaggagttctgtcaaaaagaggttcaataaaatttccattcaaatttaaaacagggatgatagcagtttcattcaaaaccgtgtactgaattctgttatagttagatttacccacaaatttaaccaattgaaggacttctgctccggcagcgttcatagaaaatttccacaatcctggatttgcttgcagttggaagtatccatagtcaggcataacagttgtttccgaatgtcccctaagtacagcgtgaaaaacgttaaaacccgtaatttgatcttgttttgttgttgcataagaatacccttcaacaagaagtgatttcagttcataaacacccctcgcttcacctgaatattccagtagcacattatccaaatcggtaacagcttccttgattacgacaacccaccggttaggaacgtctaagtctacagtaaacaaatttttttcaggtaccaaagcaaagagagctttatcctcattatccagagcgaatccagcggaactaaatttgacagaattaggaaacactccacgataaaaccttttaacgtctaactcattagctttttgtggatttaatatgaccttaattctcaccctgttcaactcttcaaataacgaaagcaacgacacaagcttctgagactcttcttgaagtggatctataaacaatgtcacctccatggtggaaccttcagcattagattttgccatttcaatggagaatgtatcgttaagaaggttagtattgtatcgtggaaatagtttctgatctggctgataaccgtcactaaaatagtaagtcttggaaacgctcatagtgaaatactcaaacaactcaaacctatccaagactatgggtgtagaaatgttatgttcagatagtagctgataagtagtttgaagttttgaatccgtttcggatcgaaccagttgttttaaacgagtatccgacagtatcccatcaatcttgatagctctaccgttaagaatcaagtaaggatctccagccttggaaatatccagattgaaagtttttagaacaaaatctttcgcctcttcaggacattcgggatatttgccgtcacgtctgtcgaaacgtctggcaccaataaggataatcaaatctgccaaagatttgtccatttccgcttgcagccacgagctaaactcaggattcaaagatgtatcatagactctaatcttgacagggttcagatcagaggctaccgacatcaagtaacgcaactgggatagaaacactaagtcccaagagtttcctattaaccatattgtaattggaattgaatccggttggtcatctataactaaggtggcaattgatatttcgttttgttctataatcttgaaaacttccaagctatcaaaaggcgcaaaaaatggaatatcagccttcatagaatccggaaatccatagagaggctctttcttattcaatgcactgaatatagggttcctataagtctgagaaccattataaagaaagtcttgcgctctcatatcggcagaaagtgcaccatttgatatcgctttacctagatccaatatatccttaaaaagctcttgagcaagatgaatcttattggtaggattattccaccagtcttttccgaagtcaaaaaatttgccatttgcaataactactggatgagtgattgaaaagccatcgatgaaatcgtcaacttttggacctaaatctgtgtaacaaatgtcatacaaacatcctagatcaagcacactaagtcgaccctcctcatcattctttagaacagttgtagcaacatgacgcaaaaaagcgatcacctcatgtattccctgagtctcaacaacatgaaggaagttctcatcaacactgtaatcagaagtaaatggaacaagacctattcttagtggtcgactctctgacattgaataaaaaaatgttagcaatattttaacctgatcacgatcttctaggtctataacaaacaccaattcatgaatattctctcttacaggggggaactctcctgtagaaagcggttgcctcgtgtaaggttctctagagcttgaaagattggaatacagaggatcagtttcgatatcatttaagtagataatagcatctgcatgaactctaatatcaaacctcttcaactcagtattgttaactgatctatcagggacatgagcggcaaaactcttcatgatatcctgagcatgaacttttgcaaccccgaatcttgttaaatcatcaacgaatgcatattctcttttcaaaatgtttaagatatccatataatttaagtttgactgcgcaactacagctccgttaatatacagaccttgagggatgtggtcaaatgaattctcccatccatccacgatactttctgtagcgtcagtatctgttacttgacgattaatgaaagatgcatactttggaagatcttgaatcagtttaataagaatcgacaacttctcactctcggacacttcaaggttcttgacatagtgcgtaagcttgtaacccaataaactaatgtctttcttagatactgtctcaatctccttggaatatacatcccaaaaatcattggattcggcaacagttggttttgcctctactggcttgttagcaactacgtctctgtcgtcgatatcgatatactcagtgttctttagggttagatcaacaccatacccagctaaagtttctttttgccaaatcgattcgtcgggaatataccgccagactagtctcagtctaccatcttttatgaaccccgccaagttggaaagaaactgcgaaaacagcggacttttgtagtccccatagataattgcaacaggaacatcattgtctttagcaccaataactctgtcgaatggcaatatttgccgttgtcctgtttcgttgccagttttcagtgaaaagacatcattggaactgcagtacacttcgttattgaaatagagccaagccttagaatttgttccacaccgatcacctaaaattgacgatcggacttcctcgtagtgctggtagtgtgcttgaacccttggggcatagtatttgtttgcgagatatacatcagttatcgacttttcagccgttgctccagccttttgagaccatgcttcatacagttctttatcggatttggcaaacggaatggcatcaaactgtagatctgcatcctcgaattccagtgactgaaatgagacgtgaaacatggcgtccagaattgtatggaaacccgattcattctcgcttgcaaccgtctcaagcagtaacaatgggaaaggggttttgaaccagttggccctcaagctgatatcaacactcttttctgacgcaacagcagtcagacattgagatatcaagattaaggcatgaccaatcattctctctaggttgttgatattgtaggggatgacaaaataggttgtgtatcgcggccagttttagtctgtttttcaaaacaaataataaacttgacaagtctcccagttatagggcaattaatgaaattattaccatacaaaatagtgtttaaaagttgaatttggggtatttaaaatctatggattaattaaattacaatcccaaaacagcagcaccagcaacaagagcggcaccaacgacgtaagaaccaccggtcaaaccagcagcggcacccttggagatggtggaaacggtgtggttagaaatgttctgactgtgggtgtaagtcttgtgagctggacagtcggtgacggtctcggcacagtcagtgtcagtggaggtggtagtagaaacctccttgacggtggcgacaacagtctcagcagagacagcagcagcgaggatagaagcgatagcgacagtagagaattgcatttttgatattaaacgagtgaccaaagtggatgaattagtaaaactaaagaaggaagagaagaggagtagggaatttcaatgtgcttttatactgaaaatcaaatgtttttgtttcttaagcaaatgcgcttcagaatacacggtccgggtggctgtggcatgttgtccaggcgatagcaaggtaccgttttgttttcatgcaagacgcgattgttcactaggcaacaaagcgcgtttgtccgcattcgggtttttaaacaatagttacaacagaaagcgcccaaaaattgcgcgtagcgttaattgttctctgtgacgctatgtccgatagtggtagtcaaatgtgcaaatccgtcaaagcttcgctttgaaaatattctcggttcacgttctagactggaactaccgttagaaaaaaaatcgttccatggaacgttgctatagtacttgggcggatcgacaccatacacggattatgttgacaaaacacatcaaagaaaccttcggcttaatcgtttgctagagctaattggttcgttgattgggaagttggcagtttttgactgcgttgcaatgaataggcaattcctaatgttttggctgtaccgtgcattcaatggctgccttggtgatatacccgagagataatggagattaattaatcaatggaaagctgaaagatagccagacatttctacagtatatggtacgatgaatacatggtcaacattcatagcatcaccgtgtttggcatcgctcgtttgggaaggttatgtaattgtcagactggttgatatttgagtaactagcctctatggtgatattattctacaatctcacatttacatttgttagcgagaatcaggcgctcatgaaaaatcgagtgaggaaaataaccttttgaaagccaagcacacggttaccattgcaacagctggatcatcaagctaattaggtttttgtggagatccgacgatggtttactacttctagaaattctcaatcataaaaggcaatagctaaaggatactggtacattgctctccggaagaagcaatccattgtcagcacaattcaccacagttgaactggaaggcagcttttgtggagcaaccgtctctatcgggtattactgaagtactatagacggttgaaacaccgttatcttttcaccggctatcacttttttaataatactcattcatccaaacatcacttaccacaactttgtcgtccattttcaggtgatgcaaggatccctgaatgagattattcttgctccctattgttcgttacgttgagtgttttttttttctctcttagaactaatcacttcttgacccctatatacatatatcagaatgagaagcatcaaatgtgttgttgtaggtgacggtgctgtcggtaaaacatgtttgctgatcagctataccacgaaccgtttcccccatgattatatccccacagtgtttgacaactactctgcaaatgttttagtcaacggagaaccgtttaagttgggtctgtgggatacagcaggacaagaggaatacgaccgattgagaccactgagctatccccaaactgagatcttcctaatttgtttctctgtagttgagccaacttcgtttgaaaatgtcaagaacaaatggattattgaaattcgccatcatgtcccttctgatgtgctcatattgctggtcggtaccaagattgatctgagagatgaccctcataccttggacagtcttcatgagatgggatacgatccaatcactcaagaggaaggtgaagcactagctaaagagctgggttgcgtcaattacctggagtgttctgcttctacccagcagggagtcaaagaaatatttgattatgctatttctgctgttgtgcaagcaggccagcctaatgttgatgccaagccatcgcctccagtgccatccaagtccagtaacaacattagccctaccaccgtcaccaacaactctactaacgtcaccactacgagtacgacatctaataagccagatcaaaagcaatctactactgcacccaatcccgcttccggtcgtctacagaagttcaagacaaggaagagcaaaaaatgtttgattttatagttttatttcacatctgcatgtaccatattgacactctagatacttaattttaaaggttgtgacccattttttttaatgctctgttttcatattcttattaattcttagtttatatcgtagtcattactgttgaattagtttggctctgtctggatgtataccaacaacctttaccgtgtccttggatccttcttccttctccttggcctttgccatatccgtggccagtttctttttgattttgtcctttctttcctgtaatagtttgtcattcttaccttttattttttccaatcttgtggtagagtttcctccacctccagcggtaagctctacattgatttttctgtcgttcaacactgtgtgatgcattgaaatggctatgtccattctctttctcacattgacatcgtcctgtttgaattccaggaacgcaaatcctttatctagacgaggtctaatagtatcaggtgagcaattcttaaaatgatttttcaaatcttcctctgtgcacttgaaactcagattacccacaaacagaatgaaccttggtcctgatatctttccacctttccctcttctggttttcctctttttcttgggtgcatcggctttccttttggcttcttcttcctctttttcagctttcagctttgcttcttgttccaacttctcagccttctctttcttggatatttccctctcctctttggattttctaaactccaaggcctttttctgtttcttggttagcttttcttcacccattgtgcaagtcgatcctggtagaagaacaaaatttttttttttgagaaacgcgatagcctcttcctcttcaatagatgggtgataacacatggtagaaagacccaaaatcaagtttaatatcaaaagcaggaagtctgttgaacctgacagaagagaaaagagtccttcaagaaacgacgttgactacagagagagacaggtttctccgaaacccgatgaggggagtaccgagattgacacaccgagaggtagacccagtgaaaaacccaagaatgacctggagtccgaggtggaagtggacgaggccatgatgaaagtcatgggctttggaggatttggtaccaccaagatgaagaaggttggtggtactgatgtctcaggtgccaaaactttcaagccaagtcaataccgacaatatgtgaatcgtacgaaaggcttcaatagacctttatcacctacccgaaagggaaaaaagtaatcgatgtatattataactaaatgcattttaatctctatctaatagctttaaatgttcagagtacaagtcttgatggactctcttgagctcattataagctttggtcatctccttcaattgagaggcatattgttgggttgagacattttcgtcggtatcttgttgctgctgctgcacagattgatccacagctgcctcttcttcggtatttagttgatagacaacatgttcttttcgaacttggttcaaaaaaccacgaaggtcaaattgttctttgagttgttcgttgtcagacgcaaggctaccaatatcaccttctggtgtccctgccgcaggtatattaatatcatgtttggaaatttctgtgtcactgatcaaagaacgcttaaggttcggtaatatgcgtggagttgaggcttttgtagagagatctgaaggctctactcgttccagatcgtttatcagtagtcttaaggtggatattggtcctgaacaatcccttagttgacgagcaacttgacgagaaactatgtcattgacaaaaacctttcctgctgaatctgcactgactaagagtccaccatccgcagaaacttgtaagcatgtaactggactgtcttgatgggaggtaatgatgaattgagattctggatcgtctgcagaagttgcagaaaccaatttgccgcaacccgtattactctcaagttgatttttgtgattgacaataaaaagaggtactagtctaatagttcctgaagataagccagcatacaagtatctctgcgctggatcaacagctagcgcatttactggttctccaaagataaaagtagtcaacaattcgccattcgagacgttataatgtcttacttctccgtccaaagaactggtaaacagttttatgtcgttagagatacctttagttagcgctatggacgtgattggtaatgaatggttcgttagaacgtgaattggtttgggaagaggatcagatgagaattgtatcagatcggccaaacgccatatcagaactctggaatctttaccaccactaacaaggacttggccatcatgcgagacttctaaacatgaaacttcttgataatgggcttcttttgcgcttagcaggtaaccagaagccaactcccaaacgtacagtcttccactttttccaccaccaaccaagaatcctgctccaaatatatgtacccataataaactggttagctcctctggcacagccatcttttgctcaggagattcctttccccataggtacacttgtatcaatgctttttcgggacaagctacaaataacctgtgaccttgaccggtaccggtgatggaagcagcgttggcagcacattgacggaactgaacatgagatttgtttgatctgatggaggccaaaaatgacagctccgctgcatctgttgcagttgaaggtgtataaaagacactttcgtccatgggtagttctagtgaagaggaagaaaagttcacaagcagcgaaaaaaaaattatttcatgttcacgttaggcatctcaggtgcgtaaataatacagtttattcctattcaatacatcctattgccacccatgccaattgacatcattaataccttagttgtaaagggaactgacggaatccccggatggccaattataaaacggtatggactaccgtttgtggcgctcagtttactgaaagtatattgtggagggaaactgaatccatggcaaagagatgttcacggaaaagtctatatattgacaggcgccaccgctggagttggctcccagttagctgaagaactagcaaaaggtggagcacagctgattttgttggtgaaggatccttcgagttcttggacagtcgaatttgtggacgacctgagagagagaaccggaaatcccttggtgtatgcagagcagtgcgatctggccgatttgcattctgtcagaaagtttgctacacgttggctagataatacacctccaagaagactagatggaatcgttgggtgtgccggagaagctttaccactaggtgctgcccgctcgacttcgtcagatggagtggagagacaagtggcggtgaattatttgggccactttcatttattagcgcttctgtctccatctttaagggcacaaccagcagatagagatgtcagggtggtgcttacgacgtgtacaacccaagcgatgggtcaggtttccttagatgaccctttgtggttggattctcagtatccctcgaagagaccgtggcaggtatttggcggggccaagttaatgttggggtgctttgcccaagagtttcaaagaagactggatgccactccccgtggtgataaaatgccatccaaactacgcgttaatgtggtcaatcctggtttcatgcgcactgcatccacagcccgcgtattatcctttggatctctttggggcttgcttctatatttgctgctttatccaatttggttcatcttattcaagacacctatccagggagctcaatcatatcttgcagcactatttgctgagcatttcatagaattaccaggaggtcagtttatccaagattgtaagatcgtcaagccagcacgtaaagaactgtcagactttacatttcaaaataagttatacgaaaaaacggagaagctgattgaccagctagaacgacaaagcgccaagcaaagagtacgatcgaaaccaaaatccaactccaagtctaaaccttctaagaagtcaggcactgcgaacgttggaccagagaaagagaatgatgtgtttgcatctgcactaaaggcgacaccaccagacctattccctcatcagcgtgcagaccccgcaggaaataaatatcttgatcagttagagaagaagcttgctgaacagtccaaaaagcattctacataactatatataccccacagagcattactaaatcttccagaataggttcttccatgtatatcggtttcttctcgaaagagtaattactgaaaggaggtaaaaaaaaaaaaaaaacggaaaagaagaaacgtactctctaatcactatgagtaatcagcaggagagaacgttagggcccttggtggaaaggattttggctcagccagtcgaatttcagccagccaagcgtccagattctgtaaccgttaaaccatctagctacgtttcatttggtagcgtgtcggccgcgccactgacccaaactctcaagcgaggttcttcgccagaccccaaaagtggtggggacaaatccaagaatctgaaacccaaaccaaaatctatggctgaagctatagcagcctacacgcagaagaaactgttgcccaaggtattaagcaccactgagaatgcaccattggatgatgatctgggagaagatctggaagacttgaaccacaaaagttcggaatctccttctgttgatagcgatgcgcaccaggacaccgatttcaaggccagcaaggaagaacaagaagagcacgaagtagacaaagaggatgatgaggacgatgacaatgatgatggtgatgaggacgaggatagtgattatcataccgctgaaagctcggatggactgcaatctgaggattccggttcagatgccgaaaccaatcttgatcacgatgtgccatcggccactagtgatactggttcagacaaagaggacaatggtagtaccaactctaactccagctcagctactgcatatttatcagaagttgaatccctgaagagagactccgcactaaaacaggcaactccacctacatctccagaaaacgaagaagagatcgaggcaaaaagaaaagtctttgctaccgaggccgatttttatcagttgaatgagttatatgacgacagagggtccaacaattccactcgtatatgcaagaattggagacaaatgtcaaaatctcgtcctttaggtctgttaaaccacggagttacatgttacatgaactctgcagttcaagctctgattcatattcctgctttccagcactatcttaacgacgtctgccgtaataaataccaatcggttattgctccaaatagtgttactaagacattggcagaaacatccgctaagatgtggcaattggaaaaatcccccggacgcaacacgcctctccatataaatccaaagaaactcattcgaaggttagaagagatcaattgcatgatgtcaaaatggcaacaagaagactctcacgagtatttgatgtctttaatgtcaagactacaggaagattccactcctaaaggtgttaaacttagagcgagtatcattcatgatatttttggaggttcattgcaccaaaaagttacctgcaagaattgcggccacatcagcgaaactcaacaagatttctatgatctttcactcagtcttgataaccgtaaacgcaagtctgctagtgaaactgaccatgttcgcactgccaacacggaagccaattctgattccaccaatgaagtagaaaattcaagcacagccggtaacgttcagcatgatgtccaacaatccactggatcccgatattctattgaacgttcaataaaggatttcttctcctcagaattgatcaaaaccgataagaaagacaagactggttacgtttgcgaaaaatgcaataaacgaaccaacgctgtgaaagtttcaactattgatactgcacccgagtcgcttataattcatcttaaacgatttcgttacgatgggaactctaactcgtccacaaaggtcaagactggcgtctcataccctgaaaccctagaaatgacggaatacactacaaccaactttcctgctcgttataaattactttctgtgattcttcatgagggccgttccgtttcttcagggcattacatttgttattccagacaaccagacaatacatgggctagctacgacgacgaatacgtcaacacaatgcctgaaaaacaggccctcaaagatccttcagcctatgtgttggtttatcaacggatcacccacaagagcattttagaaccttccagtgcgacatcgctcaagcgttctaaaccatcctcccctcattccaagagaactaagcgctgaacaagctctggtcttacattcagcgtgtgatctctttcatttactatgtacattagatattattgaaacaacaaccccgcgaatgttgtcttaaagtaaaaaacaggaatcaaatttcagcgaagaaaacctaggaagcttcaactaaccataggtataatgtcagccaagaatcatttaataaagcttattgtaggtgcaggacaggctgctccagcaccaccagttggtcccgcattaggttcaaaaggtgtcaaggccatcgatttttgcaaagagtttaacgctcgtacggcctcttatcaaccaggtgtaccaatccctgctataatcacagtcaaaccggacaggtccttcagctttgagctcaaatctcctcccactggatacctactgttgagagccgcagggataccaaaaggtgcccctaaagtgggacctggacaacctaaggtcggaacggtatcgttgaaacatgtctatgaaattgcaactataaagaagactgaccaacgacacgaaaaagccgagctgaagggaatagtcaagagtatcatagcaacagctaagagcatgggtatcgacgtagtgaaatgaatgtactgaagaaatcaggacctgtaaatacgctttttttatttcaacaatatacaacatttaaattacctcctctgttttttcttttctaaggatgcaatgtgggccacactttgatccacctgagtatgtgtatgagattttgaatgaattacaactccatcttctatggtacacatttccaagctctcaaaccatggatctttgaagcattcatcgatttgaatacgacaggccggagctagctctaccatggctccgataagtggacgacaatcttctggaagagcattcaataaccggccttctccaagttcattaaaagtgtggtttgaaggaggagcagttgatatatgtttaggagaggttgaagccaccgaagccttggccggaccgctctcgggcttgttttcgtatcctggtggagggggtactttcttaagtaattcgttcagcgagtctgattctggacgtgttgcaaacgctttgaaactaaggtcagtcagcttgggaatcctccaagggaattttttcagaaccatgcaacaatatatcatcgctgccgaccatatatctacaggtctggggtcatatttgtggaaaatgcaaacttctggggcaagataaggatctgacccgacgattccttgagcctcgataagagtgttggaaaaagggtaggaaaacacgacagcagatccgaagtcgatcagcttaacaattccctccttgttgattacacagttgtcaagcttgatgtctctatgtgccagtcccatagcatgcaaatatttgattccattgagaatctgtttaaaacaacagtcaatctcaggacggctcatttgattagacatgacaatagcaaaaaggtcataatcacagtattctagaacctgcatcatgcgatcattgtcataagatatttctatagtttcgataatattgggatgtcgcaaagttgaaccaatgcagtactcaccggtgatttttttggtgtattcacgtttggattcgcttgaatatttgggtctaaactctttcagagcaaatatctggttatcagaagttcttttcacaagcttcacttggccacctgcaccagcacctaaactgtcaccaaatttgacgtatcttttgtgaaaaggtactgtcggttgagcattaccaccaattatcatctgggagtagctgtttgaattcaaattaccactgcccatattgctcacggctgtatagctttcatttctttgaagagaagcactggaacttggatatctcctggatgctccgtttccaacgatactaatgctactgggtgtcgtagacgtatgtgcgtttgtagtttggattgtgggctgggatgtgtaattaacggttccaggagagccgacaggagaatgctgccttgacgatgtagtcgaaagggcacgaggttgatgtcctgatatgctggtacttcttttaaaaaaacgacgcaaatcggccatcgaggaatgtctaccagcactttccccgcttgaattagaagaaggagaatgagaataagtaacacggtgctccattggagataaagggtccaatccaacgatggagttcttttttgatcttgagaaaaaattggttgaagagccagaacgggacacagaattatgaaaattttgggattgttgcactttctgtctagaaataataaatcttggttcaatagaagcagaactggaaacatttggtgatgttatgtgagtactctggattaaattaccattggccaggttgggggtaaaggacaggcctcccggatttcctgatccataaagtgggttggaaccaatactatttgaaccccttcctccaggagcagaaaatggaatacttgatgaaagtgatcccaaagagcttgtcaaattagactgctgccgttcgattttggggggtattggtctcctctcgatgtacaaaccgtttgaagagtcatcttcatcatcgccgtggcctttattattttctttagagatctcatcatggaatgtaaccagttcaggtagattttcagaggaatttttcgccgtttcgttgggtccgagttctttgctgtccgtattcttccctgataaggtactgccagtcaggctttgctccttcattagtttagtcagccctgacaccggtgatcggcgggcggcttcatgatcagaagccatctcttcaaataaagttgccgtcactttggaaataaaagaaagccggtaaaaaaaggggcctgattttgaatcaccgatagataggtggtaaacttcgtcaacgtctaagccggtgctggagggaaaatacagctacataatcgcgcggcggcggcggcggctgctggcacgagattaggatggtacgtggcgcggtgttgcgagagacgatgacagattgctcaatagataccacagatatagattatgtaagctgataactgaacgggttatgattggacagtgaggaatatttttctcttggtagcctagtattagggactattggatccaaaaaggtcattctggacgtgacgacgtagcatctggttgacctgttgtgagatgacaaccttgaaatccttgctaatcatgcttatacctattggcttgttaattttctctttggaccgactgactcctccaggcgttcctccttgacctgagcttgtatgaccagggtttctctgcggtcgtttgttgggaggtgtatttaggcctctcagagctgtccccggcgattgattagttagactcattcgtcctaccatggagtaactttgaggatccatactcccagaggacagaacgctggccaacccacctgctctagaagtatgtgtattatatgctcttttcggttgttgaatggataatgcgccatcgtactgttgatctggactatctggcggtattttatccagtgatcttgctagcgggtcatcattgaattgagatccactcatattttttcccttcgtaggatacctagaactgggtatacccgatgaagcttgtaaacccgaataaatagaagatttggacattgagcgcttgcggttccctgttgttccttgagaggcacctgaataaatcaggttccccatcaccaaagatggcaatttagaaggagattccttccgtaagttctccgtggcttccattattttatgcattaactccacttgagtttcctcggcattaacaacgttggagtagttcgttaaacctttaatccaggttttagaaccaaacgtatccagtagtttctcctccagtggagatctgaaaaccttaacctctagcgagtaatattttcctgaatgagctccaaaatcagtcattttgcccttgggaatctttgtagtagttctgtcaaaaacattttgggtgatcgattgtttgcttagctcttcggcaatgctaatattacttgcactcagaactgaggacattccagatgcactgtttctaccggaagaaaacgcaacatcactaattcctgcaccacttgcagaggaaactgacgacgacgatcttccaacggctggctcagcaaacgttctgaatgctccaatctcaacaaatccttgtctgactgatctttcaggatcaatcactatcgccaggtagggatcttgaaacttttggtttaaattctgagtggcaacatcaattccactcaaccagcacccataaccaggatgagagtgataccatcctatgatattctcgttatgcttgatttcctttaagttatccaaataagagaccatgaactcatatccttccgcttgagcattcactcgtgtctctgtaccttcaaccggaagtaagtagcaatccattacgactaatgtgttggcaaacaccttacctgtcagcatgcccataatctcaattgaaccaccggaccgggcatgagacatcatcttcagtagtgctatcgttgaaatgtatacagtcttgaaatagtttccatcctgcaaccatggtttattgtccaatacttgcttatctgaagactgactgtaaaatctattatagtcgcccttgattgttggttcttcctctgtgattataggctcgctactcaggcctctgtagctgcttgtcctcttctttagaggatcagctgtgctgactttgctgttctgcagtgattgagccaactggagcgccaattcattgactttcagacaattgtgttccattgcctcactacttgcctctcgaagataaaaggttacttagaaagagaaataattagtatgtgtggaggtgcgactgataatcgagagtgatattatatttcagaaacataaagaatctatctaaactatatcatagatctaatgcgacactctaatcattatcgtaacaaaaaacaaaacaataaacagtaacaaacaatagataaagacaacaaaaacacaaagatataacatcccaaactgcaactagatcaagatgaaactacctctagtcaattcctagttaccgttgcattggtactggcattggcattggtattggcattcccaaaatacttgtgattgctgttttttgtcgagttggaagtcgacggattgctgtagaatggtatagcaaatttctcattagactcctccactcccataggcactgaggcaggattatagtacatgtagtatggagtggcagctgcagcgccagcattattgtaatccatgggtgctgcaatagctaggcctggatcatagctgggaaagtattgaagtggctgtggataataatacgctgcgttgttaacggctggatagttgttccctccttcgtatacattatcactgggaacatagtatacataagtcggacttgcgtacctgatattgttgtcttgatgagggccccattttttgcctaagggtttgtcatctgctgctgtggctatggatgatatgtggctctccttcatattggaagataccgctgtgcgaacagtagaagatggtgttgaagatgacgttttcctgccttctgtatcattgctgtcctgtggtgcctcttgaactttagactgtgcccgctttttctttccattttggttttcaggattatcattttcgccgttctctttttcatctctgtcattccaagatgtggtcttatctgaccgaaaatagcctgctcttttgttgaagctgaagggcgcagctgaattattgtatctcatcgagaacataccatgattttcaacaagtggtgaatatccatatccatgtgttgtggttgcgcctactgttcctcctccaggtgaaactgcagtacccatttgaccaactctgttagtctgattctgggagaaatttctactaaaactacgattattttttgaggataaattaaccggtggaggtgccaatgaaagttttggactatcactcgtgggacgtttgtaattattggtgtgataaatctcacgatattgaacatgcatggttctatctttaagtattgcatggttttcttgttctactgcagatgcagcggcttgctcatcttcaaatttaatgaatgaaaagacgttattgggtctctgaactagcacagactctttgattttaccatggcgtgaaaatctctcgtttagctcttctttagttatcgatggagaaagttgaccgatgaagatagacaacttatcaatagtgcttgtttcctggttcttagtggatgttggttccagattttgagcccattcgacatgccaactcacttgagttcgcaaattggcataggccctgatggcatcatcacgataaacaaactttacgaaccattctttgatccgtttatctgagttgcttgataaaggcgccttattaccggcagcatctacacctactatctgttcaatctctccatatttctttagaaggttgataatctccactttcgacaatccgttatcattgcttgtcaggatgtataaggttctattaactcttgcaggctcacaacgaattgatctaccatctagaatggaatgctgaccctctttaagagcacgcttggcgttgtcatcggttgtatattgaacaaaagcataggggcgattagaagtatctctcagcactttcacaattgcgagtttaccccattgttcgaaatgctttgtcacagaaatgcaaagatggtcatcacttttctcagcagctaaacttgccacaaaaacacaagcagaaggtctccctctaaagttggaaggcaattttttatccttacactgattatcagcatcgatatcagggtcagtagttgcatcaagagatcctctttccgatccagagtcgtcttcggatggtgtctcattttcagaatattctaatttgatctcttcaagcttagcaccaaggtctcctggggtgactacttctttgctggtagtagttaggagatcttcagacccattgtcagcgatgactggcgagtaaacatcctcagtattcatctttatacaaagctattggaagtgctaaagaaactgaggaaacaagccgtaggagggacagcattgtctatttatatatctcagtcgatgtttcgaacaaggaaacacaaaagcagtgatatctctcaaattgtggagatctgaagacaaaagaatgagccgcagtgagattcttggtcgtagtggtaacaaggttggtacaacaacggatacgtagtactaagcagatctgaaaccttgttttggataaggatacaaataaataaaatatgtaataaataattcatgatattacctaatcagaacaaacagccgattattggaatttgtaggtggctaaaacttatttagaggccttgacggcagccatgttgttcaaagcagaaccgtacttgaaccattcgatctgttcggcattgtaggtgtgagacaatggagtttcccaagttggggagccgtcggcagggtgaactctcaaagtgacattcttacctggagccaactcggtcaatcccaaaatgtcaacctcatcatcgggttgaattctgtcgtaagctgcaggatcagtgaagttcaatggcaacagaccttgtttcttcaagttggtctcgtgaatacgagcgaaggacttggtgataatagcgaaaccacccaagtatcttggctccaaggctgcgtgttctctggaggaaccttcaccgaagttctcaccaccaatgacgacccacttaacaccattgtcacggtacgcggcggcagtgtctgggacaccggagtagacaccggtgtagtggttcttaacgttgttggcttcaccgttttcagcgtttatggcaccaatcatgtaattgttggaaatgttctgcaagtgaccacggtacttcaaccaaggaccagccatagaaatatgatcggtggtggtcttaccaacggacttaatcagaattggcaatctctcagcgtcctttccatcccatggctggaatggagtcagtctttgcagacggtctgagcttggagaaatgacaacttcaacggaggctctgtcttcaggaggagcctggtaagtgttttcaccagggtcgtaaccacggacaggaagaccgactcccacagggtccttaagcaagaattcgtttccgtccttgtccttaagcttgtcagtcaatgggttgaatctcaaatcacctgcaatagcataagcggtgaccatctctggggaagcaacaaaagcgtgagtagctgggttaccgtcatttctagaagtgaagtttctgttgaaagaagagacaatagtgttcttgtcacccttcttgatatcttgacgatcccattgtccaatacatggaccacaagcgttagccaaaacggatccaccgaagtcagtgaaagtcttcagttgaccatccctggcaatggtagcacgaatttgttcggaacctggagtgacagtgtacaaagacttagccttgacaccatgggaggcagcatcttcaatgatagaagcggctctggtcatgtcctcataagaggagttagtacaagaaccgatcaaaccaaccttgacctcgagaggccagtcattggcaacggcaacctccttcatcttggagacaggagtggccaaatctggggtgaaaggaccgttaatgtgtggctctaaggtgttcaggtctatctcgataacctggtcgtactcacaaccagggtcggcagacaagtactccttttggaagaccttggcaaactcaccaatctcagatcttccagtagcgtccaagaagtcaaccatggagttgttgaatgggaacacagaagtagtggcaccaatttcagcacccatattacagatggtagccataccagtacaagagaaggtgtcaacaccatcaccgaagtactcgacgatagcaccagtaccacccttgacggtagtgataccagccaacttcagaatgatatcctttggagaagtccatccattcattctaccggtcagcttaacaccgataatctttggggccttcaattcccatggcaaaccagccataacatcgacggcatcagcaccaccaacaccgatggccaattgacccaaaccaccagcgttaggagtgtgggaatcggtaccgatcagcaattcacctgggaaagcatagttttccagaacaatttgatgaataatacctgaacctggcttccagaaaccaatgttgtatttggcacaagcggttgccaagaaatcgtagacttccttgttcagtctgatggcacgctccaaatcggcagcaccacccttttgagcctgaatcaagtgatcacagtgcacagtagttggagtagcgacagaaggcataccagcggacatgaattgcaaaatggccatctgagcggtagcatcctgacaagcgattctgtctggtctcaatttcaagtaagagacacctctctcaatgtcttgttcatgaggcttgtccaagtgaccgtacaacagcttttcagcgtaggtcaaaggtcttcccagtctttccttgacaatattgacgttgtcaagttgttgcttgtaattaatgtagttgcccttttccaacaggttcatctcaacgagagaatccttggtgagccctgacaccgtggccaatccacggctgtttatcttagcaagtactcttctggcggataacatactgtataacgggaacaaaagggaaaaagaagaaggaaaaaaaagaagggaacttccataatatatgtcccgaatgcgatctcctggtatgccagtaaaaactagctgcatcagacatttgccttggctcggtagcgaaaaggagaagttggatccgagggtggaattcagccaataacgttaaagtagtttgtcagactccaacaagataggaaagattcgaagactttggagcaaatagaaaaaggtcaggagagtccagatactgataatctgagtatctgaaggaaatctaagtcatttatcgacggttatgtcaagattgacagtctgatctacaattgaaatgtggggtggccatgtgattctcgaacgattaccgactccatctcgagggtctgaaatttagctcccatgttgccgataccctttcattatgggatgttttggcatggtaataacaaggtcatgagcgaatgaccggggatggtggaaagtttatcagggggaagtgggcaggtacttcctaagacacaatgagcctattgtgaaaggggataatcataggctcacccgacagcaataaacttggagagattcagaaacagttaggctatgaacaatcagggagctgagtgatactttctattggtcaaccacggacattttaggagtttagtttaagccttttgagtcgaatgtcggggtgcactagaaaagtatttaccttcgggattgggagtttctactccgtaagcaatttccatcaccttgtgattggtgcgagtgttccttatgcgaatttcggagcagctgtaatgtgtgacgttcaacgacctaggcctccgagcttcgcaaatggtagggactaacaacatgggaattgttgtgatcgtacattggtgtaagggcaacaatcgatttggtagggcatcaggatagctaaaggggaaacagtaaagccttgaagccagataagagtgaatgggcaactgatgaaaggaaattctgagactaaggtaaacaaaataaggtattcttgtaagagaatgtgtggttggttcaataaatttattatataattaacgtaatacttttggattgaatttcaatattgcagctcaaaaatgggtgaaatttatgtgagaatcagaagtaaattatatatctaatttgccaaaagacattaaataatagacaattgataatcaataataattatttgtctttctttgacacagtgatgaaacagtagttagtattcaattgctctgattatgtaagttaatataacatatattaaataatcccacccaaatcaattcactagttgaccttcgttttgatcatccttaatttccctcatccaattgtttcccgtggcatcccaatttgtcctcaaagtgaaatccgctcaattccaaaccatcgacaacgtcatcacctgatagccccattcatctaatcactggtaccccgcgaaaattaactcaactgccacatttcactggaacgttccagttgatctaagaaaatccctcactatccgggattatctagaaccttctagaagtcccccctttaaaaaccaggtgatgccttttaggctttggtatttaagtacccccattacccacaactacttccacactatccaaacgatcaattaaaatcatggaagaaacacagtttacagatagagctttagctattattacaaacgctacaaagttggccaaggacaattcccatccacaggtccagcctatccatctgttggccgctatggcccccacagatgaagatactaccccttatttgaaagtcttagtggagaagggaagatttgactggcagacttttgaaaggaacatcaatagagcattgataagggtcccatcgcagactcctgcccctactgatgtttccttcagtggagtagcagctcatgttatccaagaagctggaaagatgagacaacaacaaaaggattcctacattggacaggatcatttgctgttggcattgttggaggacaagtctattacgcagatcctgaaagattcttcaatctctccggatgctttaaaaacacagataattaaccttagagggaaccaaagaattgactccagacaagctgactcttcgtcaaatcacgaattcttggacaagtatgcaattgacttgacggaacaagctagagaaggtaagattgaccctgtcattggtagggaggaagaaatccgtcgtaccataagggttttggcaagaaggaccaaatccaatccttgtctaattggtgacccaggtgtcggtaaaaccagtatcgtcgaggcagtcgctcaaagaatcattgataatgatgtaccaaacattctacagaactcaaagctgtacgctttggatttaggtgccttgaaagctggtgctaaataccaaggtgagtttgaagagagaatcaaaggtgtattgaatgaaattgcagaatctaagcagatgatcatcctgtttatcgatgaaattcatatgctaatgggtgatggtaaatccgatgccgcaaacttgttgaaacctatgctggcaagaggttctttgcactgtatcggtgctaccaccgttattgaataccgaaagtatgtcgagacagatggtgcatttgagagaagattccaaaggattgatgtgcgtgagcccactatccgagagaccgtggccattctaagaggtttgcaaccaaaatatgaaattcaccacggtgttcgaattttggactctgcattggtaactgctgcacaattggcatctcgttaccttacttacaggaaacttccagactctgctgttgatttaattgatgagtcttcggcatctgttgcagttgccagggattctaaacctgaagaattagataccaaagagagagaacttcagctactggaggtagagatgaaagcccttgaaagagatgctgattccgacaagactactgaggagagactgactgcagtcaaacagaaggttcaagagcttgaggaggagttagtacctttgagggctaaatatgaacaagaaagggctggtcatgaagagttaaccgcagccaagaagaagttggacgaattagagattaaggccactgatgcggaaagaagacatgacaatgccactgctgcagatttgaggtactttgctatccctgatgtcaaacgtcgtattgctgaactcgaagagaaagttgccgaggaggaagctgcattgagtgacattgccatgatcaccaatgtggttggttccgaacaagtcgcagagactgctgccagattgactggtatcccagtgcaaaagctaactcaagctgagaataacaagcttattacaatggaaagagagttgagttccagtgtggttgggcaatctgaagctgttaaagcagtctccaatgcaatcagactatcgaggtctggtcttgcaaaccctaaccaacctgcatcgttcttattcttgggattgtctggttccggtaagacagagcttgcaaagaaggttgccggattccttttcaatgatgagaaggctatgatcagaatcgattgttccgagttgggagagaaatggtcgtacaccaaattgcttggttccgagccaggtttaattggatctgaccaaggtggtttgttgaccaaccagctgttgcgtcatccatactcagtcatcctatttgatgaagtcgaaaaagccgctcctgaagttctgaacattttgttacaaatgttggacgatggtcgtattaccgcttctaatggtactctggtgaactgttccaattgtattgttataatgacatctaatttgggtgctcaattcatcaacagtgccaaaggctcaaagatatccccagagaccaaggagttggtaatgacagctgtcagagcccatttccgtccagaatttttgaacagaatttctgctacggttgttttcaacagactgtcaagacatgctattagcaagattgttaagatcagactggcagaaattgaacaaagatttgaagccaatgccaagtcaattaagcttgacgttgatgatgccgctatcgagtatctttgccgtaacggatattcttccgatatgggtgctagacctttgaacagattgattcagaatgagatccttaatcaactagctgttttaatccttaagggacaagtcaaagacaaggaaacagttaagattaggttgggatccaaaggtctggatgttttaccaaaccatgcagttgagtcggactccatggacgtggatgttgatgattgggtggatgcggccgaggaagaagactcggacaacaaccatgatgaccaagcaccactttacgactaagagtaatggggtatatatgtatataaaattcctatttgttaatcaattgatttgatcagtatgaataatcaaagtagttacgtaatatcaaatattcaatcacgtgacagatattctaagtcatcaggaaaactttttcttgtgagaatactatcaattgcttattttaattcgaaaataagatggcttctagaactcaagtaagtggcaaagcaaagctcctttaaatcccaggttacaaagactgtttactaacatgctttttttagtttgagaattcgaatgatgtcggtgttttcgccaaactaaccaactcctactgtttggtagccgttggtggttctgagaacttttactctgccttcgaagctgagctgggagatgtgatccctattgtacacactaccattgccggtaccagaattgtaggtcgtatgactgcaggaaaccgtcgtggactcttggtcccaacccagaccactgaccaagagctgatgcatttgagaaacagtttacccgattcagttaaaattcagagagttgaagagagactttcagctctaggaaacgtcatttgttgtaatgattatgttgcactggtgcacccggacatagagagagagaccgaagaactgattgctgatgtattgggagttgaagtgttcagacagaccattgctggaaacgttttggtgggctcatactgcgctctttccaaccagggaggaatagtccaccctcaaacatccatccaggaccaagaagaactgtcttctttgcttcaggtgcctttagttgctggtactatcaacagaggatcatctgttgttggagctggtcttgtggtcaatgactggttagctgtctcaggattggacaccactgctcctgagctgtctgttgttgaaagtatattccgtctgcaagatgctcaacctgaggctatctcaggcaatctgcgtgatactcttattgagacatactcataagatattatcggagtttgaagggggatagataactaaggttatgtaatttactgtatactagcatctaatacgacaccaataaaaccaggcaagtattctgtagtgaagaagtgaagaggcacgcatgagcgattcatacagacgtctttcattcatgttttccttggcacgctcaagcttccatcattcgcgctccgtagtttaccagattcatatttcagtcccgtaagtcaacagtttcgacccaggacacaatgcagcactatgggtaagtaaaccacgtagttgaactcgatctgccgcacggcccccttactaacgtcgaaatagaatttcaggcgactcgcttcgtttggctgctttgaaaaagctggtgtcgacccctttggagaagactcgtggaaaggtggttcaggcggtcctcctttctactcacaaaattcagaaggaagaaaagcaactggattgtgttgatttggaagatatcattgcattatgtcattctgtacctgatttggtgtcagagaagacgagaagagagcttttcaagtgtttgtcccatcagttgttgcaatgtctaaaccaagggttttcattttatggaaccctccaaaactttggcccaacaccgtggtcttatctcacgcggcacataacgtccggtctgataacatttgccaatcattttgaaagctctcgtcttgaagttgagggattgtttttgcaatacctggacagtttcatgtcgatcaatgatgtggaacttccagcttttttttctctttatgggttcattgaagggctcatagacaatgtgcatttaatttcttttcagaagcttcttcccagacttttagatcttttgagtgccgagttattggagaaagttgaacagctaattgatagtgccactccagcatacgcagaaataattgagaattttctttccgacgataatgagttttgctctttgatatttgtggaggcagttggacgttttttccaatcgtacttagagtatcaattttgtccgaatagagcacttgttactacatgcctccaggagaagaaacgaaaatatgaattgttagaagaagacgttgttgccaatacatcaactcagaatactccgttgatagcatttccaaaagaaattcagaacagacttggcgactttctcaatagattacttgaaagcagcattcacaattgtaatctcatggatactggagcttcattcatttcgttatcatcgtttgcgagaattcaggtcctttaccgagccaagtctaattttttgcagatccttggattcgcaatttattctgaggtagctactactgacgatctcaagtccttcatttcattttcattatctcatcccggatgtatgacacacaaagatctgggtcacacggttgtcagcctgagcgctcttctggcatactttgatgtcaattttggctacaacttactcaaggcttatccattattgttgggctctgtagacgtcaatgaaacgatatgtgcaaaaaatgctgtgttcattgcttcagctatgaagccattgacgcaggatgatgttattactacaatttattctctaactaatgccctgtctacagatgatgagtccgctgggaaactcagaagattgagtcaagttgccactactggtaatcaaacggacaacgtgtcactggacagttttgaatctcactttttgaaaaatataacgacaacattgatctcattcacaaagaccttaaacgacgactccataactttactggttatcaacattcttacacaaaagtattctttttctgtttcagtgcttgataaacatatcctattggcattagctgattgcacattgtttgcttctgaagatgagtttaatgccgtcatgaagcatttttcttttacagtgcaaatcgctttcgaaaaaaacaatctgcaattagtgtcttcgactatggatgtactctactccatttcttccagattgcacgattctcccttttcgacaaaatattccctttatttaaaggagcttctttcttgtgtaagcaactttggtgatgtggaagaattggagcatcatcgttcgaataaagagatttcgggcattgctgtacaaattgctttctacttgaaacctttggctaggttacttccagactttacagaggagccgttagtaataaaaaatttggagattacaagcctttttcaggatgtatggtataacatgattattcacggattttcggagtcatctacactctttgaagaacataaagagtatttgttgagaattgcaagatcgtcacctccacttgcctctgctgagtcatggaataagaccgaaacgtccatccggatgaatgctgtactacgccgtggtacgtccaacaggaatattaaaagccagaaagaagttgtcatttcctaccttaagtcaggtaaagtaaacaccagaggatttgaacttcaatcatccacaacagagattctatttttaggctccgtgagttttctagaatctttgagagtgcaaacaggaatctgtcataagattttggcttatttctcagatccaagcgttcataccactggtgtggaacatttaattggcgggatctctttagctttcacaaagaagtatgtgcagctttgcgattatcctttatggcccggatttttgacagaaagaattccctaccagttgaagaccatgatgacctattgttgctctagagaaactgtgactcaaagtactgcattccaatgttgcgactaccttgtttgcaacattccatcatctttgtgccatcacactagcttgttctccctcttggatattcttacattactgcaggattctgtaagagattttgctgagaatgaatataatcccaccgtcgagttttattcagaggcatctgatattaggcttcaactcagcgattctgaatcttggaggaaaagtactctgagaaagttcatcgattatgccaacaaatgggtcaacttgtgtatttccaaatgcgggcaggatgttaattcgttgttttactcttatctaacaaccaattatgatggcagatacaatgatgaagaaaatttcggaaaatcctgtgctgtacaatttttacggcagaaggcaacaagtcactctttgactaaaggtcatttcagcttagccgatttgagcagattgttcccgaaagacggaagtttgactagccaagagacgattgaagatgcatataaacgatgcattgagctggagcaaaacttgaaaagcaataagaaggtgactgaccgtcatatactagaggttttggagagctgcattggaactattcatccagcgagaaatgataccgctcatttgctgaaatgcgcaatttctattccattccaatgcacgaagaatattatcttacctactgccattaatttctggttatcaataatcaaagagttcccacagctttccagctcgattatagcagaaattttacatcagtgggagctatcgattcaaaagggtcactcattgtttaatcgatcatttgatattactgaaccagaatttgctccaatggagtacatgccatctgatagagcaaagatggatagacttgggaagaaagctgtcgacaatattgtcccacatttattacttatccgattcttcctttccaattttgaggcaaccggataccaaagttatcatatactaagatcgtattctgataccgtcttgtttgccttgagaagcttgaaaaaagctagtatccatccatatgcccgtttaccaaggttcgaactcattaagctaggaatttcagtattccaggtcaactttcgtgctaagtcttccttttctgaacctttagcttatgcgttgattgaggccgccctttcatggtttatcaagccattcaagtttccatttggaggcaatagaaattggctgaaatctgattttgatgtacttatcgaggttaccaacctgtttcgaaaaatgaatttgcagctgtatgctggattagagagccaaaaacgtttactattgagtttcctggatcatgagttgaacaatgtatacgtatggaataacgttcttggaacaaatgatattcgaaacaagtacatgcttggtcctgttactgaaactcaaataaatgatgcgttttcaatcaacccaggtttggccatcaatctggctagtcgttataataacaacaagctgaccggtgcattaagggatcttttggcttccaatccgattgcagcaatcaattatcccaacgcggttccattcttgttaaacctcgataactccagggatttgattgttcctaaatcactactaatatgggaacctgtttcaccaattgattccattgctctctttttacccccatacaacaggaaccccacggtacttcagtttgctatgagatctttggaaagctatgacgttcaactaactttcttctacgttccccagattgtgcaggcgctgcggtatgacaatgaatggggttataccactcgatttgtcttggagacagctcaggtttcccaactatttgcccatcaaattatctggaatatgatggctaacagttacaaagacgaagaagcaacgattcctgatgatatcaaaccaaagttggatcaagtcctaatcgaaatgaaaaaatctttccgcccggttgaccttgagttttataaaagagagttcaatttctttgaccaagtcactggtatttcggggaagctgaaaccttacattaaaaagtcgaaagctgagaagaagataaagatcgatgaagaaatggctaaaattgaagttcttcgaggtgtctatttacccagtaatcctaatggtgacgtggtggatatacatcgtaaatcaggaaagcctttacaatcgcatgcaaaagcgccttttatcgcctctttcaaggttcgcaaaccagtcgaagatgacgaaaacggtgatggaattccccagtatcgagttacagacatctctgcaatcttcaaagtgggtgatgactgtaggcaagacgttctggcgttacagttgatttctttatttagaactatctggatgaactcaggagttgacctttacgtctttccatataaagttacggctacggctcctggttgcggagtgattgatgtgttgccaaattctgtttctcgtgacatgctgggtagggaagctgtaaatggtctttatgagtacttcatctccaagtttggacccgaaacttcatccgagtttcagaaggcccgtgccaattttgtcaaatcattagcagcttactctgtgatatcttatttgttacagttcaaagaccgtcacaatggtaacattatgtacgatagtgaaggccacattcttcatatcgactttgggttctgttttgatatagttcccggtggagtcaagtttgaacagtcacctttcaaactaactaaagagatggttaatgtaatgggaggaaacacaagtactcaggcttatagatggtttgaagagctatgcgttaaggcattcttatccgcaagaccttacatggaaacgattgtgagatgcatagttccaatgttggatagcggtcttccatgtttcaaacctgcaacaatcaaaagattgagagctagatttgtgcccgacaagacagaaagacaagcggcaaactacatgagaggattaatcagcaagtcatttgaaagtttacccactaagggctatgatgaatttcaaaaaattaccaacggtatcccctactaaacctaaaatgaaactaatcgaaatgaatatgttacaaattcaacactattgtagtcccacaattatcattatgatcatcatcttcttctaataagcaaactgtgtgctacggaaactgaggtcattgaatgaataatcatcttccaagtaatcaaattcctgtttatcgtcaacatcggttttctcctcatacaagtccagcttcagatttttggagtcttcactttgtttcgattgttgtttttcttcagtttgctctgtcacatgatcttgtttcctctctttgggtgatttcatagtttgtttgattggagaatcatccatttcgttcaccatggctacaactatatcccctgcctccagctgttttatttttttcggccgtcctttgccaacatctgatttggagactcctctgtcactatcaaaacctcctatgcatatatttctttctctatgtgttttcaaagcatcccttcgagagaacttttttccacaagggcagacttgagtgtaatcttgatgtttctttttatgccttcgaagatcatgatttctgacgaactttttcccacatatatcacaggtgaatggtcgatcacataaatgtgtttggacatgagctctaatgtttgatattcgtgtgaataacttaccacagttgttgtacatacatgtgtacaggcggtcctcattaggtcccacaaagtaatagtctaagtgtcctcttggaagggtggttttcatggttgagcactttcgggttggagagctatcggtggaatcgatttgtccatcgacaacaattttccaagatactccactatcaggtctcctatctggggtatctggggtgattcccagtatttggtggtgttggtgctgtggggtttgatagatatctggacgtaaaggagaggaattagccatgaatcctttgaaggaaggtgagctattctgctgttgtcctatcgttccactgttggcgggaattgggattgcaataggactagaagtgggcactaaattaggagcgggaacagggagagaccgcatctgaacagtttgtgtgggcttttgagagaaaaattgtccctgatgttcggcagtttgttcttccaaaggtttatttggatcaatatgactttcctcaacgttggagtcaaaattcgtttccaatagaggtgtaatatcgtcaacataccggggttctctggcgaagttgtttatatgtcctgtgttgccaattgactggttatttataggttccagtccattctcatggtgtttatccattcttgtcaatgattttaagtagttgacagaaaaatggttcttatatatctgatctttttctctctctgatgaatccaaggtactggttctatcagatggagggaacttatagtgatcaggacgtccactttctggctccttaactggcgagcttggcagcaatgtcactccgcttgagggagggaggatctgactttccaatggtaaatcccaatcagaactcaaatagtgtcctggaggctcatccgtataccgatctgtctccaaatctggcatttgaacagtctttggagttttccggagcaactggggggatattcctggtatacacaactgtctgttttcaccagtaaaaccaaatatcccacttccactagttttcctggagtggcctttattgtgttgtggatgttgaccataactgctagcattcacaccaatagatgctggccctattggaatgtccaaatcctccaaattgtggagcgtttgttttaatacgtcgtcgatatcaaagtttgtgaagtcttcggttggaagtggaacttgctttagctctggcattatcccgttagagtttgggtcataaaacggatctgacttgtagttgtaattgagttcttgtgaactccagtaagagttggagtccatgacgaaataactgaaagttcacaatccactagcctctgcgtttactactaaagcttagaaaagcacagttgggtggtaagaagtgttgtgtgtgagcaggttaagatcaagaagatctaagcaaagtaggtgtgctatgaacctcatttaacatggaattccccttttagggcaagaataaacaaaagctgaaaaattggtgttgcaggaacagctattgtgatatatgcaagatgatcgagaaaaaaatttaaaattttgaagttacgattagggattacataatacattaggttattatttacagttgtactctcaatgtggagaagccatatctgactttgtagtggttgacctcaaaaacgagttgagacaactccccttcggacaggtaatactcagctggtgtcaaagagtccaattgggcatgacagtttggttccacaatttttttgagatcttccgttgatctagatagaatttctgatagaaagatcatctcactatcattcagtatgttatctcttgcgtgatgaaattttcccaacgaggtgtgaaataaaaccttagaaggtgagctgagaggctgattaaacttcacatcttttgcccacggtttcagacagtttacaaaatgagaaaacaacgctttcacaggtaccagtgattcatacgtcggagtgatagctacaaacgcttgggtaacgtgtatccttggactaaacgagatactgatctttttttcaggaaaagcctttgacttgattgaactgttgtgaaatgacttccaagactgagcattgcgaaattccaagttgggactcagggatatgtggagcatcgagtgtgttgtgttagaaagcgtttcgggtgagaaaaagggatcaaactgtaacttttccgaatttcttattatccttgggtatttttccgttttgatggttaagtctgaaccatcgccctttctattttggaaaagggttcggttcaatgcaatgttgtaaggattactgttcaacactaaaccttcaaacttcccctctctaaaatcttttattctttgggatatgaacttgttgtatctagcaacatgattggttaatatgtttctttggtggtgacttgttggaagttccaaatatgcaaaccaagagggctttttggcatgtctgaacatctagaccaagcaagacgaaaaaagaaaaagaaaaaattaccttccactgattatgacattctcgatgtcggatgtgtcaaattaatcaaacgcgtcagtttttttatttacctaaaagggtaatcgtgggtgttccaacctttacctaccagtcgagggaacaactgtgttataggaaattcagagtcgtttaccttacctctctttcatagccgaccaaaactccctgcgttgctatctttgatcgagttgaaggcccagaaaaggaacacacatcgcaattagcaataggacatttacaaagatttttttttgcttcctatttttgctcctttaaccgcaatttgcatcaatcttacactctactacattcaaattaaaagtgcttcaactctacttttgcactttgtatctttctccctgcctctttaccgacggcagcaatgactacctcagagatttacatcgcaacatactcatccgtcgatgtttatgagtgtatatgcaacactttcccactaatgcgacggtgttcagatgattgggtgaacgttactcagattctaaagattgcccagtttcctaaagcccagagaaccaagatactggaaaaggaagtacatgacaaaacccaccagaggatccaaggaggttacggtaggttccagggtacatggacgcctttggacattgctcgcaatttagcgatgaactacggattcggtgatgctgacttgccagttctatattgggatccttcaaaggatcctatgccaaagagaaacaaacagaaaccaactccagccaagcataatctacagtcgggtaacaattcgactggatcacccaagaggaggcgggccactcccaagaaaataaaacagcaggtgcaattgccagttcaacatacattcaccaacactaaattggaacaacctgctcatattccccaatatcagttgcatgatggctactctcaacatccgcctctaatttcaaagtcgcagcactcccagcagtaccctgtcccgcaagtcagcacatatatctactcgcaaccgcctacatttcagcagcagcagcaactgctacaacaacagcaacaacatccgcagccacagtacactcaatttatcaataaccaacaggcaataatcccttcacagaacaattttacctacaaccaaaatcctgtgccacggtttcagaactttcaaactgctaaaacagtgcaggctgtacataattctcaaggctccctatcaaccacggagaactggtcccaagacgagttacatcaacatggtcgcaaaaacagcgatacctctgtgtcttccaacgtatccctgcaaaatggaaaaataccgcacgatgactcacaactgcctatcataaggcctcctcatctgagcacccagcagttttacacagagttgttactaaactattttaccgaggacaatgaacaagttccctattatttaattgaggtgcctgaagggtttaacctcgatataccgatcgatgacgaaggccacacagcactgcattgggccgcatctattggttcggtgccagtagtggaggccctgctaaagaatagagccgatcctctaatcacaaacaattcagggctaaacgccctttctaagctggttggattcaacaactcatacgagttaatgaacttttcgcagcttttacatttgctgaaagactgcctgattattccagacgctaatggtcgaataccattacattacatgatggaactcactagtatcccagataagattcaaccattagagtattattttcaaggaatacttgaatttgtacgagaaactcaacgtctggccgaaacggcttctccagataataaagataaagatttattgaagattttattaaaccaccaggacaataatggagactcctctctacacattgctgccagaactggcaatgcacagttcataaagctcctcttatccaatggagcatctgttgaacttgtaaacagaagaaaacaatcatgtaaagacatgctgtccattgatctgctagaaaaattacattgggaagatttgcaaaaggctaagagaacttcgtctaaatcttcaacgcagagaaggggtcgagttaacagcactgacaacaagccatctattggaatatttaatgatcaagtggcgtattatccacagtataatagcagtgttctctcagatcaaactcaaatgtcaattgttcctgctacttctcagatacatagtcagcttcatcaacgacagcagttattgtctccagagatgatcacctataatccctcgattcctcaggatacaccgaagacagtttcacaatgcgatagttcaatgaacttgagtacttcggaacaggaaggaaatgtctcatttaaagaactacgggagaaacttccggatgttatcaataacttgaatgaaacttttgaaactgaaatggccgagaaggatgatgaaggtgagcattattcaagaatgattaaagatttgacgacagaggctcactacttggaaaagactatagctcgtatttcacaagagatctcctcaagaatgaatatggaccagaataagatgagtaccgctgtttttatcaacgaagcgaataaacaggttagcaaaatgacagaggttttgaattctaacgttgaagaattgaccagactttgggaaaggtcacaatcgttacagttagcaaagttggttcatcgccaagaagagaagcatttagatcatacagaacagcttaacgaaaaagagactgccatcaagctggcaattgatctgagcattttacaattcaaccgcatgaagctggtaaatgagattatccattccttagccgatgtgaacgtcaatagtaaggatgaccttgcaggtaatcgactttacaagtacaagaagctgatttcgaaggcatgtgggctgcaaatcgaggatgtggatgatgatctgttgaacggaattgagcaaactcttttagaaggtggaagtatatagctagtcagactaaacgatatatgattttcaatttaagaggggaagtcttgattctctcgtactccttcctccctgcagaagctatttttcggtggatgatctcctgctcgtttagttccccaggcctcgctaggatgcacactcgcgccaccagcaattgcgcacttctcctccacttagaccatcactcaacaactcaccaaaaatgacagagtctgggtcaaattcaccccggaatgaatccaagtcaagccttgttgaacctgagctttttgggctgtataaggatattaataaggacaacgaagacaacagtatttatgatgaattgaatgacaatatcagcaaacacacatcacatgtggacgactatgatacggtcgtcggacatcagccaaaaccacccatttacattcagttagcaaaattggcctatcatttgctgatcattggagttttgggtaacgttttcatcaaagtatctgaacatactcatgataatagaggaatactgccggacttgactaatttcaagttattttttatttttaagaacatcattaagtctgtggcccataagttccatttccgtttcgaaagcaacgaaatatttgatgagtactcgtactacatcagtaatgccactgaaggtatcatattggcagtgcttcctatttttatcgaacgtgctttagggtttagttcaaaaaactctaataaatcgagaggaagcaatgacctgggtctaattatgcgggcttcggtttctctggttggaatctgttttggattgcgtaagttggagtggacgtcagcatttcaggcatcgttggcgtggtcacttctgaatccatgtctttggctactacttgacggcacccttggaggatttttgacgtcaaccataatatctttggtctccatcattctttcaattgcagtaggctttgatgacacaattcccaaggattacagcttcattcattctcatgacaccgaagcgtatgcccgagtgctttgggttgggtccttcgtatttcttgcaagtattatttttgggaaattgggtagatacttcttccaataaaagatgagaaaataaagggaactacaattatcatagaaatccatactcccatccattacctatatatatatatatgtttgtgtgatcaattccaaaatattacgctactgatcattcgtagactctcgttccaaatgagacttgccgttaacaagtgggttattgacgttacagatagaattcctgttcaccctgctgatttcttcaataccagacaacttgagtggattcagtgatgagttcacttccaccccttgctttactccagctttggacatggcgtagtcgccagagtcaaaaaacttcctgtccttgaatttggactttaaaatctctgaacgtttcggaatctttccgtacattctgtaaagtttgagctcctgctcagtaagctttgattcatcaacagatgggtcttttacttcagataatgggtccattggatctgacatttgcaaatgaatactagttgcgtagaagagcagttcaagtttggagatgtaggggtcacattcgcgaacagttctgtgatcttcgtctggattccaatcgcaggtttcgtggcgggggagtccgcagtggcagtgggggatacggaacgcgcagtcgatgagcttagggcctgtccatcttggaagcatcgtgcggcttacttttcggagtggcacctataccccgatcgttgagcactggggcgatgagagccaaatctccgggaaaagattagtgccagtagaactattatcgttccatcgtgagagtctcctattgaagtcatctaagtctttggatgacaccctcgtggtaggattgaatactccaatggagatgtgcaggttatctggcgggtaggccaagtgtgactcttgtgccttgaagtaactatgtatacgttggttaatctggccaacaattgtgcccaggcgacccaacgactcgccgccaagtttgattgataagaatatttttctagaagtgatgctttgaaataagtatggtgcttttgtctttaacctgacagggttttcctgaaaactttcaagtgacaagtcctggcaaaatctgtctttttcgtcttcagtttgaaaatgcaagttctgcgataaacttatatgcaacgggctctctaagggctcaaaacacagatatgtgtcattgaacagttggtttatctgcccaaccaattttgtaatacccaccatctctttttcagctaatggaatattaacgaagatgaaaagagagactttattatacatcccaacaacctttccatcataatatttcctatgctcttgttgttgtttcagcaaatcgtccatctctgtgtcatcttcgtcctccgaatcataccccagatccattatttgttctcaggaggaccttggaagcgccaaacaggaagctaatgcactctctgtcgcgcttcctccttccactcttctctgcacctccgaccgcccatactttaattacaagtgttcttaccaatatcactcggatcctagacccggcgcccgggaatgttccttcttgcccagcgcgaactccgcctatcaggaacctatgtcttaaaagacacggatccgagatgttaaaatcctttgcgacagcgtcagaaattcatttcctctcttcttccaccaaccattcgttaacatccccataatgttttctaaatcagctcgcttagtcaagcaggttaaggtgtccttaccagtgaccccaatggcctctagaagattccttcaaactgcacccaaatttatgggcgctgcttctatccgcaacccacgtctcattgcccccaggtctcttcagttgattagatttcaatcacaaactgtgaaagttccagatatggccgagtctattacagagggaaccctgtcacagttcttaaagaaagtaggtgattatgtggctgccgatgaggtggttgctaccatcgaaacggataagatcgatgttgaggtcaattccccagtggctggtaccataactgaacttttagctgccgaggaagataccgtcgaggttggacaggatctgttcaaggttgaacctggtgccaaacctgaaggtgccgccgcagccccaaaagctgaagagcctggtgagaagaagactgaagaggcagccccagcttcatctacggaaaagaaggaggaaccccctgccgcagcttgggcccctcccccaaaaactgctgaaccagcagctccagcaaaaaaggaaactccaaaacagactaaggaggagacttctgccccaaaagctggcactttctcaagaaatgaagagcgaattaaaatgaaccgtatgagactacgtattgcagagagactaaaggaatctcaagacactaacgcttccttgactacttttaacgaggtggacatgacctccttaatggaaatgcgtaagttgtacaaggatgaatttttggagaagactggcattaaattcggattcatgggtgccttttcccgtgcttccgcccttgccgccaaggacattccatctgttaacgctgcaattgaaaacaatgataccattgtctaccgtgattacatggacatttccattgccgtggctactccaaagggacttgttacgccggtggtacgtaacgtcgaatctttatctgttttggatatagagaaagagatctccaatttgggtaagaaagctagagatggtaagttaactctagaggacatggccggtggaacctttacaatctccaacggaggtgtatttggctcgttatacggaacaccaatcatcaatattcctcagactgctgttctgggtctacacggagttaaacagaggccagttgttgttgccggaggtaagattgaggcccgtccaatgatgtaccttgctttgacttacgatcaccgtatgatggatggtagagagggtgttattttcctcaagacgatcaaggagctcattgaagatccacgcaagatgttgctcatgtaagagactgaactgagcttttttaaataagatctttgtgatatttattgttctacgattctaatgaactgccttttagagagaacccgttgtagagagtagatgctacacctgagtaggtacaccagtaaaagacggagatgatgggcttcgcgagaaatgagggatatgaattctgtcgttttcttgaaactatctctcacttcttatcatctaataccatggcttcagtcaattacccatcatcgtttgataagaaggacgaattcgaagacatgtccattttggacaagatctggttcagatgcaaacagcagcctttggtgcctattggttgtttggctacctgtgttgctgtcgctctggcagcaaaaggtgttagaaccggggaccgagtgaatgctcaaaaatggttccgttggagagtgggcctgcaaggtttgactcttgtggcccttgtaggaggtagttacatttacgacagacagcaagtcacgcaaagaaagacagatgaagaccttgctagggagaaggctcaacatagacaggacttatggatccaggagctagaaaggcgcgaccaggaaactaaaaggaataaggaaagggctcgacttgcaagggcccgtctggaggcggagcgctcaacgggtattttggacgatgagccccccaaatagtatgcatactgattatcgaaaaatgagatatttgtacatagtttaaattcattccttttgttcatcgtttgaccgtttaccgggttagtttttttcttccaactgtaccttcttgctcgctattggatgttcccaatctcggtaagaagacagttctcagtcctgagccatcttagagtcaatgctagatggttttatgccgttgatgttccgatttcgaaaccggagcaattcaagtacactcagactaaaccaccccaaaaatttctaccattcaatgattcggataattctttgttagaaaagtctttcaaagatggagacaagaccgtgttgcaagtgttggaggataggctgttcaattgcgatataaggtccaggcaattataccccatatactggcaaggcccggtgtacgaggtcagaagaggaatatggttttctaatggaaccccgattgatcaacggttggcagatcttatcgagaaacaataccaagctttgaaggataaattgggcaaggaagaggatcagatgttatttgaattagacgacaaaacgtcagagttgtccccgatagagaagagtgaagacttgactaccacaataacagaaacattcggctcgtctgaatctcaatcaccaaagaaacttgtattattcaaggacgataaaactgtttttatactacctaaaagctcaaaacttttgattcaattgctgaatccattggcggatgagttgaaaaagtctattttttcggactataagattgagagaggttacaaagccaaagaaaaggataaagcacaggtaaataagggatccacttctgcctttggagactactcattcataaattttttcactgatactgcaattgataagaatgccaagagtgaccaagctgaagaaaaaatggaataccacatgaaaaatgactttgctaaggaagacaaagataccaagcgtgacattaatcatatagtgttatgttgccatggcattggtcaatctctaggaactaaactggagagtgtgaactttattcatgacataaatatctttaggaagggacttgctactgcattgaaagaggactcagagttacaagagattagcccttctgcaagtaaccatggcattcaagttttaccagttatctggaggtataacttagggttttcaattgatgagccaatcagcgtgatagacgaaaatgatggagtcaaaaaacttccctctgtttctgatatcacggttgatgctttaaggcctttgagaaatcttctcggtaatgttgttttagacatattgctttattatgatagttggtacaagaaacgaatcctctcatctgtcgtacagcaatgtaatgatgtttatgacaagtttttacaaaacaatccaggatggaatggaaaagtatctttcgttggtcattctttgggaagtgcaattttttttgatattctatgcaaacagcctgataacttaaactttgaagacccaaactttgatcataaaagatacctcaagtttaaggtagaaaattatttcgcattgggttctccgttgggcgttttcagtctattaaaaaggcaaaatattgctcctagatccgaggaaaatttggtgtctgttaatgatatcgacaaggaagtgctggaaagaccttgtgtagggccaaagtgtgaaaatttctataacattttccacccctgtgactcaattgggtacagagtagagcctttaattaggtctgaatttaccaaattcaagccttctccggttccatttgctaataaatctggatttgattctcagttgaaagagattacagattttggtgacgaatttggagacaaattgaccaataacataagtaaactgtttggaaacaaatctattggagaactgctacttctggatagtaagaagcctgagactgaaaatctttcctcagattcacccgaagagtcgtataagaagtcatctagttcaaagtcgactagagtagacatttctgccgaaagtttgaaggtaataaaacaattgaattacagcgggagagtggactattgtctcagtgaaggactgtttgatatttcaattataaacgctatcaaggcccatacaacatactttgaaaataaggatctaacagcatttgttttacgtgagttgttgtccccaaaaagtaaatcccaacttgtttccaaaagtgcagtccttatgtcatctggtgacgatgataacgaatggttatgaaaggccggaaagagaataattaataattcttaacaatatatatttacaatagatcatccaacgattgttcggtgtcttttttgattaaagctatcatcccatctggaaggataggttttccagttttatccataacatatctgaatggcatctctgtagcctcatacctgttgaaacggatttctgggtaatcgatgaaagttatatcctcaaatttgatttgattttgtattattaattgggttgagcgaacagctgtgtcagtggtcatctgcaactcacccaacctgcgaccttcaaggccatatttctttctcagttcgccagttctatctcttgggggatgatcacccaaaatacctccaaacacgaaatactcaaacttctcagaatctgaaggtgttaagtcttgagatgctgcaggatctaaaagacataaactctgtctactctctgcaatgcttatacattcatcagtggtccactgtattccaagatctattaactcctgtggaatatccgcttctgttgttccttctggcaaagaagtaaggatcaaattctctttacctacttccttaatgattgtagagtattctagaaccacccaaggagtgaatcccggttccatgtgttcaataatgtatttcatagtgggagtaacagataggttacgactgaaaaagagagaaaagaaaagggcctcgcaaaaatatgcgcgatcatcttggattgataaaagatcaatcaaaggagtaagcttacctaaatgccaggtgattctgctaagttgaccttgcttcgagtcctcatatgtcctggcttcttgggctcaatatttggctgaggaaccgtatcctctgctttgactttcgtcgtatttgacgcatccgtatcttctgatggtgaaggagtagttggattcacgttcaacttgagtctcaatttgggaagatcctcttgctctcccggagatgcttctctcttacgtagccctaccccacctcttgattttcttcgatgtctctgagaatttgcacccgcagaagatgaagatgatctgggcctttccacattagtgggcttagacaatttcaaattcatcctcttggcttccttaagaagattcttgttttcgtccgtcaaattctgattggcatttatatcctcctcttcgtcgtccagtaaatgtgaacgtaaaacttcagacgttgtatcttttaacaggtcttcgaattcaggattgttcttgaacttctgttttaaatgctgtgtacttttagttttagtgacatttgcaccggcgccgggtgatgaaagtttacggggagcagaagctggtctttctgttaaaggtggcgaagaggttgaggttgttgaatgagcccctacatcgcccttgctatcaccagtgaagatcaattgtggcttcgccagattcttacttggatccagattttgtttccgtaattctatcacggtatctaacccttctttatcttgttcttcgtccggaagtgtttcaccgcatattaaggctgcattgtcttgcgaagtaaactcttggttatgcgcaattctgcaatgatttaagaatccctgagcactggagaaatttgttctttcacaattcttacaagtcaattggactaaaacgccgtctgacctcctatatatacatttgccactactggcgagaaacttcgatccaatggggcgcaaagacgacgtttgcgatcttgttctatatgaaaactctgagggggagctggtatattgtgcttcttggttatttgatcgttcctgcgcttcgttcttgtattttgacagtaaattcaagtacttttctgtgaaatcttttggctctcgttctagcttgtcttcaaccggaatattgtaatggtttctcaaagcaatcatctgagcctctactttgttcatttcttcatcaacaaggttcaactccctatgtttcaagagaatctccaagtcgaactcgttttcaatgagtctgcgctgttctgccaaactcattggtttcttgggctccttagacaagggtttgagatcttgctcaggcttgtctatcagctcggcagtctggggagatatggtatctgatctacttcgaggagtggtagacataacagggtggcaagcgttcgggagtgtaagaacttggagaaataaggatcaccacgcctttgaaatttccaaggagcgatcgataagaaaatatcgagaagggtgtattgggcaatagctatctaatcactctatataagggaggcgcttcccccattagtattactcaaacaaaccagatcgttgtacgaaagttgctcaaagaatatctttctctccttgaaagtcgttggaacaaccaagtatggctccatcttcatctctctaacagactctaccagtgtcttggaccaagtgtggtaatcggcgctatggcccaaattgatcagtttcttgttcggattgatctcattataccgtatgagtggagtcaatgatttgtcctgtgaggatatatccatatctaaagtctcattgacagaaataaccgacgaaataggtggcaatggaggggatgttagctggtccactcggtctagaattgttaatgacgtagagctggatcgaatatcttggtaaacagcctgcttcttgcttctcaattgaggctttccaattcttattgagcttttatgagattgaacgggcttggttaatttcctgctacgtttcgaactttcttgattgacatcgatctccgctaaggcaactcttttctgttttgggttctgcttgggttttccttaccaccagtgttacttaatgagctttatagactctgtataatagtccacttactgggcatgattaacttccaaatctgatttgttctcgtttgataaccgcctcgtcaaactgaataaggaagacagttcgattggggttttccttggtctcgacagtatgagcagaaacatccgcctggaaatatgctgaatctagcatcccttctatgataccagcaacaaatgcactgcagttgaagttctggaactcactaggaacacttatatatctgtttgctaatgggtcattgtcagtaatcatgtaattgcaaacattatcttgggacctttccaaattgtccgctgttttcccaaataaagccttccaaaacgtggtatgtataaattccaacatctggataatcttgatgtccctatttagtccattcttgcttgtggttgtattggtaatgtaattttctctcagccctagaagttctagatatttaagacctatcgtataaccaagaccattgaggcgtttttccagttcttgaataccattcgcacgttcccttgaccaactgacaagttcacaaaacagaaaactgaaggaacttagagacacatcgtgtttcatcctatgcaggtttcgatcgtaattgaaatttgggggtgtaacatgatcgacagacgtgctattattcgcagatgcttctacttcttcaacccgctgggggccaataagaggatcgtagcctatgccttgaatgggcttagcagatgataaaattctagacatgataatcaatggatggttgaagggattaaaggttcagcgatccttgggtgcgaggttgaacgcggaagctgggccaggaggtttggaggggaggttgcctttggacagtgttagaagatgaaaaaaagaaatcctcaatcaatggtaacagtccgaaacgtcaattggctccaagccgtacactgcagactctcatctcgtgcaagaatgcctcgcaagatacaactggcttgtagtcttcgtcttcccttccctgaactaagtatatatttcaaacgcgaactgatatattcttccttttcaacaaaaaccagcaaatggctatcacgatcagactggcgacaatagaagatattcaggctatgcagaatgctaatctgaccaatctgcccgaaaactacaccctcaaatattacatgtaccatattttgtcctggccccagttatcgtttgtagctaccactacggggaatgatctagtcttagacccaacggaagagtattccccagatcccaaacaagatccccaatatgtgaacaaagacgaaaaaattgttggatatgtgcttggaaagttagatgatgatccagacaagcctcctacccctattactggccatgtgacgtctctagcagtaatgagaacttatcgtcgtatgggaattgctggaaaattgatgaaacagtgtttgtatgctcttgcagaaaactttaaggctgatagagtgtctctacatgtcagaaagtcgaatagagcagccctccatttgtatcgtgactctttgaagtttgaggtcttgagtattgagaaaagttattacaacgataaagaagatgcatattatatgaagaaagatctagtattagaggatcttgttcctacaaaagattatgaatatcaggatgatttagagagtgatttaatataaaatagttagagttaaccattatactcggattgagaagctatttatgccctaaggatttaaaaggtagaatagtcaaatggagtataagaccgccatatattttattccgagaatttattctatgggcgtgcaattgttgtcgccaatgtctgctctataccatctgcctatccatgtccagtctactagttcgattgtaggttcaacaatgttctgccaatatactcagcctgtgacatttctcttcgatcccacttgagatttatggaagactcaacgaagcggcagcttcttaatagtttgatgagagagccagattttccaactgggtcgttttcagggttcaattttgaatagtcacataatgtagctaagactcccccaatgtagtcttcaaactgaataaaacagtagtgatacgtatcactatcattattttcaggaaaccagattttacttattctgccaaaacgactcattatgtcccgaatctcatcctctgtgaatattccttgtatcaagttcttccacttcaatttgacaactacaggagattccacctgatgggtcacattgggtaaatttaggtacttgctttccctccgtctccttagttttaagttctcttctcgtaatatagcctctttgtaagcattggactgctgtgacttcagattcctaagtaactcttcttcagcctttacaagttcattctcaaaccgtttatctctttcatttagttgtgatcttttctcatttctttgtctttttaatcgtttatagctatcataactattcctgagttctggagttcccaaaatctttaatgcggtggaaatttgttgaaatctgacgtttgcctgtggggtatcattcttatccgggtgatatattaatgcttgctggcgatagcccctccgtatatcgctatcctgactatcttctggtacacccagaagatcatagaggtctatatctctatccagaacctgtttgagatcttgatccattaaatggtaataaagtattccctgataaccgcgattatgacaagatttctatagtggtgatgtaagagatgccccaagatttataggattggaaagagatttagtagttcaaaaagaaataattaacatttccattatagtcatcatggcagtgaaatggctattattttcctctgtgctttaaacgagcttcttctgctttccaataacgcttaaagctagcacccatagtatagtcgtcccctaaccaggaatctccactataaaaaatgcagtgaaaactctgctcctttccctgttcaattaatcagtcatagaatatatgccttttcaaatggtaagtcgctccgatagtcaatcgttgttatgatgataaccaactcagctcactcagaaccacgtaatgctgagaactgttcctaatccaacaattatttttctgatagtacgatttgacatttcccatatctgtttttatttactaaccgtttaagcattattctcactgagtataccatgactatgtactctatataatcaattttacgattgcactacagttgcatatatttaagcttgcttcccatgtgtctttcagcgtgaccccctttggcttttccttcgaggttcacttcctagattgcccctagcgaaattccattctagcttttcctaacagcttgtttcctttacccatcatcacttacatgacttctcttgaggagttcatagactcctatgatatggaagtcctggcgtcacaattacaaggtgactcaatacagagctcgattatatctctgaaacagcaagatgtcgagttgactaggcaattgcaggtgtgcaatcatttgagctcgttctaccagttattcaataatctaacatttgatgagaacccttctgtgctacagacccagcatttagtcgaatcattcaacaaattgacctaccagagacatcgcttggacgaatttcttgccaaacatggagtggattcgtcaaaattactgattgttcaggatatttctcaacaaactgaagcaaaaaaacagcagttgacaaatcagctaatggaatgcttgaaactgtatataaaaattgaagactccaagatcgagtttcattcagccgttgatggagttagctttcacaaattttgttctttggatgattcgttaaattctagaaggtttcatagagtgtttgaagattggctcaaagaacatgtaaatcaagggctttcatattttcagaacactctgacagtttcaaatgccgaacagtcgttcataaacgtaattgaatcattggaatcttttgtcagatttatcaacgactttgaggaagcgaatacttcaaaatctttcaatcttaaacattatacaagtaaaaccttgtatgatattctaaaaccatacatgctacaccctgagattgtgtttgacctcctgcaaagtaaaatttgcaatattgagaataaaactatgagtcgtttaattgaattgaatcgcttgctggtaactactgactgggttaagaacctaagtgatattgatatttggttagatgatttggtttcccagtggctagacacatctgtagaaagccttatcgaagaactgaagtatttgagccagaagattctgaccaatcaatcttggacagagactatccaggaagtaaacaagcttgaagccggaaaatggcaagttgaaaggagatcctcaaccaagaatccacaaatgacatcaactaaaaatacagaaacagaatgggacaattgggatgatggttgggattcggaaagtgttaatgacaaacgaagtattgatgctcgttcaataaggagcaagagaaatagttggggggataactgggataggctgagtaagaaagatagttggagtgataacggttggaatgacggctggaatgaagagttttctgataatgacaatgatgtaaccgaaacacgctcaaatattcgggctgatgaaccagaaatgcgaacttctaacactcaatcacatactctccggtcctcagtgtctgaacagtttcttcaagtgatcaaacagaaatttttcgatcctgtttcaaaggtttcaagtatggacatcgatcctgatgttaaggacgaaatcaacgatcttcgttccagtaaatcaatcgtgatcataaacagcattgtcatgttatttgactccttcttgaccccacgatatacaacgcctatcctggtctatcaagatctaagctatttgattaatcaaatagacccacaaaaaaattcactaggtgataactttctgagcaatcttattgattccgagtcggattttctctttcagtcagccttacaatacaacgatttgtttgttgataatgatgattcttctgaccgtttaatcgagttggcatctcaatttcaactggattttcagaaaaaagcttcacagttttacgaaaaattctattacaactccaataatttcactgttaatgaaacattaaatattacactgatcctgaccatattggatcaatttttacagtctttgagtgatttgattttggaaagagaatctatcggagacgaagaatctaaaatattggccaacgtactcataataacacttcagagtctcttaccatcaaaatatcatggaaccactgatcctttagctgtcaagattcctcaaaccatcaaacattaccacaagattcaaagtattgcattcatgttccagagttctatgaaagtcatcctagacgagttctacgaagggtcgctatacgatatggaaactaacgaactaatcagactaatcaaggcactttttatagacagtgagatgagatcagccacaattaacgagatagtggatgttcgaaccacggattaatgataatccttttggtattaggtaatatgtgattatataagcaggaagataacggcccaattagttcggctttttatccgacgtacttaaaataagccactccttattccttactaatcttcatagacaaatgtctgaccacaagtatcactttgacgtgaaaatgtcctgctctggtaggtgaatatttcatttgttttattgggaaatgcaaactgttgctaacaaaataggctgttccaatgctgtcaacagggttttgaacaaattggacggtgtaaagaacgttgacatatcattagaaaaacaaactgtagatgttgtcacttccaatgcactaggttatgatacagttctgcaaactatcagtaaaactgggaaacaggttatcggtggaaatgttgtagaatagctgtgtgtatgcatttacctcccgttataatattaatttctttcaactagtcatatgaaggccgcaatttgcggatccacgtagttgtcgatcttatattgtagtattcctcctgacgaaaagtcagtaattccaattgtaagaacctgggtgttattctctgagggtatgaaacttagtccggtgattttgccaatacatgatatcggttggtactgaagcggaattctagaagatgggggtgtcggtgggcacattaagcctgggtctatgttttctaagccgcctgattttagatctatcaggtagacattatctatgctttcagcaaatgccaggtaatttccggtatcatcaaacttcaagttccttatggccccgtttagcttgcccgaaaaagtaaataatgttgagtttccgctaggattttttgttgtgttagatagataacgagtgtcatatatccttactgtgccatcctggtttccagtagcaatgagatggttgatattccaatctgaagcaaatgtatagtcataatgtcccgtaagaattatcggtagagctgataatttcggtaatcgtctgtctatgatgaaactgttttgggtatcaccggagatgagtacttgactttgttccgatactggaccttcacaaatggtattaatagcaaagtccaacttatctgctttaataacttggttcgttgtgtaatcgaaacttcggaggaatttgtcatttgaggatatcatcaattggtttgcaaacgagcggtgtctggacatcagaatatatgtaattattccatccaagtgattggtcaaaaggtattcctgaaatctgttggtatgtaagtcgtaagttaaaagagttccgttaaatgatccaatactgatcagtgatctattggcactgatggtagagatcttcaagtcagcaaactgagagtttaccagatccaattgggtataaattttgtttgtctcagggtctaatctcatgattctagagctttctggtccattttcaatgtaaaagacactatttttgtcaacacagtaaaccaagtggcggagctggaaatgggtcacatctggtttcggcaacgtaaagaacttgtgaaactcaaaaagaggttggatttgcataaatttggagtcataatggccgctgtgaggctgcaatttaaaatccacggtcaaattggccaatcgatgtgagtctggtagatgggtataactgtgaaataagttgcttctttggctcaaaactttgtttcgaagtccttcagacggccacataagtccctgactatctatcatagctctttcaggtagagtttgttttattttttgaatcaccttcctagtaatttggtggttgcaatgctcaagatattgttctctctcttcgtaaagattaattatactgctaagctggtctcctttgagtaggttgtctttatgaatcaatgatttatagaaaaactcaaacagatcattttccagctcataatccctggcttgtagctcttgtggaggtatatccagaaacgaatcctggttcgaccataaatgttcagtgttgagaagattcatgggtagttagctatttttaagctccttcgataattgtcaagccttatcgttttttaatagtcgccttggttttattttttatttccttccttggtcttttggtttgagtggttttatttctgattgtcactacctcaagaacaaatttggagtgattctcactagctctatctttcgagagataagatggcctaactgaaaaactctctaagtaggaaaggtttaccaataaaggactacatgcttttgaatctatatagttgagccaatcaggaagtctacttcagttcttgtatactctgaaattcctcaccaatttttcttattagaacttctttatctttgaaataagactccttccagtccagaatttcctcccttgagtacggaccataaatttcatcgtatcctacatactgaaattcatatccatcgtcatttgtttcattatcagcatcttccaaagtacgctttactcttaattcctgtccagtgagctgagcatatagtctcattaattcttcccgactcatattgtatccgtcatatccctttttccctagcaaactgcagagatcaaccgtctgtgtaatagcttctttgttcttggatttactgagtctttgcagagcttccatgggggtttcggaaatttctaaaaattgtaccagatcattcaacactttcttcaaatcaatttctttcctctcctgccgtctcctttcaacagctaatttcttcttcaaaagccgcctctgctgctgcgttctagccttctcaatgactttgtcgtcgtaagttacctcttcttcgttgctactttccgagtcaggtttgttagcaataaaattaccattctggtcgaacactccctccttcaattcgtcgtccagatcaaaagacgtgagctgaacttcattatcttcatttaaactatgtgtattttgtatttctgtgtctctgaccacgttgatctctccatcctcatctgtctttcctatcagctccaatgcatcttcattcataagcttaatgtcatcatccccttcctcttcatcaagggaatctgattcatatcctggttgatagctgagcttgactttttttctatccaggttttccaagtacgggtcgtcttctttatttggggctcttcttggccttttctcggttaggctaaccatctagatgttggaaggaagaaatatctgaggcaccctcgaaagagataccatgtcccttcgaggagggaaggaactacaattaacttcaccatggatgacccgtttgagagtgttctctccttggaacaacaattttaccaggatggatacaatgaaggataccagaaaggtgtggaaacacactttaaagagggtaaagaatatggagttcaaacaggcttccagaaattcgtatttctaggtttcatccaagggttcaccaagaacatattagcttcagaccaagagaacgtcaaagtgaaagaaaacgctcttcagatcgaaagtattttagagcctttacaagatcacacttctaactctgatgctgaccatgaactccttgaatccgctcttaaaaaatgtcgtaataaactgcgggttatttgcaatcaaatgcaacataaaacttctctgagtcagatggaaaatttgtgcttggatattacaggaaaaattcctggtgagattttggaagatgcttggtaaacattttagtattcactttggagatacacacttatatcaaagttcacgctcttggctatgcttttgatgatgtcccaactaacattacatttccaccttgtatttccatctaagacatcattactcgactttaggatcatgtcttgagatgctagagttgctaaagattttaaaagatccacgtcggtttgaagttcaacttctgattcataaatggcatgcaagatcgccaacaatctctccaaactaaaagcatttggggtcaacgtctttacagatttctttttcaacatgggctttttacgtttatcaaaacgtgcgtctctgaactttgagaaaaagatcaagtcattccgtggatcgttaaacgacgccaaatacgatgccagcaggatgtacttgtcataaagtgacagattaaataaatcgtcatctaacagagcttttccctcttcttcattcaaaacactgcaaggaatggcatactcaggtcgaaataaagatttaaactgtctgaacactgatatagcatcactcttccccatcactattctcccgttagtctcaatcaatggacctttgaattgcacccatattttatcaacaattttctccagctctttgaggtcagatgcgagtacgaaatagaatgaatctactactatgccaaggaacgttgttatgaattgttgctgtgatttaagtattgttgtggacactagttgttcgtcggtgaaatttttcacttgttcatcaattggagcgttcttctctagtttagcttttgattcttgtaatagttgattttctagcgtggtttgtttcattattttcaaaatctctttagtctcttcaagagtataattaggaaagtaaattgtaggaatcccaatggtcgccagtttttctggaattaaggtacttataacctccacaaagtgaacgctgttcaagcattcatccacttctgcttctttagtcaaagccaacagaaaactctctgtatcttccaaacattcatctaacttctccaggataataaatattggcttatgtaatccgttctcaattacctggacaattgtgtcaatgaaactgttgatgtcatggcaagtggaagctgggttcgtctgccgcacttctcctgccgtgtatttgcctttaaagtcaaagtccaattcgtatatacaattgaggattctctgcattatcatttcagtggacaaacatgtttcacagtctatttgaattattatggaatctgcttttgtctccaaaaatttgtttagaagaaaagatttaccgacaccgcttccgccttgtagtatgacattgttaaacgaaacatcatcgcctaaaaagcactttagtagctgccattgagggtctctaaacatggaagttgaaatgttcaagagcgatgagaatcaaggccagcgatcgcgtcaatctaggaagaaattcaacaaggtcggaggttcacatgagctactctttcatggtttgatttttgtttcaatttctctatattacacagttctatttgcttagctattctcctgtagtggtgacttcctttaacatgttaaagtcgtagaatcttgcaacggtgtggaaagttttcattcgctttacaatgtcacctcgattaaccgtgccaatccaagacccagagcacgaacagtacaattgtagttcagaacttcgaagtttgtggcacttgctacatttcagatcctggttataaaaatgcaccagcaatttatgagcatctgcgatcagcctctcttctaatgcaagcttattgaaccgtctcttacagttctgacagttgaatatttcagtctcagtatctcggcatagatctaagtctgttatgtgattgcaaatttcacaatgaacattgtaaagccttagtgaagctgatggattcttgaaagttgcctcagcgctgaattctttaacgtcaaaaagttttagaatatttcgtcttaaaactctcacttcaatgtttcggcttttggaaagtgacaaaatatgacagaggaatttgacaaattcaagtgttggatctgacaagtccaactgtgaaccagcaagctttgggaattcatactcggcttttaatgctggattcaacaatgttcgcagttggcgttctttgagcgtaatgattcgtttctccagtacgttaccaaacatatcaatgatattgttctctggcttctcataaacgaaatctgtagaaagtgactgttgttgattttgctttttaagaatgtgctgtatttgagtttgccgaggggttccattagattgtgatccattcaaatcaagctgcttgcacttcaagaatgaatccagtatcaccacaacccagtcctcaaactcttgttgcagcactggaggtaaaaactgttgtagttgccaatgattgataagttccaaatcttgtttctcgttggaagtaatttcagcacagccattccctccataattgtattggtccatccaaatcagcatatcccagtaccgcaccacttgaaactctaggtagctaaacattgattttgaacgcacagtttttatgatatactgaccataagcataggagttttcaaccagtaatttggaggtttttaggactatcttgtttcggttagcaaaaataatagtggagcccaatctcttgaattctcctagtaaatgtaataatgacttcttggtaaggttgtagacatgataaagcagagacggatcgtacagatatgaagacgttttctctacccacgacatgaaattgaacaccataatgtcggcatcgacattattcttaagagcatcatcccaccacgacttcaacaagaatcgaagagcctgcaatgcaggggttgaaaaaatatcctctgcaaaagacgttgtgttttcattatctccaatttctaaaccttctgcttcgttgatcaatgctgaagtcagaattgtattgattgttaaattgctcaaattgagttccaaacacacagtctcatagatctcaggtttgttgatggttggaaactccagagacttttctatgttagccatcgattgatctagctcgaaaccaccatggtcaggtaaaggattgggagaccaccatagaactatacccagctctatgagtttcctggcatactgaatgtcaatcaaataacttttatcctccacattcaagttgcataatggtatgttaccatacctcgccatagaaatgagatcctttaacccagctcctaaagatagataatgatttattatcttgttgatgacagaactcttccatgataatggtgacagattcaattctctcaaattcattgaaatgacaggttgttcattcaaattcttcaacgccctgaccagtttagtacattggttggattggatcaccatcaacgatttggagcttttctcttcgttggcttcaccgcatttgatatttaaatttcgaagtaatttattcttatctgtgaaatctacgacatcaaaggataattgctcgtcatactgaataatggtatgggataacctttctttcttagaccgataataatcttggtatactgattccatgtttcgtggcaatgatgatgctgccatgttgggtttcaacacaagaacagaaaccgttggatcccatgatttgaacaaagagaacacttcatatccattggcaacaatgtgaattaagtatgtcacattcaagttgaaatgacttaaatatctttctgaaggtaaggttgtaaagttgttttgattgaacccattttgcagtgctttccctaatgccccaacttggttctcttgaaatttgacggaatttccaagctctacaattattctttcagtacagtctatttgtgattcatagacacatttcacatcttcgtgctgaaagagtccattgcaatttcctcgttccgcgttaaacttctcctccgacatcgttagcttgaagagattctcaactttttcacccttggggagatggttagtggacggttcgacagtacattcatctggtatgcttagtgatcctaaatcagtcgttttgagtcccaggaatacttttttaggaaccgcaatggtgaatgtttgtactcttccatctatgaacaccaacgccttaacttctccaggcttacaagttgagtcatgtttgtattgcaagacttgccaactagatccaacgtacgattcagccttctttctcataatattaccaatagttcctcgggttgcggtattggcactagccccgaatagcttccttctccgttccctattttgtgattgaagtttccacttcgccttttgatatttcaagaatgagccataatccaccaattcattaggacagtcttcttctaacagtttctgctccttttcggcaattcttgactctaattccttttgctttctcttacgggacgtgacttttcccatcttgcgagacattccattagtatccgcaccaaaatcttcgatgtccttaaatctgtttgagatatctttcattatgtcggagtttgtagtctttccaaaaaactgagccaaactactttgcttcttactgtcgttttgactgttaacttttttctgtagccattctgggtgggcaattctaggaacagggttggaaatattctgcagagctgccggaatagtaataattttctgtacaacagaggccaacctttctgtgtaatattcccagtctattatggttcttggatcaaaattgtccaaagagttatccccaagccaccttctcaggaatctctttttgatctcggtatcagaagaaaagatagtaaccggtacagctctttcagtgattggagcattgagaggtcggttagcaataacatatttacaagccaatcctttatccttgaccatttcctctcctaggaactctcctaaccttcgagcagtagtaattgatgtggatttctgagttccatactcagctaaggttttactcatgctccggttctcacaaatcagttcaatcagatcttcatcttcgacgttgacacctttggagtctagcacatctaaccaccgattagcaacattagccacggtttgataacatccttccaaagtgtctccatgtaggaaaagtttgaatatatcagattgaaagttcttgattagttgtaattcacctcgtcttttcaactcaaatccttttagctcagccaatgaaccgtcaaagttgaacacagcataacgctttttaagtcccttaccttcctctttcgaagtaggaaggatcatggccttatagggaccatctaactcaaagaagatagaattgtcagagtaagttttatacttgtgagtgaccggatcaaccaattcttgatactggtggttcgtgaacttttcatgaaccaagaagttcaacatagaacaaggatatgaaacagtaagtgttttaccatccttcattttgaaatcaaagtcctctgggaacgatgaaggaagaatacaccaaattccgtcagtatcaagttctaaaggcctacccaggcgctcaaccaacgatctggctaattgaataatagtggcaccagtcagacaggtaattccagccatttccacggaataccatctggatccctttctcatgacatacccgtagaatgaattaagaataactttatgagccaattgtaaactatcatataaaacaatcattttcttggcctcatccagactatgtctatcatcttttggtattttggatgcttttcccttccaaactttggcaagtcctttgaactcataccttctgtctctaaatgatcgcactgtattgacatagaaagggttttcccgttggcagacaatagcctccttctctatagttttcgtctgcttgattctatgataaacttttcttgagtactcacttaaattgcttttaacaagtgcagctctttgaatatgagaaagttgatcaaaagtttttctgggaagccaaggtttatctggcgcaaatgtatcgttagataaagcatgttcgatcatcttatactcactatagtctgcgggataaaactcacccctccatgcccataacaaccttcgatcgcaagttttacctggtcggttgaagtcacactcagcacagtcttgatcagtcttcatcgaatcaggttgcagcctatttgttgtcataatattagggtacattgatgccacatcaacatgatagatcaacggagcttcgtgtctcttaggattattctttaattctaatagctctcccttgatcttatcataaatttcatcatagtttgtaatgtctttcagttgtttcttggattcaacttctatcgagaacttcaaagattggtccaatgttgagaggatctcatcaatagcagtgggatcaattcgaaaatctgtggaaatgtctgatctaaacacaccagcttctaaagattcaacgtggcctccaacataagtttcagattctatcagatggccttcataaaagcgctcaagtgggtcagtatgcttattgggtaataggatgttgttttcataagcttgtaccattaataacatctcacataaagttccagttccttttctaagaacttcatctggattcaaaggaatgattgtacagagagaaaaaacaaaaggatgcacatacttgtaataaagatagtaagtggccacagcatcagaaactgagtattcagctaatagctgaggtttctcgtaagcatatggagtcatcagttctgggtctaattctgtggggttataacctaattttactgtggtaacggcttttagaccttgagaaccttggggaagataggaatcacgtttgacccatctataacagtccatatggacacagtacttggacttgtactcatcttccacatccttggcaaaaccaatctcccgaaacatgtcaatgccatgaaaaaaagcccttttctccacaaaaggccaatcaaagaagtcaccgttaaacgtggcgatgacagtgggtctaacttctctgatatgctcaaaaaatctttcaatcaatgctttttcatctggctcgttgaagatcgtaaaaagaccgggatactctggcttgggagtatattcaaaatcttcgatctcagcgttaatgatttccctattagtgattagaaacccttccccgtcaatcatataagaaatcatcataatttgatcgatactactgtcaggaaatttgagaggggcctttgtagtttcaatgtcgaacgccaaaataacagggtccgcaaatgcaattttatccttcatttcggtgaatgagacttgggccgagtcggtggcctccaaagtataccattttccgatacgataattattatcaatagaaacccgaacatggtacggcacgtcgtactctcggatatcttctaaacagtgtgcaatgtccaatggttttgatttggactctgtgttgaaatcaagatcttcttcctcattcagcagattgtaattcaaatcagaattgtatacatctctttgttccttaaataattggttttgtttcactatcggagctatgatccttcttgcctctaaaagattggaaatattgtgaaaggaaagctgaatcaatgttctcttcaagcctattaaatggttgggtagtgataagtcatctttctcgacacggctagcctttttcaacaatccttctaactgtttcctcaggtactcttctacctcagattcgtatgattttttacaaatgacaaaaaagtagggatcatattgttttgttactttgaagccaccgccctcttcgtccaggaagtagtaatcgactccagagtaaccttgcagaaggtcttccgatgggatagttgtggtatgcatgttgatcagccatcctaccttcttaggaccactttcgtagcggtcaaacccaaatacagagtcaatttggtcagcttcttggaccagggaaagctttgtatgtgcattttcattgttgaaattagagagtagttcttcttctgaccgcctttgatatggttgagaattgttgccggaatttttcacgaaccgagccgatgttgaccctttgaactgtgacttcgaagacattaatagcagaagtgggcttaggtttcctggatggttttattacgcccttctgaaggtctgacctttctagataaattctaacgcgtatttatctaagacaggcgcgctttgaacagatctggattaaattcattaaaccccgatttgtgaagcttgattcgtgttattaccctttccatcagtcgagcatacttgactggatgttgaacttgacctatctcacctcaccttaggttcaacgactaaacaacccagctctaactagcaaacaatgtacaacgcctttgacagttcacgaggtaatcagggtaaacaagccaatggcaacccctatggtcagtacggctataaccaaccttcggtaccccaaccagtaggtcagaattatgcttctcatcagccttctgtcagccagcaacaatatcaaaacgagccattctctcaacaaacatatcctccccaacagccacagcagcaccagcaacaacagcatcaacttcctcagactgcacctcagggtggtgcccaacagcagccgttccaaaactttttccaagatccatcatctgctatgggccttcaattctcgcaaactgcccttaatgcctcccaacaatatatgcagcaaaactttaacagtatcatgcacactcaggatattaagtactattttcaagtatccaactcgtacgtggtacgcaagctgggtctgattcttttcccctatagaactaagacatggacaagaatttaccataatgctacgccagttggaggccctggttctactgggcaagagatttacgccccagctactgaagacatcaatgctccagatttatatatccctctcatgtcgttcctgtcttatattctggtgtggtcagtttttgcgggtattcatggagactttcatcctgaattattaggctatgcagcttccaaaactttggcattgcaactcttagacctcgtgttgttgaagttctgtatatacatcctgagtgttgatgctaaactttgggatcttgtggcttacagtggatataaattcgtggcagtgctcgtgatattgttgatcaagaacatatttgcactacaatcaagagctgctaattactctgtttactttgtgtttgctttctcattgggctttttccttatgcgttcgttgcgttacgtggttctttcaacgggaattcgtgctcaacaggtcaacatttctcaaacaaaatacagaacaaattttttgtttgtttactcatttgtgtttcagggtttgctagtgtttttcatgacttaatccctactaaattgattactcaacgagtacagtgcatactgggatcttatgtcaattaccccaagccactagagccctcttaccaaatcatctcgttcatgttaccctcctttttcaatgcgcgcgtgcgatatttggaagagagaacactttctctgcttttcactgcgttttccatttccttacctatgcccttctcagtatagagcacatccactgctgagtaagtatatctccaatgtattgcaaaatgatgataacgagtcagaagactccatttataacccagctcattcgataatctgttcatgagacgaaacctgtcaaatgctctgattttgcaaatattcaaatttcttcaagaagaaacataggttactaaccacataatgtttagttgtgcatctcttatataatcaaacatcatcattttataactttgaatgaaacgaagatactttaacactgtgtgagttttttctcatcgctttttccaagatgtcggatctcggtaactatcacttctccggagttttaacctcacttgcaccccaaacttgctgtacctgacccaacacactttctcctctctactagtgcagtaactcaaaatcggtgtttttcaattccgactacttcacctaattcattgaaaattatgacagcaagtggttacgctaatttcatctatgacctttttgcctggacattcctcatcatctttgacattttcttcagagatgtgaaaacacggggagctttcaacatcccgagccaaggtccggtaatccttgtggttgcacctcattccaatcagtttgtggacccattgatggttctaatacaaacaaagaaatcgacagggagaagaatttctttcttgatggcagcagcttactatcgaaagaaatttatcggtgacctagcaaggctaactagagttattccagtagaaagagctcaagatggcttgaagcctgcctctggtacaattcattatgccgattttgagaaagatccctgtctaattgaaggaactgacacaaagttcacccaggagtgtgaggctaaaggactgataggtctacctagatctggtggatttggtaagatcgcagaggtcctaagtgacactctactgagattgcacaaacctttctcgtcagatagagctatcaaaattattaagggctctactacttacaaaactgcccccaaaatcgataattcaatggttttcaaacatgtctttgatcacctccatagcggaggtattctaggaatctttccagaagggggttcccatgatagaactgaacttttaccacttcaacctggtgtggcactaatggcattaggtgctttagccgaaaactcagaacagccaattacaatcgttccttgtgggttgaactatttccacccaaataagtttagatctagagctgttgttgaatatggaagtcctatcgttgtgggcgaggaacaagcaagggcctacaaggaagattctaggaaggccgttgcggaacttttgaaaactatatccacaggtttgaaaactgtgacagttcaatgcgaagactacgagactttgatgattcttcaggctgccagaaggctttaccagtaccctaaaaagaaaattccgcttcccttagttgtacagatgaacagaaatttaacaatcggctacacaaaatttaaggacctcccagagatagtgcacctcaagaactccgtgcaaacgtacaattacaggttgaacaacttagggctgaaagatcatcaggtgcaaacagtaaagtttaaacctttcaaagctgttgctttgctggcgtatagacttgtgaagttactcatcctagctgtcctaagtcttcccggcactgttctgttctcacctgtcttcattgcttgtaagtatatttctcataagaaagctagagaagcacttgccaactctgttgtcaagattagggccaacgatgtgttggccacttggaagctgatggtggcgatggtggcagctccttgtctctatgctttttattccacgctaggtacattcttgattttcaagtacgatatcgcaattgttccctatcaaacaaagagcatagttgttacttttataactgcatggatcatcttggtatgtacgacatatgctgcgttcagaataggtgaaatcggaatggatactttgaagtccatgaagtatttgacatggtccttgcttccatccgaggcacttgaagagttgaaagctgaaagggctcgcctttccttggaagttactgaagtctgcaacaatctaggtccaaaagtgattccagaattcgccaaggatcttgaaaagattgaggctagcaatgaggagcaagaggaagaggagatagaagatgaggaaaaggagcaacttttgaacaagacgcgtcttggaagggcaccctccacttcgtctgtgaactcccttaggtctgttactagtagcactagcatgccttctgagttaggcgaggtggccatatttagtgaactcccaactagctcccggggctcgatcagaagccgctcaagctccctatcagaaagcgaaacgacaggcctgtctacaggaattgaggccaagaacgtcaggtccaagattcaagaacggatcttccagaaaatgcgtaacgaacaaattaatgaaccgaagtaatgaaaatagtgcatcaattatcatctctaagaataacattatattttattttaatcttctccagcaggtatctcatccttgagtattttgttcaacctcagtttgatttcagtagaaggatcacccctcaaaatatctttgacgaatgagacgtcaacatctagctggaccatctgtagggcacctttcaatactccgaccagtacgtttgagtaccatagctcctttacagctttattgtcatctggcagttccacaaactcggcaagaggattgtcttccagtattaaattgaattgtttgccgtcagcagagaagttgtccacagtcggtgttgtgtttaagaacatcttgaacccaactttgctgattatctcggccgtttctttgaagttgatgcaacgtccaaaattagttttggccaaaaattcttcgatcagcctaattcctatattgtatcccatactttccaattgttcatttacttttttataatcgttattgtaatcccggcataattgagccaccacggaaccatatgtcaaagtgaacagttcagagttctaaaagccttgttagacgatgaacttgtaccaggggatttgtttgcttcaaaatacttacaatcttttctgtcctattcttataaacatcctcacctatcagcttgtagggtttagacattttgaaggagtaacttgggaagagtaaggtctacgcaatctgtagaggacacacgcaccactctgactttccgataattgaacttcgcgatgccggatgttaggtgctgaattttctagtcgtattggtaaatagtctatgtatcatcgtagctcttctgcaacaggttgttgagaatatgctcatatttgccatgagtagctttatttgcatgctgaagtcttttttctgctttggaatagcagtcttcttgttctctgctatcgacggagtgtagatttcccaaagttacataggcttctgcaacatcggcccagctctttggatcgtcggagtattcagctttttccaggtattgaattgcttcagtaaccaattggatagcaatgtcacgagcctgatcagcttgtagaccattgatcccatcctctttgtcctcaacatctgaatcatactccagggtggtaaagatggctgagggctcctctgcctctaaaagatatgactgacccaatttcttgcaaacatctctatgcaagttaccaattggcaaagatgagtctttaagaatgatgtcggatttctgggcaagcttttcaagatttttcaggaattctatagtttgagttctccaccaaatatcatatttttcactttcccccaaaggtttcaaaggatgagattcactcagttgaagactatcttcatcttcgtcaaacccgagctcctcttcatcttcactatctatcccttcgtcggaagatttcttctttccaaaatcatcaatgatgcttagcagatcatctaaggagtcgagtactctgaaggtttcttggtcaaagagttcaaatcgttcagttttaatagcttcattctgtgctgcttcatagcttttaagagcgtcgtctaaaacttcgagtatatttgggtatccctctgagctggactctggggtcattttggaaatgtattccagtggaactctgttaaaaataatgtgagcctttgagaacaataacctgggatcctctttagagtgacttaaaccaagatcaattctctctagtgcttcgtcaaaatatggcttgacatcgttctccttagctgcgtgaaaaaatgctaactcgttcagagctaaagcgtaaatggcgtgaaattctccatttaacttgtatttattcttctctgtttggctgtttctcaataatctatcgcattcatgaatgataccgttcaagacaagctcgttgtctttttcagctcccaagaatgttttccacagggcaaatagctgagatacctcatcatctgcgtcaacctcctcgttcagctctacagtaagttcagaagcatttgcactagagccagactcagcaacgccatcttcatctgtcttttgcttcttcttctgtgcggactttcccaatccaagcggtcttttgggtggagccattagctgataatcatacaggaaagtaagaaaaaagaaagaaagttttgacttcagcctcgcctcggctcgactgtctcccctattcttgcatctgcttacataagttgaaaagtcgcttggtaacatacggaggagatatcaaggttctcatctatctcgcatgccatacaaatcacgtgcgattgcatgaagcgatgagtaggcctttgaaaaaaaaaaaacagtttcataagattaggtcttcgttatcctctatccatacccccgacgatggccaaactattactcgcagataactgccaaggtcaaatccatcttgtggtgggcctagagcacctgaatttgtgtgtttcaagggtgaagactattctggaggctggagccacaccggttctagtttccccacaaaagtccacgatgctggattctcttcaagatctagccacccagggcacattgaaggtcgtagatcagaccttcagtatctcacagttgactcaattggggcgagatgaagtagataatgtggtagacaaggtgtttgtggtcttggactcgcaatacgcccaattgaaaaaagacatctcggctcactgtagaaggctaagaattcctgtttcagtggtagattctccagaattatgcagtttcactctgttatcaacctattccaatgctgattttcagctgggagtgacaactaatggaaaaggatgtaaattagcatctcgtatcaaaagagaactagttagcactctaccttcaaatattgacaaggtttgcgaaaacattggtaacctaagacacaggattcagcaagaggatgacgatcaagtggaggagatttacaataggttacaattgctaggagaagatgaagatgatgctattcagacatccagactcaaccagttggttgaggagtttaacatgaccaaagaacagaaaaaactacaaagaacgcgctggttgtcgcagttagtagagtattaccctctaggaaaactggcagaagtttctgtggacgacttaagtgctgcatatcatgaatctagtaacaacgttgaaattgctcagaatggaactttcgaccatgcgaagaaaggttctatatcattggtaggagcaggaccaggagctgtctcactactaaccttgggagcactgtccgaaatatactctgcagatctaattcttgcggacaaactagtaccgactcaagttttggacttaattcctaggagaacggaagtttttattgctagaaagtttccaggaaatgctgaagccgcacaacaggaactattatccaagggtttagcagccttagatgctgggaagaaagtaattcgcttgaagcaaggtgacccatacatttttggaagaggtggggaggaatacctatttttcgaatctcaaggttacagaccattagttttaccaggcatcacttcagcattggcagcacctgttctgtctcaaattcctgcaacgcatcgtgatgttgcagatcaagttctaatctgcacaggaactggacgtagaggagcacttccaaatattccagaatttgtgaaatcccgtacttcagtattccttatggcattgcatcgtattgtggagcttctccctgtcctttttgagaaggggtgggatccaaaggttcctgcagcaattgttgaacgagcatcctgtccagatcaaagggttattagaactacattagaaaacgttggtcgagcagtccaagaatttggttccaggcctcctgggcttcttgtggtaggatattcatgtgggatcattgaaaagttagagaaggagtgggaagtggtggaaggttgggatgacattggaggatcgaccatactagatacagtgtccaacctttccaaatgactatgaagatagtgaactgcattttatttattgtatatgtattttagacgcattaatagagagccaaaaagttatatcacaagttgatctgtagtgtcaggttgattccatgaggatcaaagtgccatccacccatcctgggtaatcatgcaaaaaatgaaagattggacgagttgggaatcgaacccaagacctctcccatgctaagggagcgcgctaccaactacgccacacgcccattttctcttcggtgaaggctttaaaagattttgacctaatcactattctttcggttttaatactaccataaaatgacagttaactactgtgcagatagcttcatacatacttagacaccttattgataaaaaaaaatgacactaggcgccgagaaccttatttacttcctaattactatgataataagttcaatctataataacctgtgcttatgtaatcattatccgcgtgtttcctccacccataattcttcaactagttttctaaccaattgattgagtttgaccatgttctccaactcaattaggaactttccagcaagaaggtttgctaagtttgctcgctcactcagcgatattggattctgttttgagtaagtccatgtttttcacccctttaaagtttaacaatctgatctaacccttcaatagtatagacggagtgctgctcaaaggcaagaaagccatccctggagccgcaaatactcttcgctaccttcaatcggaaaaagttccgtttgtactattcactaatggcggtggagtttcagaggaaagccgtagccactttatttcaaagacgctgggtgtggatatctcaccccgtcagattatcctttcacacacaccattcagagcactagcgcaagacgaaaggctcaatagagtattggtagttggaggccccggagattcagctagacatgtcgctcaggagtacggattccgtgaagtcctcatgcccattgatgttctagcagccaatgagtctatctggccctttcatagatactctaaagcggagattgcgaacctagccataccagtagactcctcgcatatttatggaccatcggctaaaccattcgattgcattttgattttcaatgacccgagggatatgggagcggatattcagatcgtcgcagatctactaaattcccatggcggatacatgggcacgaaacgtcacgataaaggcgaagttcctagtgttccaattctcttctcaaataatgattttttctgggctaatgactatcctcagcctagatttgggcaaggtgcattcaagatagctgtggacgcaatttacaacaagatcaacggtaccgagaagatgcagagtatggtctttggcaaaccagagaaagtttcgtatgattatgctcatcacgttttgatcgactggagaaactggctaggaggtaaacgggaaccagcatctgctcccgtattgggaagaactccagaacgtagtcctttccgggagatttacatgataggtgataatccggcctcagatattgaagggggaaacagagcccattggaatacagtactggtacgcacgggggtatttcaagatcacgatcttgtgcatgatactgaaaatcttatcgcccggccttcccatggggtattcgacaacgttgaagctgccgtacgtggtgttttggaggatgtaaacaattagagggtataactttgatctaaaaaaaaacaaaataacaagggaaactaaactaattacacttttgaagcgatagtctgctccgatgtaagcttgttggcattccgttcgtgcatctgttccttgcaggtctgaagttccgtacagtggtggttctccaataatctatgcttcgaacagaacttgccctgacaatgaacacaatctccaaccatcctcaatggggcagacatgcagttcaagtaagaacaacgacgcttgttggatgacttcctgcgcacctttgtgatctttgttgtggtagtggcgccagtttcatccttgacggtcgaagataatgcgggaggattgtttgtatgaggagcgctcagctcagctggtgtcaaaattggggaatgtgtgtttgtatcagaagacaccataaagacggtgctagcatctgtaacacctagagacgttagagtatcagccaagtccagttttttgccggaatatactaatttgtagggggtctgcgacctggttgatattaagtctattggagcggctacaagggctgctgtccttaaatcttgaactgtggagttgtctgggacggtgactgagaaggctggggagtttgttagtgactgctgattccaacacgaagtagacggtccctcgctatcgggggtctctatcctatctaacttacatgttcctccggatattctaatgttgactttcatctgagtgatgttcgtttgtatgctctatggtggcaataactgggaagatataacgtaatgtgacatttacgtcatcgcagcatcggtgattcgcgggtccgtcccaggtaatttctcaattccttatctggtggcaattgtcttgagccgaatcgggcaagtcggggcacagcctgtccgggtaacagaccaagaaaaacgtccagtacccaatgcagtatattagggcggtgactaccttaaccattcttctgagcatgggtttgagaaaaaaaaagtcacctagcctcaacctagtctccacctcttccaagacagtaataaccaatggatttctcaaactttgccaaaaatgagcccaagaaagagctttccaagttcgagcagttcaaggaaacccctgcttaccaggtagggcttaacgttggtctgttcgctctaggtgtcgctttcatccagtcatctctgatggatttgcttgctccccaaatctgaggtatagaccattgaaccaggaaaaaagagcccaatgttctactgatctactacgaaaatggtcaagagaagcacgctggcgttttataacttttgtaaataatacagggctaatataataaacttatatcgtcatctaacgaagtactcaaagtaagacggaagtccaaaagggaacaagatgtgaatatcttggcttatgacgaagtcaaaacgacataaagagcgtgcaaaatacctgggaaccagaagaaacaacagagaataatgttgatgagcaagtctcttccggcacctttaaccataaagacagctaagaagggaagaaagacagctggaattgaatgttagttggactcattgcagtgatttcctccaaattaatgcttaccgattataactgtgatgatctttgtgctgtcaaccattttgtttgcgagtgtgaagataagtaaacaacaatgtcaccgggctaactggctggagatgggttactccctgagcaagccagggctcgtaatttcttggaaacgcgcatcaatggtggaccggagatgagctgatgagatctgatgcagtttggcgagagcatacgattcaccgagtgagtgcctcgaggagtagatccttgggaatttagatccactggagttccggattcagtttgttttcagttttgaaagttgctctcttaccttggttcaagtctcttatgcttgttcattaaagggtcctcctcggttgtcctcaataagaaaagcgtattgggaaactcacggcgactatctcagtttgtcctacattaaataattaattcctgctcttaaaagcagtctgtacatctttgtatttcagtatttatcatttacattagttcttaatcaccttcttgacaatctgttcaacttcatcccaatcgtcagtaggaacacgagtcatctccacatttccaaaatactttcgaatggccataagttgctcgtatgatgtcctgtcatgcacaaaggaaatggaaactccaactctaccaaatctaccagttcttccaattctgtgcaagtatgtcgaaggatcagcatttccctgtctgtctactggaagatcatagttgacaaccatagataccgatgcaatatcaatacccctggcaagcacgttagtggttatcagaacctttgacctaccttctctaaagtcatcaataagcctgtctctttcagaactctccaggtcaccgtgtaagatagagactgtgtgtccttcatccttcattcgtttgtataacatgttggcggtttctttcctctgtacaaaaataatcgaggatccgatagttagtaatccatacagctcacagagaacatcaaatttgtgctcctgactatcacaatccatgtataattgtttaataccatctacattcaattcctcatgtttcaactccaggctgttagcattgggcacaaacttaccagcgtattttctaacttcatcagggaatgtggctgaaaatagcaccaattgagctgtctgcggcaagaatttcttgactctaacacattggtctcccaaaccttgcttatctagcatattatcggcttcgtccaaaacgaacaccttaacatttgaagtgtcgatctgctttcttctaatcaaatccagtgtcaatcctggagttccaactaggatattggcagttacaggctgtcctcttggcacagcctcaggcacaaccaattgtgtggtgatcttggtgtatttgcccatttgctggaccacttctaatgtctgtctagcaagctccctagcaggagataaacaaattgcttgaaccactggtttggactcatcgacacgagataacatagttaatgaaaacgcagccgtctttcctgttcctgattgagattgcccgatcatgttacgagcgggattcgacaacaataggggtaatgccttttcttgaattttagaaggcttttggaacttcatggcataaagacctttcagtaattcaggagaaagtcctaattcctcaaaactttttactgaaaatagtggtgagtctggatctgcctgtaaatctgccaatttcaccttaacctcatatgttgatttaatcaaatttgagtcttccttctgctcagcttcggtctttggctccgattttgattccagtttaatagattcttcagttttcccggtttctacaacttcttgcttggcttcaggttgagtctcattatcgttggctttgttcagcgacaaagagttcaatagttcagcggcatctttggcctctctcttttctactatattagcatcattttctactcaaactttcaagctattcttattcctaactttattatcaagattctagaataggagttaatcacaacttaccctctgacatattcacctttttagttcaacgatggagtttatagatagaatcacctaacggaaagttcgaaatattcaaaaaggcaattgccgggtaacacagaacacaagagctggaaaaataaagcccaacgcggggattgaacccgcaaccttgtgattaagagtcacacgctctaccgattgagctagccaggcatttgttgagtaaaacattgctaaatcttatatgtgtaagcgatttttcataacatttagaacttgattaaactatattcaaaagggctttattgctgccccctttacctagtacgtcaaaataattgatttttcatcacaatagagcaaccactactaactttacgagaatttatggttgaatgaagacttgattatcgtgtagcttagctaatactctatgataaatgcgatgtgaggacctcctttttggaaaaaaatggttatacttttattctcttggatgtttcagcagattcggagctggatcttttgtggagctttgtttttgtttctttgattagttttgctttaagagattttttgtccttctttttcttcttgtcattcttgtccttcttgacttttttaactttcttgactttcttttctttcttctccttactttcctttgctttctttttctctttcttttcttctttccgtttactctttttggccttctctctttttctccttatttctttcaagtctactatctgctttcgtaccgtagcttggacagtctcttcttcaactccgatagtcccagttagcccttctccttgtacaaacatgctatacaatggactcttgtctatttttatctccttttgttcaaacttaactttgtcactgttgtaaacttccaaatttttcaactgcacatcaaacagtttttcccaccagacctctccatcattgatatcatttcctaatcctttggtgtccctcttctgctttacaaggataggccttttaaggcctcccttctttaaggcctctccttccttccagccatatgaaactagatacctttttgagtccatatggaggctagaagatgtgttttatgcggaaaaaactgagaaacaataatctgagataatgaaaatataaatattaattatattttgaattcctgttacataattagtaacataatatttatttttttccattatctgaacctgattaagctggtataaaaactctcccaataagcacttttgctccaacactccgttccatcatattcaaagtagatggagcaaaacacgataatacccagaggagaataccttcaattgatagaaaatgccaaaggtgatgagcccgaaagtgtcctagatctacgactcaaatttctttcaatttacaaatttaccacacaggaatggaacagttggttacaggaaatgcaaaccgaaaattttgagaccgtagacttctactttcaattaaggctgaaagatgatagttctccttctgtttggctcaagtacatagaactagcatctaactattcaacattggaagaaaaagtcacagaaatattcaacaaagcgctaatcagcacccaatatcattacacagaaagtcaaattatatggagcagctactggaagttcatgtctgaacagcagaatgttggtgctgatgttttagactctatttatttacaacgacttcaaattcctcattttgattctcaagaaacattcaatcattattcagtctttgtcaccaataacttcaaggaggcctacgattctaaaatgaaatacgcttctaaattgtttaaccagtcaaaggcaatttcagatcgtttggaagactttgagctgaaacttttggatgctcagttccaaccaacatctaaattctggattgggtacattgacagtgtgttcagattgaaaaagttccagcatgcccgattgttggcaaaatcaatatttgaacgagcaacaactaatagatttgatgttttggccattgacatatggagccactatttcaatgtcctgaatgagaaagatattgccttgcatccttcttcagtggaatcatttataaggcaatttccggaacatccgactccttaccaatactattttagtttaactttagatgctcgttcacttttgaagttcagatcacaagcctttcagtttgacatcttcaccccctccaagttcttggaatggaaaaacactgcgtgctcacttctgtggactgaactagatgtattgctaaattctgattccagctctatacccattttacaagacctatctatgttttcagaacttgcactgcaaaatgatgacgtcctccactcccttgatcgaagttgtgtcgagatctattcgcttctggatttattagacgaagcaagagcgttattgcgcaagatgactgaaaaattcccttctcaagttgagatatggctattttcttatcagtttgaacgatcccatgacaacttgactactgcctcaaaaatccttcgtgctggaataagtagatgggatcaacttgattggccacagagattaatggatgaacagtctcgcttcgaaggtatatacaaccacaaggatctggctaaagcgtttgcaaaatcaagccgaaagttacaagagtcatccgagcctatggcttctcccagcatacaatctgaacttgaattagagaataatgaagaaaagagtgggccaccaaaacgagctctggaagaatctatttatacaccatcaaagaaatctaaaagagatagagagaatttatccgttttagtcacatccggaaacaaactagaagagctgtctgtacgaaacttatttcaagattgtggagaaattaaatccgtttttctgagaaataacttagctactatagaattcagcacagaggatggctacctagcagctttgaccaaagatcataaaacaatagatggttttgaaatctctgtgaataaactactcagttccacagtttgggtaaccaatttccctccagatcaactctctcagtcccttgaagaccttttctccgaagtgggtactgtgctaaacacacgattcccttccttgaggttcaatacagatagaaggttctgctatatacagtttacgtcagaacaggcagcgatggatgctgtagccaagtttaatggtaaagtacttaaggattcgcagggaaaagaataccatctggtggccaaaatatcaaacccagaaaaaagatctcagcgttctgatgaaggcagggaactttttatcagaaacctagacttcaaattaaccaaagaagatttggtacctctctttgaaaaatatgggcagattgataaaatatatgtcccttgtgatagtgaaaccaagaaaaataacggatttgcattcatcaccttcaaagaaaaagatgcagcagaatctgctttggagttgaactctgtaccattacttgatcgacctcttgatgtcagtttagctaagaagaagccaaaaaaggtttcagtacttgaaatgaatcctgcacctaaaaagaactcaaagttaacaactatcgaagcgtttgacttgccagagactgttaacagctcacagctcatgaagatcttctccgctattggacctatcagtaagattactttgaaacctgaatcccatagcgccttcattgcatatgaagatgtaaataattcaggaagggccatgctagtactgaatggcaaacaagttgatgggtttacattgaaactttccgaaaaatctacgcagcaacagccaagaaaaccctctcaatttccaacttcatttatacccccgtcacttcagagacgaaaagtttagatttgtattatatatactctatttaatcctttaaagagtttcttaactctttcaaaccgttaatcagctcttcctgaaactgactagatttattttctatgagatttgtatctacagctctggacatgagatactttggatgtgataataggtaacttaaagtagcaccaagagcatttcgttgctctaatgtatctaaacctggaaagaaccggttctgaagttgttcagaatcatttgagtaccttgaccttgatgatgaggacattatctgtttaactcctgaatcaaaagtaagattgtttgagatcatataatctttgaagtttaaggccttgagaaggctatacaacataattagttgacttgtctcttgaatcaggggtaacgatactgatagcgagtctgatgaccaactgtggatacaggtagctatctgttttgcgaaacacgtaacaaaactgcacacttcaggtagtacagattccccgaacgatcccaaaatggatagtattattgacaatagaccattgctccaaatattatgcagtcttggggtacttgtggctgtaatatgtccgttctggatataaagagaaacggggctttctattaagttagaaaacaaccggtttgaaattagttctttggtaactcccttgactgtcaccaactcatggatgaaagtgatagctatatctgccaatattaaattgtccttttcattcaatgaatgggatgaagaatacagattcaaaattgagcgcagtgtgccatgtctaaccaatggttttgcaaaggagtttgccaagttctttggcaaattcatattgaaaaacgttttcagtaacgcaaggttcaaaaggatattctcaaccagttttccaaacaaaggaagattttgatcagatgtcaaagaagcgaaaagatatctagtgttctgacagacgactagatcaaatactcgctcaaatattgtgaaatgctctgcaaaaagattcgtatctttcttgatcaacttcaaacaggcatataaaattcgcaatagaggtctgtacaaatcggttggagagattattagttgcgaaaccgcagagatgagatcggctaaatatttgtcgtccacttgcttggtagtttttgaaaaattgtacacgataaaaaaggccaaatcaattcgttcgtaatatggttctttgaatatgggtgctggaattccatcacgatcattaataagcagtaactgcgttgccagtttaatgaatttgatatccactgccgttgcctttttgaagtacgtagtaatcagtgcagatagtgatttagcaacaagtagctgtgcagagatgtattgcagattgatactggcctgaatgatctcgtttctaaaatctgcccatcgttcatcactctcaaataagtcatctagcaagccaagagcaaatacagagttctcaccatatctctttctcttaaccagtgatgaatgtgcaaactgatcgagtttcattccaggccaattctgttgaaatttttcatgcaaatcgttatgcagcgatgacttatagccttcaatgcgaaaatctgcttcaatagtttccaagaattcgtcgctttcgataagctgaactatcatcctcttacatttttcattattagagacgaacaaaaacaaggacagtatttcggcaatctttgagattaagcgatgctcatagcaagcattgataaactcttggttggtttggggagtatcaatgaggtttcttttggaaattctagttattagctgcccaatgaaaggctcatcatctttggactctttagctgttgtccaggagttgaaagccaaagcgattgcatccactaagtgaagagctaccgaatctgggtactgagataaatcaatcacacactttttcataatttccaggagggaaatagaggcttgctggaacttttcattgctgccatggcctgtgataaacataattgatagaccttcttgatcaccctccattacggcagaaaaaagatcatatatactcactttgatatcataatcaaccagagagtttgtcaaattggcagccaaaaggtttaacaaaagatatgattgatctttacccaagtatgctagcaatgaaggaggttcgttgggccattttgcatttaccaaactcgttaaaagctttgtgacatctaatcttaagcttgtgtgatgatggtaaacatcgactaaagatggtgacttggcaaacatagtcttttctagtatggaaggaggcattccacatactgatctgattgaaagtaaaagttcagtaaatcctatgatagctctattccagttagaataccaaacccctgtaagatcgagagttgatgatttcgttagtaaatcatcaatagccttggtaatcggcttgttgcttctgacatccattaaatcaggcactaaaaaagaatccactattttctgagcagatttggcgaatacggcggtggccttattttctggctcatcgacaccgtcaataccatagacgggcaccagcaactttccaaagacatccacgagcaaagtaccaatctcccacttttggtattcaatctcaaagcgacaatggtagaagatctcaaagatgtgaagcatatgagaggttatgttgatcaaaacttgactctttagtcttgctgaaactctagtatccaagctcaagcatcccacaaccaaagtatccaccattttgattaaagtaatggtaaaagagtagtcacctgaaaccatctcaacagctcccagaattgttgaagcaaatacgctgaacaattgagaatgagataggtatgaccatacacgataggacaaggttctgcaaagagcctggataaacttggcaatagcttccaaaccttgtagacatcttgcatgcaaacattggtcgaacaacctgaaaattacttcaatgacatcggaatcgtctacaaaagtgcttgccagtgcaaaaaaactttcagcactttctggaacaatctcctctgtgactcgagtgaacacttgcagaatcgatatcatagaggcaaccctatcatcttgcaaattgaaattacgagagatgttttgtagaatccgacctaagaaggtccagccgttataatcgtaaataaaaacaaccatattaccactgagtaactttcccttggttccgtctctcatcaaaagtgacaattccttggatgattcgaagggtggaaaaatatcaatatcttgtgttatcttcactaactcaggattctgatcatcaatttcatacttgttcaacaacgaatcttcatcaaaggactccatataagatttcatgcaagtgacttcttccaatgcaaaatttgtatttaatgatgccaagtttaagtaggaaactattgatcttggaaatttggctcttgctagggtcagcaatctttcaaaatactcgtcttggaaaagcttgattagaatgtttctgaggcaatctttgaatattgtgtttaacatctgagaaacttgatcagtgagtgataaatatggcaaatagtgaaggaccagagttcccagagcagtcgtgaaaatagcatcataataaagattcttgtggcaacgaaccagtttttcaataacattttggtcttgtgaaatcttgctaaattgaagatactgttgttgcagctgatgcaatccccccaatgaacctaacaacttctggccatgggggttgtcaggaaaagattccagtaccaaatacttcctgtgcaaaagaatactccagctgtataagacaataggacaacttggagaagtgttgttcagtgattcactgatctgctgaatggacacggcatcgttgaggtaggacttgtaatgatctaggccaccataattgttattcaggtctaggattaagtttgtaataactgataataatgattgaatggactctaaacgactgttgcttatggaacgtttcaagatggatgcaaatcgagacagctccataatcttgaaccatgttacaacctgttcttttgtggctgaatattcagtagatagatacgccaggaagttcaatacttgaacagtcacattgaccttctcattagcgatcaaggatgcatacggagattcttcttcaaaatatcccttcttgatgaaatactcgttgagatagtcaaatattccatcaaatatgtcatcactgtttatcgtcagcctttttgattgtagtagtaaacaccttagctgtataatcaatgcaatttcttgagtaaccaacttgattatctctgttattgaatcatttctgtcaataaccaagtcgacaaagttctgtttacagattcttaaaacctcatgaacgtcaacgtttagcagcctgctcactgtaatacagtattttataattttttcattggggactgggtattgaactcctctaataacattctcctttaagtggagtaactcatcatccttgaactcatgaaagacaaaggggatagatttgctctccagtaaatcagaattcgttttcaaaaaagtgtccaacgaatctaaaatgctggcatcattggacttgctgaacaactcaaaagcttgtgcaaaggtccaggaatccttatcgtcagccattagttggtgttggtgtttatgtttggagatgattttttcctttctttcgagtgttacgtaagctagagggtagaaggtactaagaggcaaagagactacgaagttggaagagaaatataatgcatttcgttttaaccatgataccatggtactggggatacacaaactacacaagagctggagctcttgtcgtttaaacgtggtagtagaatgcaagaatgagcatttgaaaaaaaaggaatgtatgagtcgatgctggatggcaggtcaaggtgaatcttctcttctatgttcgtttttggttctggcatcttaagctgcgcgaaacaataacaaccaaaatatctaaaacctactaatgcatccaatactccggggctaactagccctgctagttattgaaaaagtacaatctgttaacttcctgtggaatctcttcatccttagcattagtcttgaccaataatttctgctcatcaaatgttgtgaacccgggggtttcttccagtgtggcattactaactttaggggcctttgcgccagtgacttttccttcgattaaggctttccagttcttgtggcattcctcgatgactttcatcgtatcttcgtgattcttgaattcaccattgaaagcaaagacgttgctgggtttaccttccggtttcttatagttcttgaaccattctcgagtgttttctaacatacccggaagcacgtggtagatgtcgtaaatatcattaacatctgaagcatgataatcttcagtattgatggtgatgatcttccagtctagctcgccttcgtcaatcaatgccaaggaacccaaaactttcaccctgagcacttgcccaacttccagaaccttgcttcccacttctataatatctaggggatcattgtctcctttgtatgctgatacaaatttggagggccgggtgtaatcctcccaagtttgaggaattgctccgtagttaaatggaaagccgtggttaggatacaaattgtgtacaaatctcaattgaccgtccttctggtcctgagtgatgggatttgcctccagcgatctactgatctcaaatttggcgttggtccaccgtggaatctctaccaccacatttagtaggccgctagtctggtcgtattcgataggaatatcatgcatataactgccgatcttgccattgtcaagctttagatagtttttgtatgcagatgaatactttgagcctgtttgcacggaagagaataggcgtttaaacatgtttatagggcaaattggcgggaggagcagttatgagcggcaaagagtggataggtggaacgatggcccgagatgataaagaaataccccatcttgcgttgcgcgacccggagatgttagatgtacaacccactatcagctatcagtctgcaaaaatagaatataaggagtcaacatagacacgagatcaagttagacctgccatggcaagggactattattggtccaactataacattgatcggaagaatgatttagtcaaacactgaaaacgtttcatttaatatttgaagctacttgtgggttattcattgaaaactaccccttttcagatcttattaagacatcattcgtaagtacatatgctgctaactatccaccaactgcttgtcagatttgtcaagttctacgtttgaaccacttgtgggcgcatctccctcccattcaactttgcccttattgttgatggatgccctctcgtgagaaatctcaatcactcccttgaattcctggattagttgtgatgaaaacccaagtgggtcctttggaatccaaagcactttttgttgctgagttacagacgggtaatcataggcatgtttggtctgtttctcatccgtaactgtgggctcttgatacgactcgggaagatacgtacgaagcgtctcgtacgaatagtatatccaaggacggaaaaaacggtcaagcggtcccaaggtggtgatgctacttcccatatcctcaccatctaccaacaagggaacattggccaaggacctctgttttcgtttcttgtgcttgtgtttcttcggtaactcctcttctgacaggaatggagactcattgaaattatgagaattctccacatcgccgcttggtacccatgatggtgtctcagaaacaccatcaagaggtttcatggcatctgcagggacaacagataacagccggtcaaacgagctattcatattgagatgaacaaacacagtgacagcgagaaggattatttccaaaacaataggtccccatcctctgccaactgcgaatatacccaaaagacaaatctctcctaggtaaactccaaccaacgtttggaacaatgctctggggtaatgtaagccttgagagtcggggccagacacgaaaacatagctcaggttatacatgtaggtgaaccaaagtaatgcaaatgcaactgttccaaaaatcagaatcaaaggggaaatgatagaatatgaaagcacaataactgccaggttggtgtacactggaaatgttgtaccccattccatagatccgagaccagcgtatctatcgtgcttctttctcggagtgttgtcaaatgcaaacccaaacacataatagaggatcaagtttgcgacttggaacaaagaactactactacctgacaaaccttgaagaatgatgtaggcaatgtaaaaattggacgcttttggtaaattcgtagctagagtatccataatactagtaggatcttcaattatctgtgtcactgcagacgctgcagcagaagaaagagaaaccaccaagaatacctgcactacctggaaagcaaaaaacgtttgctgggtaaacaattccacgctttgagatgtgactgatccgtaaagttttgccatattacgaataaagattggcaaaatcatcatcaaaagcgccaacataatggtaggtaataaagacgtgacgataccaagcaactggtctggaaggtccaaaatccacctcagccatggcagttcatttgtcagatacgttatattcgaaatcataccaacaaaggacactggtatcgaccaaaaaatcactaatgcaataatactagccactgccgcccatgatcgcaccagtctctcccaccatgaaagtctcatattgaaccagttgatatccgcaggttcaactccaatatgggagggagtgaagtgaagaggcatatgatgggctactgactggtgagctaattgtgcatggtattgactgataaattctaccacgaccgaattaacaggagaagattcttcatagttagcctgtctgtccaaaattttctcgtttagctcgatcaatgtggtcttgcaatgatctataaggtcgtacttctttccaaatattggaaacgaacgagtagtgggtctcttcttgacataatcgctccaacttgtgccctctacaaatgtgtcaggagatttcagataccttttagtagattgagtcaatatcttgcagattgcattctccaacttcattgaaacttgatctcttttattcaccaaaggagcaagatctttgggagcttgcaaaacccaaacgtttttgactccatcaaaaagtttcctaagctctgacttaaacaagaattggggtgtcgcagtctgaaagatcacacttttagagctctgtttagttccatataaaggagaagacatgatgactactctcatgttgttgtaaaagtacagctcccggtaaatcacatacaatatagatccgtaaaatacccaagagatgaacgcatgtgcaaaatatctattcctgtcatcaacgttttgaatagccaattgatcgaaaccgtcatgcccaaccccattaactgcattgactggtaggagaacaatcaaaatgagactaccaaaaaagaaagtcaaagtcaatattcccatgtaacgtagaaataggtacccgtcaataccacagaacttgatcaggaatttcttatctttccgtattaaatcccagatcattcttggagcaaacacagaaactggtttgggtctgtcttctgggggcaaaagctttgtgaaactcttgggttgatagattcgatggaactttgctctgagcaaaataaatgctacaacgaaacctccaaacacggccgaattcacagccaacgaagtcagcaccgtttcggtggagatgttgacctcagtcgtcattgttggtcaaaatcaaacgggaagtgatggtgggaagagaagaaaagaagcaagggagataaagattcaaatccagtcttgatttcgatctgtagcatatgtatgcgatatgacgcgtttagtaatcgtcatgtaagggaatgagaaatgtaacgataaccaactaaatttagaacagagcaacaaagaaggcgcttggagtcacccttgctataacatggacatgccgatcaagtagtattcttttaagttaaatcttggctaaactttttatgctgctgaccttagttcttacattaggcaacgaatcatcatcctccttgctctcgcaccaaagattttcagtgcggctgatgcagtgattaccatagaaacattgatccagcatcagaggaaaacgtacgcctctcgaacatccagcatcccatcgttgcaactccaaacatctcataaattctaccttcacgtgatgagggctcacgcccttcctcatttttcatcacttttttgtcgtccaaatcgttttcttacttcttcatcctttaaacagcctatcctcagtatagtaataacagagtcgaaatgggaggtatcaacgaaaagaaagccgagtactttaacaagctcagagagcttttggaatcttacaagtccatctttattgtcggtgttgacaatgtctcctctcagcaaatgcacgaggtcagacagactctccgtggtaaagctgtgattcttatgggtaagaacaccatggtcagaaaggccttgagagacttcgtcgaggagctcccagtctttgagaagctgttgcctttcgtcagaggtaacattggtttcgtcttcaccaacgaggacttgaaaaccatcagagatgtgatcatcgagaacagagtcgctgccccagccagaccaggtgctatcgctcctttggatgtcttcattcctgccggtaacactggtatggaaccaggtaagacctctttcttccaagctcttggtgtcccaaccaagatttccagaggtaccattgagatcaccagtgatgttaaggttgttgagaaagactccagagttggtccttccgaggctcaattgttgaacatgttgaacatctctcctttcacctacggtttgactgttgttcaagttttcgacgatggacaagttttcccagctaacattttggacatcaccgatgacgagctgttgtctcacttcacctctgccatctctaccattgcccaaatctctttggctgctggttacccaactttgccatccgttggtcactctgttgtcaaccactacaagaatgttttggctgtctccattgctactgactactcctttgagggttctgaagctatcaaggacagattggctaaccctgaggcttacgctgctgctgctcctgctgccggtgaggcttctgctggtgccgaggagactgctgccgctgctgaggaggaagacgaagagtctgaggacgacgacatgggattcggtttgtttgattaaatataacgattaagaactaattgtagtcaatagattaagttttccgcaacattaaacgtaattaaccacaccaaaattgggttcgtagtttggtacaactttgatgggtagtctacatagaaactctgatccactggagtagaattccactcctctgagcaaatctcctttgttgtcggaatagatcaactctaaatcagaagattcctccactaagatgaactttattgtgaccaaataccttacgttcacaatgttagttttgaactgacctggtgagttgtaaggaatgggtaaattggctgatacttgctcactgttaatagtactaacaactttttcacaaaccttttcaacaagctggctttgttcagtcagattctcatgtatttgccctttttcatccttgaaaatgtactggtcacttatggtctctactctttcaagtgcgactatcaaccctgtcgttttaatatgatttaataactgaatgttaatgcgaataatatcgttgaccctaaatactgacttgtcgaggtcaacttgagcaaaattttttgtatttcgtttcaacaagaacctagtttggaattttgcgggtaaaaggctatcatattcaaaaaggttcagttcttcaaaattcttttgtaggggtttgcgttcagtttgtctaagggaaagaacttgtgatgggttcgaaaccaaattgataaggtttaacctacaattttcgttcttcggagaagtgtaatctgtaagaaactctttgtgaaactcattttgtatttccacaacctgattaatgttggcttgacttagtttctgcataaaagccaagaactcgattggttttaccgctatcttgtcattagaaaaatcagactcggattcaatatcgctatgtttcaactgagacttaatggaagcaaagctggccttttgtccatcagttacctcgttaacttgagcctcaatgggctgacccaagagtggtttatccaaggtgaaaaaaggctgctgcccaactctgttcacgtaagcttgtaatttaagaggaaattttagtgtccggacacttatcttgccactcttttcaaattgttggtagccaaccagtaacttataatttatagtaagagcagctgaatggtaatttggtggtaagttttttggtaaaggaactttcacataaaagatcttcaaagggtcttgggccagagaaatctcctgaaatagcatggcttgagttgtggaatatagcgggataatctggttactcttcccaggctccaaaaattctatgttattgaactgccaaatattgctagttttatcactcaattccagtccttctataccagctagtttatttcctatgacagatctttttctaacgtcttccaatttttttttatctatgatgttttcattgatagcaagatatccaaacaattgcgtatatccgacaacgaatacaggttcatcgtcttcctcgtgttgctcttctaccttgtctaattctttcaaaaaaacattccttgtaacattggaaaattgcgacgagattctccttccaaagccagaccacgtatcactactcccagccttatgagaagagttgacagcgtccttatcttcaggatctggctctgaatgttcttctttaggaagcttgggtttacccaaataccggaaccgtaggatcaacgaaagttcatctgttccagcaatgactggataattttcatacacaacttcaacccgaacattattgtctactaattggttgtatattgtgtgggtcaccattaccttagttggaactagggagatcagatttggagattgatagaaaaatctggttggtgaacgattttttcgaagtgatcttcgtgtagtaaatagattatttggccttaatttctgtttaacacccactcccctttaaaagctactaattagggaagaatagaaattacaccacattgcacttggtttcttggccaattactgatttgcaacaaaaagcttttccaaagggcaattgcagcgggactcttgccagaatataatgacatctaaagaggccattttccgtaagtttgactctagcatttcagcacgtatagcttgaaaagttactaaccacctcttctaggctcagcggagatgtctttagtacagttttatatagcaagtgaaatctcaagagacattgtatctgtcttgggggatctcggaactgttcaactgagagatttgaactcaaacgtcaatacgtttcaaaggtcatttgttaaggaaatcagaaagctaacggcaacagaagagcaactaaactacttggtctctcagatatatcaacaaaaacctggaaccataattccagagtacgatggtataggtgccattcattcttcatctcttggtcaaccttcgactgcttcttcctccgaagttgacgatttgactaccaaagtacaacagtatgaggccaatgttagaaggttagcagagtctctagagcaatccaaacaacaggagttgaggctaatagagcacagactggtactgaatggatccaggaagttttttggctcgcatacgcacagttttgatataggcaacgatcctgaaactttaaacaacgtgagactttccctggattccgctgatggattattgatggaagaagagtctgtcaacatgggccgcaatctgacgattgaaagagacttcacaatgatatcaacaatgaactatattactggtactatagacagtcaacgatatcacacgttagaaaaaattctatggagagtattaagaggtaatttgtaccttagttttgtacccattgattctacttttgatgatacaagaagtgggcaaaaagtcaacaagtacatatttttggtgtttacccatggtgacaatctgattaacaagactaaaaggattgttgactctttaggtggtacagttttccacgttgagagcaattatgaactattcaaacgagagctagatgagatcaattccaagctgtttgatttaaaacaagtcattgaccacacgcaaaatgtactgaacagcgagctgttgtacgtgtgccaggacatctctcagtggcaggttgaaataaagaaggaaaaggctatttataatgccttgaatcaatttaactacgatcaaacgagaagatgcttgattggtgaaggatggatacctaaacatgatttacctgcagtgaagaatgcgctgagggatgtaaccgagagatccgggagtgacataaactcagttgtgaacgagttgtacaccaatcgtacccctcccacttttcacagaactaacaagttcacagcagctttccagtcaatcattgatgcgtatggtatcgctacgtaccaagaagttaatccaggattggccagtgtggtaactttcccttttctgtttgcaattatgttcggtgatgtgggccatggacttctggtgttcttggctgctttagttttgattttgaaagagaataaaatcgccaaaatgaaaagggatgaaatctttgatatggcttttactggaagatatattctgattcttatgggtgcattttctgtatacacaggtttcatttacaatgatattttttcaagatcgttgactttgttcaaatctggatggaaatggccttctgattttgatgcgggccaatctgtggaggcaactgaaagaggaacctatgcattcggaatagactacgcctggcacggaactgacaataatctattattcaccaactcatacaaaatgaaattgtccatcttgatcggtttttgtcacatgtcctattcattcttcttttcactggtgaactataggtatttcaagtcaaacgttgacgttatcgggaatttcattccaggattacttttcatgcaaggtatttttggatatctctctctcactatcgtctataaatggtgtgttgattgggttaaaataggaaagccagctcctggtttactgaacatgctgataaacatgtttctttcaccagggactgttgaggagcagctttaccctggacaatctgtcgtacagattatccttgttttgatagcattggtgtgtgttccgtggttactattatacaaaccacttgttttacgtcggcgtaacaaccagtcgatccaattaaggtactccgacctgtttgagcatgatcatataaaccaactttcagattctgaaaatttggaagatgacgatttttttgtcatccaggatattgacgacgagcaagagccattcaattttggtgacgttatgattcaccaagtgattcataccatcgaattttgcctaaattgtgtctcacatacagcatcttatctgaggctgtgggccctttcccttgcacataaccaactttcggccgttctttggtccatgacgattgccaattcgtttggaactacaggatattcgggcatattcatgacgttctttctatttggcctttggtttattctgactgtggccattctggttgtcatggagggaacctcggcgatgttacattctctgagattacattgggttgaagccatgtctaagttctttgaaggtgagggatatgcatacatgccattttcctttgtagacttgctcaaagaaagcgacaaccagtaacttagctgttttccacacggtggactgagagcgatgaggtttatataggaaagcataaacatgcatgatgataggcaaacgcgcgaagtttatttaggagaatcaaatcaaatcaaatcatcttttgtcaacaataatacgttaacagtagtagaatagccaaacatccgtcgccctgatggaatcgcaacttaggacgaaaccttcaatgggtttcaaaaagggaaggaaaaaagacccggtagaaaagttcatcacaagtaatcaagtcatagtcaaaactggtctgtcacagctacggtacatgatccttgcagaaggtcttacaacacattcagacttggagagctgcccgtatcggtgttacgtatggtccattttactacaagttcctccaactgaaagtgaattctatattgaactggtttctcagggaagatctcaaagtttcgataagatacttaacgatgctcatagaactttgaaaggtgatcccaattacgaaagcaaagtgacacccaccatacttgcaagaacactaaattgctatgccctgatgacagagataaagaacgagaatgtatctaggggtagtaagagaaatagcagggcctatttatcgtccccttatattcaaggtatgaatatcttgatggcacctttcttatacgtttgcaagacagaacctcaggcatttttactgtttgataaaatgataaatggacatatgccactctacgtgcttccgaaccttgaaggagctcatactggtgtccgtatggttgacttgtgtcttcaaattgtggacccgaaactgcattcgtacctaagcaagaaaatgcttaaaacagaaatttacgcctttccctcagtgttgaccttatcagcatgcacgcctcccttgagtgaagtgttagaattgtgggactttttattctcttacggaattcatttgaatgtattgttcattgttgctcagttagttttaatacggtcagaactgatgaaaatttcgaacccaatgacattactacgagaattccctaaactagaatccaagaagatcataaaacttggtattagtttcattgaaaagattcccaaagacgtatacatgcttctagttaaacatacacatgaccctacaataagcgaacaattagatgcatattaccgttgattcattaatatatcccatttgcaaaatccttttcatttgtgaatgttgccaacacagttctgtcattatataattttccagccaactgatcgatggccttacgagcatcatcaacatggtgaaataccatatagagcttctcacatttccaatcatcagcttgtttctctgtattaggtatgaacactcggtcaaaatttcctatgctccgtccaaattcctcaaactcagaaataactggttcgaaaatgtttagaagctggacaattttagtttccttagttcgaaggaaattttctcctttgctggccttctcaagattttgaaatttcacttcgtactcctgctgtagcccatcgcaggcagggaagcaacgcaagtcaaattgttcattttttgagctttcgatagcctcaaccactgttgatcgatccgagtttttgaactcgcagaatgcaaaggattgcgattcaccagattccttcaattttggtaattccaagcctgtgactgttccaaattttgacagataatttaccaatgatgatctctcagtcccgatcggaatactggccagtgctagtttgtttttgctatcaataacaacgtcagatacttcgtcggtagagctagttttttcttccgtatttccaacaatatatgcctctggacgcaataaatccaactttaaattcagttcttcaatgttcatgccgttcatacaatagattagtgtggtggtttgggaactatctagctcaagtattattttggacttgtcgtctacgacgttaaaggcaacgactggtttgctggcgttgcagctgctcagctgagaagtgtactcattcaaatagttaacgatctgttcaggctcaacaccgtcaaaatttgtgaccacaagttttttgctaagcgtagagagtgttgggctcaaactggcagtatcaaagagaacatcagccatttcgggtttttcggtaggggctggaggaagcggttttgatccatcgctctgagcgctaggtaaagaaaatagacccgatagtttggctctggaagcttgaactttttcatatcccctgggtttgacgtcccaaaaactaatatcccttttgacctcattcaagggtagcacattcgtaagatctacttttctagattgattttgtctggagtgactccttggggcgtgttcctgggagcttgtatatctgtcattagggtactctgatgtatttcttaatctttgttttgagggtccatttctttcaaactgctgtggctgataatcagaagatctttctctttcccttgcactcaccattccattgtgtggtctataactatgataactatcctgcacttcttctggtgcataatctctgtaggaccttctctcgtggcgctgattgcctcgtccacgagagtagtcattataccccctatctctggagaaatttctggagaatccggtatcattataattctgtgaaaaatctttagctcctctctctccatctctcctataccctctgtagtcattgttgcgttctcttggtgggcctctagaaattgcacccggagattcagtgcgataattccttcgagtatttgttacatcaatattttgatctgagtaaagagcttgattatctcgggcatacccctgcccttgctgttgtaccctaggatggtggttcggttcaatttcttcttgcttctcactagcaggcgcatcgggcatcaacttgttattccttcgagaagtttttaacagatcttggactttcagtgccccatagccattggaataaactggttttccattctctcgttggccagttaatctttcatcatggaaagctccgttatctttattttccatctgctagagcttatatcaaagaattcaaactaagaaaaaaagtctagggttagcgttccgtcgcgatttttcaccatctctcaagaggcaaggctcgcttcgctttctagaaaaaaccctgtagttggaaaagacacttgttcagatcaattgttatgagaacacaaaagatagtaacagtactttgtttgctactaaatactgtgcttggagctctgttgggcatcgattatggtcaagagtttactaaggctgtcctagtggctcctggtgtcccttttgaagttatcttgactccagactccaaacgtaaagataattcaatgatggccatcaaggaaaattccaaaggtgaaattgagagatattatggatcctcagctagttctgtttgtatcagaaaccctgaaacttgcttgaatcatctgaagtcattgataggtgtttcaattgatgacgtttcaactatagattacaagaagtaccattcaggtgctgagatggttccatccaaaaataacaggaacacggttgcctttaagttgggctcttctgtatatcctgtagaagagatacttgctatgagtttagatgacattaaatctagagctgaagatcatttaaaacacgcggtgccaggttcctattcagttatcagtgatgctgtcatcacagtacccactttttttacccaatcgcaaagactggccttgaaagatgctgccgaaattagtggcttaaaagtcgttggcttggttgatgacggtatatctgtggccgttaactatgcctcttcaaggcagttcaatggagacaaacaatatcatatgatctatgacatgggggctggttctttacaggcgactttggtttctatatcttccagtgatgatggtggaattgttattgatgtagaggctattgcctatgacaagtcgctgggaggccagttgttcacacaatctgtttatgacatccttttgcagaagttcttgtctgagcatccttcctttagcgagtccgacttcaacaagaatagtaaatctatgtcaaaactttggcaagcggctgaaaaggcaaagacaattttgagtgcaaacactgacacaagagtttccgttgaatccttatacaatgacattgactttagagccacaatagcaagagacgaattcgaagattacaatgcagagcatgttcataggatcactgctcctatcatcgaggccttaagtcatccattgaatgggaatctgacgtcaccttttccactgaccagtttaagttcagtaattctcacaggcgggtcaacaagagtgccgatggtgaaaaagcacctagaatctttgctaggatctgaattgattgcaaagaatgttaacgctgatgagtcagccgtttttggttctactctccgtggtgtaactttatcgcaaatgttcaaagcgaaacagatgaccgtaaatgaaagaagtgtatatgactattgcctaaaagttggttcttcagagataaacgtgttcccagttggcacccctcttgctactaagaaagtggtcgagctggaaaatgtagacagtgagaaccagctcacgattgggctctacgagaacggacaattgtttgccagtcatgaggttacagacctcaagaagagtatcaaatctctaactcaagaaggtaaagagtgttctaatattaattacgaggctacagtcgagttatctgagagcagattgctttctttaactcgtctgcaggccaaatgtgctgacgaggctgaatatttacctcctgtggacacagagtctgaagacactaaatctgaaaactcaactactagtgagactattgaaaaaccaaacaagaagctattctatcctgtgactatacctactcaactgaaatccgttcacgtgaaaccaatggggtcctctaccaaggtatcttcatctttgaaaatcaaggagttgaacaagaaggatgctgtaaagagatcgatcgaagaattgaagaatcagctggaatcgaaattataccgcgtgcgctcgtatttagaggatgaggaagtggttgaaaaagggccagcatcacaagttgaggctttgtcaacactggttgctgagaatcttgagtggttggactatgatagcgacgatgcatcagcaaaagatatcagggaaaaactaaattctgtgtcagatagtgttgccttcatcaagagctacattgatctgaacgatgtcacttttgataataatcttttcactacgatttacaacactactttaaactccatgcaaaatgttcaagaactaatgttaaacatgagtgaggatgctctgagtttaatgcagcagtatgagaaggaaggtttagacttcgccaaagaaagtcaaaagatcaaaataaaatctcctcctttatcagacaaagagcttgataatctctttaacactgttaccgaaaagttagagcatgtcagaatgttgactgaaaaggacactataagtgatttgcctagagaggagctttttaagctgtatcaagaattgcagaactactcttcccgatttgaagcaatcatggccagtttggaagatgtacactctcaaagaatcaaccgtttgacagacaagttacgcaaacatattgaaagggtgagcaatgaagcattgaaggcagctctcaaggaagctaaacgtcaacaagaggaggaaaaaagccacgagcagaatgagggagaagagcaaagttctgcttccacttctcacactaatgaagatatagaggaaccatcagaatcgcctaaggttcaaacatcccatgatgagttgtagtatcccacagttatatatagaccacataattcattagagatatttacgcgcgattaccacccctcaaagataaaaacgacttgaacctcagatatcaccataccactcgaaacaactaccaaatgtttggactagggatattattttacacagttctattccttgtgaatgccatagcgatcttatcagaagacagatttctaaatcgaattggatggggctcatatgccccagcaagtactccgcaagctagcttccaaaccactacatttgacaactacaacgccaacccagaagtttctatgaaaacgaaaattgtaacattaataagtgctacaagaactttgcttagactgccattaattgctatcaacagcgtagtcataatctacgaattggtgctaggatagatgaatacacattaaaaattatctatacactaaccttaatacacagttcgatgtcatgattcataccctagtattccgcttcaaaggggggttgctcctttcttttagtctcaacgaagttctcaacgatggatattcgttcgcctgagtaatcgcaatgatcatgaactacatttgagtccttgtccttgagatacaatcgaaggaataagatgatggtatcataaaccagcagatattgtctcaaagtttggaccatgaaaacacgctgctttctaaactcttctactattctccaaactgggtcataggtggcgctacagtttttcgatgtcaaactgctatcctttaacagatgttccacaactgcgtcgattgaacaaaatgttccggttcttccacagcccgcagagcaatgaacgactattgggacattatgttctttatctcgacaattcctggcaatataccttctgagataaattaaattcaagaggtcattcatcaatagtgtcccgaaatctggccaggaagaaacttgcaactgtaatacttctctgctgatattagcagtactgacacgtagacgtctcacggttaaagaaaaactcttgcctgaacctagtttcacattctcgtcgctttcaatcaattcaacagtaattatctttcttccactggtatactctccacatttccagaaaggagcacatttttcaactccattttcattctgcgccgttaaagagaagattaagtaagacccttggtctaatatcaacctccagaaatcaccaattgtttcttccagtgggccttgtgtcgctatgtatgttgttggcgtgacgcctgtagtaagataatttgcattaatgtagtcttctgaatggtcaatttctaatacaggtgacgtgactaatttcactctggaatgctcatatgggaatatatccttgtatctgttctttgatcctaactctacacccttggataccttaggggcgtctatatctgatttttgatgtttgttgctaaaggccaaacttagcctttccttttcgttaatctcgaggtgataaaactttttgctaattgccgtagccccatgatcatccccaatgatacgaaggatccaaggtggtagattggccttttcatagtcagtaaaatcctccatgttcaacaccatggagtagtcaggcttgctagaaatcacttcttccccgagccttgttttgaaaagcggaacgctgggaggatcaggaagagtaaatttagttaatgttggggatttatcaaccgtattctcggtgagctgtctgcgtaacactggtaaagatgatttccgagaaaatttagggctactagcttctgttgcggcatgactttgaatgggatcaggactaacagagcaaatattaggattcaacgaactgagtgataaagcaggatagtcttcgttgaactggctaaaccctccactgattgtataaatgggagagttccactgagaatcatggacaaacttggaagttagagtagacaacggcaatgagcaagaattttcatccctgctagctaaatcatagattagcacggcaggaagacccctatcgccgtatggaatcccgttattcaatttgttcgccaaatcgagattctggatattaccgtccttgaacaaattttgactgtgttccaggtggtgatagaaaaggtttctatcgttcaagtccaaaatagacaaacacttctgaagggtgaacgttggtctcttggccaacgtcgatggaagacaaatatttatcgaacctggaagatggctcttacaatactcagcaaacgggcgcacgtcaataatgatcaagttagatagctccagttcttcgtaggagtggcaattggccagtaattgcgccacttctgaggatgaaagcagttggacttcactggatagggtatgctgataatctttgttcatcctagagataatttcatcggggtttttgaaaccatatggagaagttgggaactttctcaaagtcggctctagcgtttgacttttggaacttgaatgacggattggtctagcaggggtgttaaacttgaagaaaggggacgaactcgtagccggaggtgtttgcaaatgcttgtgtctaagggattcggttaaagtggttttgctgtccaacgaatccgttctggatggttctttggaatgaaaaaagggacgatcaaccagcgtaatatcagaaaaatttgtctgtatggaagataccgaattgttgctactgtgagcatagcaatctttgccatccgaagtttgcgatttggtcagattatccgtaggaacctcagaatgtttgatgctaaaatagttgctcccttccgtctctagattagctgaagctggatctaacgtatccccctgataaacagagctgcttgctactgcgtgagcactaggactgggcatgttttgagctgttggaaatctataaagtttactctctcgcagatcgtatcgtctttttgaattctaacaattaggtgtccttctctgatattgctctattgccccctaccagagaagtttattaccaagcttaaaaatgggggcggtctaactaaaaaaacttcacaaacagcaaagattagtaaatgaaagggggtgtatgttgtagtaggcaaactgaagaattacctctaagcgatatgtagcaattagatgtgattttccgatttctcacgatccccttttcttttctttctcgttactttttttgagagacgggattaatgtggaatgcagctgcacaacactattcccttacgccatttctgcctacccttggcaaaaaatggtaaccactcaatgcgaacttctattggctctcaaaatgtcggcaagctgagtccaacggcgttagaattacaaagtagtgactacctctattaatcactccgcatgtactgatttaatgccgtttattgctattacctaatacggtatacagagcgactggatgggaataaacgggctcacacatatgcgagatttacggtagctccgatgacttgctttggatagaaacaacgcgcaagtggagctatacgcttcataaattgttcgtgctatcagtttggctcacggaaagtttccccatcgtaaatgccactcttggaataatcactgtatgcttggtgccctctatcagatactttacctgcgagtctaaaataactaggcaacctgtaacgatagatacgtgccaagaaattgtcaggtttagcgctaatgaaaagatccgtcacgttgaggtggttatcagatcctctgtaaacttcaacgtcattgatcagtagagagtactcttcgaagtttctcgtggactcagtcgactcccattctagaatgccagtatcggcattgagcccttcaaatcgaggaggcttgattcttcccaggggatcgtctcttttcagttggatttctgtttctaatatgctatccatgccccatcgagcaacaccattaatgaaaagcccaattaaaataccctgaaacattatggctgtgatatttctggttctagttccaggcagcagcaacaatgctagaacgtaatggtgcagtctcaaagttaaaccagggattctcgccagtaagagcagagaaactatgaagataagataaatgtaaaaatatttttgaaattttcccgctttccacaactgtactgcctggacaacagcacaagacaaaatcagcgttgcaatgccaagaatgcttatcagtgctcctttttgttccgcaatatctgatcttgttagcctgtcaactggtagtgcatcaaaggtaatattattaagaactcctatccagtacaacggataccagaaacaaacgacccacattctaaccccgcctcgactcgtttccttcatggtgtaaccagaggcaaatttccacaccacatatagaataaagcatgtgggcaaaaagcgttggacagctagactgagtagctcataaggggagtcactattcttggcaacattcggtattataggaggatcaaagctcaacgttagtacccaaaagccaacaatcgagctcacccaatacaccaacggcatactggcaagataagaaaaaatccagcccaagaatatgtttacgataagtaccaaaaacctggtatctgtacagtttgtacactttccagggtgaacctttccaaacgcgtaagatgatgggaatgctgaattgaaaggaattgagtcttgagctccatacattcctttagttgaactaaaattgttctgggtgccctgaaaggtcaggtttaaaaccccaccagaaaatgatgatattaatccagcatgaattccagctccgcatggatatgaatcagctctataggcattggttaatatgtcctcagaatttgtgtccgagatgctttttctccctccccctatgaaaaagcctctacgttttatggtaaggtcaccaacaggaatagatgagaaagtccaagatcccctgtggcacagtgctggacacttcacaagcacacttccatcggcaatggttgtacatctttcggcattcagtccacatctgtcgttcttgcccttccaaatttccttcacttcgccacaagaaacactcataatctccgttccgtccagagacggggctttgaagataacatcatacaataacagataattaatcagtaaccataaaaaaatgtacccaacggtgactgcaaatttgatcttgtactgtagttctttcctcagaaaaaatgggtagctgtcaacttgggatagactgtatgatttgacggtggtcggctcatccttcgggtaatttgggccattccataaccaactgaaaaatccaacgttggtgttatcttccagctcatagttatcttcaagaagttcaaacgagggcttagggttattcaaactccttagcgggatgctttcctccgcagagtatgattcttctcccctttcaacgtccaggttcattatctataatacaaaatgttgtgtgcgaacgctaaaagtgtggcagaaaaaccgttacgtgtgatatcagaagattatctcgcgcgacacggataatcagcggtcggacttaaatcctttatctgcctaatcaccatttcggaggaggggagcggagcggaaaagggaatcaaatataatcaatcaaattaaactagtttacaaaaatctaaaactcccggaccttcataccttcttctcttcactgtagtaatctatggcttcctcttcgggctcctgtccctcaccattgataactcctccactgacatcgaactcttcaacttcagcgtagatttcgtaccagcccttcttgaagagatccttcttgatgtcagttggcaatcctggaattggatggatatagcacagaagcacatagaccacaatggacgacgcaaatcctgtgaaaaagttaaagtcgtaaacatacatagcaccttggggtacggaacctgcaccagtagcaccaacaaatccgacaatgtttgggagaataccacagatataagcaacaaaagctctgtagttgataccatgccagtatgtgtaggcggatgtcttttcggcattgtacaaatcggtcaaaattaaccatcctctcttaacaatatagtagtcagcaaaaatcacaccaaaaatagcggacaaaaacactgagtaagcagacaagtatgttgtaaatttgtttgaagatgacagcaattcccacggacagatggccaaaccaactgcagcacaaatgtatccaccacgacgaatggtaatgtacttggggaacaaagcagtggcatcggtaccagcactcaaagagttggcggaaatgttagttccaagttgggccagagcgaaggcaagagaaatgaaaaagacaccagctctgttacccgagttgtagttgtccaaaaatcttcctaaaacatcaataggcgaccagtaagtttctccgtaaatgacggtagaagccgaagagaccaggataccaatcaacgaagtaatggagaaacacagagggatggaaaacagttgtgcccacttagccgacttcttagtctttgaaaacctggagaaatctggagcgttggtgatcagagtagcaaagttagcaagagagttcataaccatacgaatgaattcccaagcaaactccgatccgtggatagtggatggttgcttcacgatgggtccgataccattggcctttttaatggtccaaaccaaaaatgcaataccagccactgggacgacataagatttgacggtgaacaaatgacgaaccttgtgaggttcaagccaaataaatggaagagaaaataaccaaaacaggaagaaagacaggaactcaaaagttgtaacgtttggtgaagaaattccatcgggaattcttgtattcaagtcattcccgaaaatggaacgaagcatcaaggccatggttgttccaccaatgtagccttgcacaccgtaccagacacaggacatcaccactctgttaaaaactggccaaatagatccaaaaacaccgaacgaacttctacaactcacaggaaaggaaacgtgatagtagataccaacacgagcactgatagtaacaaagataccacacaagaaataaccaacccagactgataaccaacaagtccaccaactcataccagcttggacaccagtagcagcaatttgccaagtgttgatgttgaaagagtcagcaatccagaagaacacatagttaaaccaactccatactcttctagcgctttcgactggtctcaagtcaaagttgaaaaggaaagtttgcgaaacggacaatcctttttcctcttgcacggcaattttgtctaggaattttcctatagctgatttatcagatttttcatgaatgctggtggaatactcctccactgaagcagcaccagttgaggcatcagatgatttatggaatctgtgtgtaagtttgtctccaaaagccatggttgtttgaaactgggtgaaaagaatgttcgtaaactggaaaacggtgccctacttatgctccgcttcagattgcttatcgttttctgctgctgaaatttaagcgcaggttacttttttttttttaacctgattgccctcagatgtcacgcacgataaagaaaagctgttgtaatctcgatgcgcctatcactgcttgattattcccggcattagaaacgacagctttcatgatgatgatacttccctgcatgtcagtaggtgtggagactgtttcatttagagacgcttccactgtagcccaaggcttggtaaacaaaatgaaatgaagcagctaaaacagaagacttgggcttggattgttcacaaggttttttttcacatttgaattactccttctttgactctaacgataacataaccaattaccccaaattattaggaaaatgttaactgattctgagtggagtgacgttcgtttcttttcggcgaattttagcgccgccctttaaaaaagtcatcgccgtcagttagcggcgaggtatgcaacagccaatagaaacctcaacactgcagaaatggcagaaatgagtatgcataataagtaaagttagtgaatggtaaaaccgcgtgtttcttttgatgccttaatagattgatacagggtccgttcgggcatttctctggcgaaaagattttgcatctgttcgattgttctatgatcagcagataagaacaattagtcctattctgatttattgacctctttgggtaatcgccttctctgatgaatccaacgcagtaaatggggaacatcttgagctattgttcttggaagagcgagcacggtaataaaactcggcacaaaccccccagcgttggaagctgttgccatgttccagataaggtcttggctatcgccataactaatactttccaccgaggaatactgggcatagacccattcttttgaaaattgcaaatcagttagtaaactgtcggaatggagattaggattgtcactagacctgagcgtctgctgtatttcttcaatgtccgctggaacgctcacgatgaaccccgactccttgccaaatagtttcactttgctgccttcattttgctccagtggaggaagcaccctgacatattcgtagaactttcgtgttttcaacaagggccctaggttgtagttcagttctacacagtaccatggctctggagcacctttcaagattacgaagctttcaactaactttcccatatactgtttctcgtaataggtgtgtaaggttggatccgcaatcttccatttgtccccctcatacacacagcccgtcaaagcttccacaacattctctagattataatcattggcgcttatagtgttactcctcccggcccatccgttgcttcccttaaatgtgtccacctgaatggtctcgttgtgggcgccagtttgatggaatgtcttatatctattttcctcctggtagatgcattccagcaattccagacactgattcctcaattggtcctcatccaactccaaatccccagacttgaaaggcgtcgcctcaaggagcttcattgatctagtgaatataagtagtgcgagaacaaacgatatgcctccccttggctcatcagaagtgtatcatttttgagcgcgacagacacggcatccaacagtgataatccatcgttcctcatacttacccaagcaaacagattttacaggaatggcaagtatagttttccgtacaagtcccttgctggtctgcttctctattcaatgtatttgtactaaccctagtaggttacaattggaaacgcacatgatgacctaatccatgacgccgttctagattactatggacgtcgactggccacctgttcatcggacaagacaatcaagatttttgagatcgatggggagaaccaacgattggtggaaactttaatcggacacgaaggacctgtgtggcaagttgcatgggcccatcctaaatttggagtcattcttgcctcgtgttcttatgacggtaaagttttgatttggaaagaagacaacggtgtatggaacaaagtggctgaacattccgttcatcaggcatctgttaatagtgtttcctgggcacctcatgaatacggtcctgttttgctctgtgcttccagtgatgggaagatatccattgtcgaattcaaggacggaggagccttggaacctattgtcatccaaggtcacgctataggcgtgaatgctgcctcttgggctccaatttcattgcccgataatacgaggcggtttgtttctggtggctgtgacaatctagtcaaaatttggagatacgatgacgccgcaaaaacatttatcgaagaagaagcttttcaaggacattccgactgggtcagagatgtggcatggtctccttctcgtttatcaaagtcatacattgccactgcctcacaagatcgtacagtattgatttggactaaagatggaaaatctaacaaatgggaaaaacagcctttaacaaaggaaaaattccccgatgtttgttggagagccagctggtctcttagtggaaatgtattggccatttcgggtggtgataataaggtcactttgtggaaggaaaacatccagggcaaatgggagtccgctggcgaagtcgatcaataatagaaaggaatacaaatataaatacgttttaactcatttaaccaattactatgtattctgttattattgctattaacgctcattaacgtctactaacgttcttttaacagcttgttcctcttttctttcctcttaagtctctcgacctttctacgatgcattacttgagccattctctcatatctttccttttcttccttcaaactttggcggcgtttggtttcttcaattttgctttttcttatgctttctttctcctccttgagttctcttatctttgcctttatagcttgctcttcaagtcttttctgttttttctgttcccaagtcagattgcctcctaaagatctcactctcatggcatctttctgtagcttccaatcttttccattaacacgggtccctcttcctttatccttaggggctatagggttgttatatatatccttctttgaagtactgctactgtcactcatgatgtagtagtggttgtgtagaatatcaaaaggaaaaaaaaaattatttcgtgaaaattcaaataaggtattgttctcattaagggataaaaaaataccctttattgccattgaaaagtattacatcggtactcatcaagcttattagagttttcgtcgggtcttggagctctagaacaacaccagaactttctgcctttattcttggattccttcttgcaaactcgaagaacacatggctcgttatggtcacataaaggtggcccagctgcaactgaaagaatttttttgaaagactccatgtctgtagatctcccatccttattcttggcttcttgatctgaatacgagtccaaaaagaattgttgctctttgtctgagaaattgtttttcgaagatttaaagtatcccggattctgcttctttctgctcctatactgataggacgctgattttggaggttttgcaactccagtaggggtaattttgccttgtgatcttgacttaaaaaaactatcaattttacacccattgtgggttttgtaatgatacctggcttcaaaggataatggctgtttggagaagggaaagctatcaaaagattcatctggctcaaagtctgctatcactggacaatgatcactacccattaaccaaggtagaatttcacactttttgaacttgttcaaaagtgccgttgagcaaagtatcagatcaatccttgaaccaatattcaacggtcttgtatttttcaatgtgttccaaacagtgtacgatcgcatcactcttccatggtgttctctaaacgtatcgtgaagaatcccgctatcgttatacttgtctttaatgaaagaattcagtaaacttcttggttgagaagctgttcgaaactggagaacagctgttttgttggcttcctcaaagtgagctccatcattattaattggcggaattaacgatttgtccgcaataccctctctcaaataaacctcattgtctatgagatctcttgaaacgtttatatctcccattatgaccacagttttgcccatttgctgcaatttttcagctctctccaagatgcaacgcaaaaacagtactctatgaaactcaccctgctctgtgcccatggaattagcaaagcaataaactgagatgattaccatcatgttccctagttccaaaaccacgcaccgtccctgaaaatcgatttcattagccaagacctcagaaatatcaggataacccccgatattattcagatctcggtagctagtagttgattgcgagctcttcaaataccctgtaattccttcttcggcgtgaactactgccaggcaactcttaatctgatctgattcttcatcggctggaattctaacaaataccccaacaccgctatacccttttctattagtcgccagggttacaaagctcctatagttggggatctcattcagctcatgatccaaattatccttttgaactttcaactcttgtaaagtaattatgtcagcaaatagatacccaaatattttgtcaaaactcttcattttgttccatggatgatagttacaaagagtcttggtcccattgacattgaaggtcacaaatctgactgctgcctgtgatttgacaggcactggcggcagtgctgattccatcagagaataaagggcgatgagtttaaaacgcgaatcaatattttctacaccaagtctaactctataaaatttcacactacagagagaaacggctaataaaatcgagttaatttagaaacgtttcggctccaaaaaggtctcgtcaacaatgtgtcctctatcgtttatttcgaccgttcctgcagtctcaaagagagatacagttcccactaataaacctaaggtctccagaacctgtcctgggtctgaaaggtaggccttagcaacagtttccttatttgctggccccacagaaaccggatagacaccatatccatctaatctatccttaggtctcttctcaagtttccaattagcttcgatatcattcaatgccttgaacatgtcttcgtcggtctgatcgtctcccagacacaaaataaagtctggtggtgccctgcctggtccatcagcatttattaccaaccttttaactatctcacctttattaacgaacttaggtcggacttcaatgttagccttaccagacatagcttcaacatcatactttttcatgactccagagagtaatttttgaaggcaatttgcagcttggaacgctgcaaaatctggttctgccttcctgtagtgccaggtgactgctaccttctttttctcgatgaaggttccaggagtattgtcagtgtaatattggaatactgactcgacttccttttgccaggacatgtcgaaatcttctgccaggttacgccattccttagatccaggctttttcataaagcaaccatgttcggcactgagtccaatatgaggaagcttttgtccaatccacttatctaagaactgttggtctcgtccacttataaaccaaatctcattgcgtggatcttttgtcaacaatgtcagagtgtcatacagcttggccgaggggatggcagcactgggcgtatgaacaataggtgtcagagttccatcataatcaaacatgaaaaggcgacgctcagctgtttgataattactgagtaataatggtctattcaggttaggagttcccttctttgaatggttgagtcttaagtcttgaatcaaatccgaaagcaagcgacgagtccagtcttgaacggtattcttctgaatttggttatacaagtttgcttccaatgctgtcttttcacgactgtccatcaataagcatttatgcatagtattagcaacgcccacagagtcccaagggttgaccaaaattgcctcagggaagacagcgacagtacctgaaaactcagaaagtattaatggagaatgctttttcttctgacatagtacgtattccagtgctgtggtgttatttccatctctgatagatgtgatgactcccaaatctgcaacccgtaatagggcaagatactcgtctttggctaccctcatctggtagtgctgaacaggagtccagttgaaagatccgtaagttccattgattccagcaatcaactcgtttaccttcttctccattttagcactgtggaaaactgtaggaaaagaaacttgtatcaagacaactttttctctccattgaggatacatagacaggaaagtctcaaaagcctccaacttttgtacaacccccctaacgatatccagtcggtctcttcctacgatgatcttcttatcgccgttaatttcacggatagcttttaccttttcttcaacttctttgctttcaaaagcgtacttttcgattgtctcaacatcgatacctattggggccacagaaaccgagacatgggcaccatatgcaattactgaattagctaagatctcagcacctacaatacgggtacaacagctcataaagtgtcgggcaaaagagaaactttgaaatccaatctgatctgctccaagcattccatcaagtatgtgcttcctcttggagaggcatctgaaatattctgaagatgggaaaggggcatgcaagaacagggagatcttggcttttggtagactcattctcaaaatttgaggcaataaaagcagataataatcgtggatccagatgatatcacccggcttgtagattttcttaattctggcggcataagcctcgttgaacttgacatagtcgtaccaccactcagtttcctgctttccatcggatggttgattttgcatgtaatggaaaataggccagaggacattctctgcgtactttctccaacgtaactggtccttcctgagaagccaaacaggatgaatattgggagagttgttggcagcacgcattttctcggttaacgcagtcttatcatcttcactaaggtacaaaggatcgctctccaaattagatactatactccgaggctgcagctcatcggagttatatagctcaccggtccaccctatcaagtgagtctcccatccagtgttatgggtgaggtagtcgtttgaagagtatagagcggaattacctctgaccggtttcacatcccattgaccttcagagttcttgaatatctggtttggcagcagagacatgacattcaagattctacctgtacatcccaagtcttttgtatcctcgggacgtatcatttctgggtctttttcgtaatcgggcattgttttgctgacgaaagataatactgttgaggatgaagtcggaaacgtcactgagaaaagatcgatcaacgtccgaatgttctaggttgcttggtaacagattattagggaagcgcgctagaatgcgcaacaataatagaagttgcgggtggaacgataaatgaagctgaaaagagatgtctaatggcgtcggaagtaccccctattgcattgattattagaacgttacctagtcttcttaagaatgaaaatccacccgttatgacttattgtgctaacattacggcaaattgaactccagccctactacaacgttccgcagcaaatttaaaatgttcctgcctgctgatgagcaacctttaacctgatgaaacaggaggaaggatgaccacctcatcaccgtctttgacctggacttgatcaaatgctaaggtgggcttctccttatcgaaatcaatatactctgtatttaatgcaatgttgcatgctgtaataatgtaatcaccaaattctgtcccatatttttcgttgatccaactccaaaccttgttcaatgagacaggataagattccatagtgattaaatcgtctcttttgtgggtaacatctgtagctggaccaaagtattcaacgtgtatggccatcacttcggtgctccgttctagatctagttcactcttccgcgtgaaaaactcaaaatcagaattctgaaaaattggtggtgccgcattaggatagatggttgaaattagtctattggtacaattataaatacataacaactacttatgtgaagacttcattttttcatgttctcctcataaatcttgaccagagtctccagtctttgtcgttcatttctttcctcgttcaattgttgttcatgcctctcattgatcttgcgcaccaactttttgaactccgatcgcaaaatagtggcacttacgttgttctttttaggagaattgggacctagcggagactttgaaccactcttagtgttctcccctattccaagactgtctatttttgaaatgcttagttctttgtttaggtcattgatctccttttccctctgggcaagatctttagacagttgattgatctgattttcttgttggaccaacgtatttgtttgattgttaaagtccttggttaatttgctcaatagctcctctgaatggttcaacttgtagcgcatttgtgaaagaatatcgctatgttgcaatttttcattctcaaattgacgtgacagatactcataagagaattggagatctttcagtgcagtctgtaggtcaagatcactaactgagtttttagtggattccttgcttttacttccaagaagacttttggatcgtgttaaagtctcattgaaagtaatttctctgagacatgatgagatccacgttaacttgccttcaagactagttatggaatcaactggttggggtaacacgaggtttttctgagctgcaatagagcagatctcaaaaattaaattctcaattttaaccccaagtatttggtgatcttcttcgtttgaaaaaagatcgacttgattaagtttggagccattatctagagctatcagtccattctgtgtaattaaaaggtttaacgcatgaatgtacgtattgttcagcttcttttgtaattcctctttcttgaattcatcttttgcttgggtttgcatactttttagggctccaatttgatccagattcaagagcctggagtcttgatcggattcgttagcgtctagtaattgcatttccaaaagacctttttccatgatcagtttcatatatgtcactttgaaagtatcatccttatccttcaatattccgatctttcccgcctcttcctttagaattgcttcgaatctttcgtccatcccgttagcaaactctccaatggaagtgggtgggttcgttgatgcctcctcatgcgattgttgtaacaactttttcaacgatgcttcatcctgggcggcagaccagtctacaggaaactctttgcttagcaagttatccttcatggatgtagccatggctatttgactataagtctcgtccattgttgtttaatgaaagaacaaaaccgtgttctcgaattaatgaaattttggcgtgtagttacatctagcatcttttcaggtctaaatcaagaaaggtttcttttatctacgatggatactggtttgcactattactagctatatgaacagtccaatcaatgagatttgacactattcttctctcagggtgctactggcttgtcacactgatacaatggatggacatggtaactgcaagtcctctaccaacataatctaatcactatcggtgtagtgctttcgcggtatcgatctgatctgtcttctaagccatctgcatccttttaagatcccatggagtgtaaaaaagtcaaagatcgcctagtcacggaatacttaaagattgaatgtagtcgacttaaccgaaggatacgctccctgaaaaatccaaaagttgagcaagccctactgcaattcaagaactcacgtttggctcacatgagaaaggctcatctggatggaataagaaacccacagtatacggatgacgccatctttcaggcattggaaaccatggatttggaccacatatttgagaaggcaggtagtctttacaactcacagcaacaagatgaatcaaaaaaagattccctggatgaaacagatttcaccgtggtggcgttgctagattggttcaagaatgacttcttcaaatgggtaaacaagccaccttgtcctgtttgccatagtgaagatgaaagccgcataagaatggtcggatctgcaaggcccactagtgaagaattgtcgtacggagcaggggtcgtagaggtgtttaattgtgaccattgtagctgtgcaatcagatttccaagatataacgaccctaagaagctcctgagaactagagctggacgatgtggggaatggaataactgttttctgttgtgtctaaaagccttgggtctgaaagctagatgtgtgaggaatgtggaagatcatgtatggagtgaatactactcggaacatctcaagcggtgggtccatctggatagttgcgagaatgcctttgatcaaccagaactatactgcaaaggttgggggaaaaagatgagctattgttttgcttttgatgacactctcatagaagatgtgagtgccaagtacattactcaaggtagactgcctaaaatgctagacgacgaaaccatcagaatatgcttgtattttttcaaccaggaagctcttaagatggtgagtgaaaatccagaggcattctactccgctttggttaagtatcacagatgtctgtctgcgaatagaaaagagagcgggtcaaaatcacgagccgtgaatgctagtttgacttcattgttaccacgacaatctggtagcgcatcctggacgtctgagagaggcgaaaacggactttaggttaatttataggcaagttgttttgtacataattgtttgaatgaatggtctcatgaagggaattattcgtcaagatttaacgctagttatctggtggtagggatataattaacatttcatttctattcaactaacaggaagatatagcctttcattgaaatgatgatgaaacaaaactggtattttcatacttgcagaacaaacattgtttactcgttatagtcagtaaatgttagctactcataaaacaaaacacgattttcgtgtaagaatcctctcagtggccaagctggctaaggcgcgagactgtaaacgtatttcagctaatcttgagatcgggtgttcgactcacccctgggagacttctttttttttctttcgtttttttttttcctgttttatatttctaaatgtcagttttcttgtgcttgctttgataaccttaaatgcattgcctatatctaattctagttattgttagaatgcactaataagtatctacatggtgcaataaataagcaaatcagatgcggacgattgccaattcgcgtagatgattccttatgacactccaaatcgggctgagtcatatgcatcttcatgcgctatctattagcgttgagatcactgttgggaatgattcgaagcctacagggaatataggtggtcatagagtggttagagtcgaagttgagttagccttcgttctttgaaaaggtgatcctccttaagtgctaactttcgtgaagaaacttcaaaataattgaaagtttcactccaacaatcagcgttataagtaattaatccaacaaaactgctgctgtgtgtgactcgcttcttccgccctgccaaggaatataaataaaaataaatcttcttgccgaccttctttaattcttccatttttaaaatcaaaaagaaaacatgaacagacagtcgttgatggcaggcaggagactcttctccaaagtcagagtggtcagaaaaccatccacgttggccaacgagttggggtctttgtacgagcataaccaaccaatttttgagcctccatcccctgaaaaaaaggtgtccgctttagactatgcattttctttgaaatctccggtttcaacttggactaaagaacagcttagagagatttacaacactcctctgatggaacttgttcaccgtgctcagatatatcatcgcaattttcacaatccttcggaagttcaaatttgcaacttggtgaatatcaagtcgggaggttgtactgaggactgcaagtactgttcccaatcggtgaacaatgacaccaacttgaaagctgaaaagcttatgaccgtggatgaggttgttgagcaggctaagattgccaaatccaacggcgcaacaagagtctgtttaggagcagcatacagaactgttagcaccagaaagagagcgttagaaagaatcaccacaatggtgaaggaagtcaacaagctcggcctggaaagttgtgtcacactcggaatgattgaagaagaacatgctagaaagcttaaggacgcaggattgaccgcatacaaccacaacatcgacacctcaagagaacactatcctaacatcattactacgagaacttatgatgatagactgaagacgattgacaacgtccagaaggccggaatcagtgcttgtaccggtggaattctaggtcttggagagacagtggaagaccacattggatttctgtacaccctgtgtaccatgaaacagcaccctgaatcactgccgatcaacagattggttccaattaaaggaactcccatcgcagacgagttggcccgtgacaactctaagaagcttaaattcgagtcaatgttgagaaccattgccactgccagaatggtgatgccaaccagtattatcagattggcagctggtagatacactatgaaagagacagagcaattcttatgctttatggctggatgcaatgcaatctttagcggaaagaagatgttgactactatgtgcaatgggtttgatgaggataaagaacttttagccaaatggggtatgaaaccgatgcagagtttcgctagtaaacgtccttcgtcaatcgtggaaacttgccatatatgattcttctcgctcctgaatttgataggtatagcgagctccttatctaacgacgaacaacttcaatcagtagatatattgttatataagcttagaggaacccacattttgtcgtaataaattatttatcttcaaaagagtgatatgagaaataaccaaggttcaattagctcatggtagcttggaggggccaatgctagtcaaacaccccgttgccaattgcctttttgagcgaaggtctcgctgctagttccccttagcagcctaacgacaagagaaattgtcataatacatttgactaatgttttagagaagacaattttttctttcgccttgtgaatcttttaaaccttcaagtcatctgctctactgttcgtcatgccagataaacactacagagattaccagcaagttataaagctgaacgtcggagacagaattccacgctctcgaccctcgcttacctcagctccttctccagatgattgtatgccaattttgccaatggtagcaatggactcaacaaaagcctcagattataagatagtcaaaaggcgcaagatagtgcgtacgaagactggatgcttttgttgccgtaagagaaagaagaagtgtgatgagataaggcctaagtgctcgggctgctccagaaatttcctggtctgcacgtatccttcggaagcgacactagagagttcacaacagaaagctaatggtagttctgattgccacaagaaaagacccaatttcatgataattcaagatgaccctacgaagctgataacgagaaactataatagctttgtaatcacatccatctcctccaacagatatatccaggaacgaagttcggggcccgctgccccctttcgaagcatatcgatcaaatctttactaaattgattttccacattcattttaattatgagtttagtgttgttttcttaatacatagatacggggggtttgggtttaatacatgagtcgttttatttttttttttgataatactagcaaaatactatacgcgtgtttcttactttgatcttagatttgcagagaccttgattcagctagcttgaaaattaggttatcaatattcttgaagttacagtcatcacgagcgaacgacctgtgaatctgggttttaatatgagtgttgagattgtcgtattctatccgacagttttcacagtacccatcgtacgcagcacgttctctcttgcgcttgcgatcttttttcactgttagctgtggaggagccaaatcttgcgcaatcttagcactctcttgcaaagtttcttcatgctggaaattccgttgtaatgttacggttttacgtttatctgtggacacttttttgttgtatacttcagctttgattggtcctaaaccattacctctattctgatgcactgcagagttttgagaaacttgctgagtagagatgttagttattccggaggcttggatttctccgttatccttaattacatgatgtgacttgttcatgagttccaacaataccgtatcattgcgcttcaagacgggcgcttcgaccggtggcttgttagattgaggtggaagtggggttgcaataggctggatttggttctcattatcttcattaagagagagaatagagtttgtttcttggtcttcgtctttattatcatcttctagctgcggacttgggttcatgacggaagtgggcgcttcgacgttctttttcaaattggaagcctcatacaaacgaagtctatattccttgtttcgttcgtatagcatgcgcctttttttgatcatgcgctcagaattgggtctggcgtagtctgattcaaatggacagcctccattagtggatgcccgtatatgcgggatatctggatcatctggtttggaccattctctgaaagctatgggtctatacttaagctgaaaatcataaaccagaaaataaacagctttgaaatagtggaagtcatctcttttagcgcttggatctctatctgttggaccaagtaatttttcctccttcaacaacgacgataggcgattttcttctgttccgacgactttctcattaccgacatcagcagaaggtaactctccaagattgcgtaaaaagcgaaatactttctcgtacgaccacactttcaagtttcttcttattgctttgtggaacaaatcgtttgctggataaacgcctttcgaattaaatggtctcttggacacaatgatcgtaactccatcattaaagaacatatctatggtacatcccaatctttccagatgttgtttggccttctttctctctgctgagtcttcatgagcatcgtactcaaaatacaccaccgtagatttcaagatttccctccaacattgctgccattgacgcattgaagacgacacatttgcattttgaacatacacattttggttatgctgagtcgtagctttttctgcgtttagcttccttgtctctcttgctggtgttttgcacacgttattgttggtctcttttagaggttgacgggtagtcataacgtggacaattttcgacctagtaaaagcttaaacagacaatagaaagtctccagtattggataaacaagctagacagtcttttatacacaaggaaagcgactccttgatcagaaatgagcaggtgtaggtttgttgatataggtgagacctgggaagagggatccatagcgagaaccgtgtatcgcgctgtgatgctggatgttccactacgaaactccgtaattttttcccatgttttctcatccggcactggtttgtctgcgagttaaccccatacacaccctttccgacccatagaaggcccacccatgctacactctagaaacatagcaaaggtgctacagcaaggattcaagccttctcagctgacggacgaatctcctcttgcagttgctctcattactagagatggagagcttctctctacagcaatggaaaagtctattatttcaaacagtcaagtagaaggcgatagttctttttccaagtctacgctgtcgaaaaatgatttaaaaatctactctttggtggctataagggaatatcattcgtatcaaaaaacgcaggctgaatcaggcggtaaggtggagaattggcatgctacaactataggggaacgtcgggtattgctttattcaatcgagaatacagatctactattactttcagtgactagattatcatatcctggagatatagcacttatacgcagtcagatcctttctgaaacgcttgctgctgggttgcaaggattcaagttgactgcccattaaccaagaaatttcaaatagccactaaaaatggaaccaaatgtaataaaagggctattaaaatcatggaaacgaaagactaaaagaaagacagaacttatgtacgatgcactctttgacgatcacttgtccatgccgtcctcggaaacgttgtccacattatcgtcatcctcggacacatttccatccataatactatcatcgtctccataactctcatccgagtcaaaccaaaaatcatcatcgactgcgtcttgttctggttcttcagctcgtggttgtccgtaggctgtgtctgcatctggcattatgaacccctcgggaatatcctgccgggagcgttcgacctcttgtaaaacccgctctttgtacttctcggtattctttcggtagtccaccgcggcatcaacgttggccggacttgaaatgttggggtcctccagcaaagaaactatcgaaatcagcacactttctacagtctgtgccgggctccatgtctcactgtctggttcatctgttgtagggtcaccacctccttggtggaggatggaaatgcagagtcttccgtctctataaacgtttggatggtatatggctggggtaaagcggaaggtaggtggggaaaatgggaagtccagcgggaacttcatttgtcctttgaagtatccaccatgataaatagattccttattaagcaccatcactccgatgttccagaggaagatgttatcgtcctccaattcaatatggaagcatggaacgcccttcttggggtctgtgagttctctgaactgccttagtaagatggaggcagctgctgcgttggacatgagttgactattagaggggggttatttgtatgctttgggtttgttgtcactgttggggttagggctatcaaccgaaaattagtaacttatagtgcgagtaggatccagttgagaaggtcctatcttttgtccttagttttggccgattttgcctctgagttgccacttttctttgtctgtaactttgttagtcagactaattaggaggttgggttatgtgcgaactgagagagaacaaaggtgcaaatgtggacagtgatgccgcgagaaaaagaaatcaaaagaaaaggagggtctaaaaccgggaggtagaagaggtcagaggattatcggagaagaaatgactatactggttaaattttggattatggtagaggccaggttacgacgcacaccaagtgctatttgtttggatactcttgaaagggtaacctggagttaatccgagatattccagaaggttttctctgcagtttcttgtgttactaaatagtgcatccggccttcctattaggatttacagcctattgtttggactacccggaagcttctccgatatacaccatccgtcacgaagaccttatggtttaatttttttttgtccatcttgtctttcaacctagttaatctcttacttttctcgtcatccagagaccagcccaactgctagatattctggattgagagtttcgaaagtcttttgagagtcacccaccttaggcagaaacgttataatacgttcacacggaagcctgttagaggtggttcaacactatgatcttgagtgatacgcactgctagaggaaagaaacttggtggtatgtaacttgccgaaggcctcgtataagaccggacctgtgatcacttaaaccagccactcggtcaattacaacgaccaacagagtgattggtaccttggtacctttaggtcatctacccctgggcctggctatgcccactagttgacagccagatcatgtgcacgctcctgcataacgttattttgataagtgtattacataagcttcaacctttcagctctatggatcgatcatcctctcttccccgtcatgaggaggttccttacaaccacatctagacccacatcaaaaaaggcacttttggagagattagaacagctgacagaggatgctctagaagaaagcccttctttactccaaacccccgaatttaagcagatactcgactctctatctgactcggaattcaaggctaaatacacaaaagagttgggttatgccaactctacaaagtcaaggtttatcccaaaacagtctcaagagattgctttatcacaaccatggacaggaacagagtcacaggctgatgcaacgctgagaatgctggtcgacaagtacaagccatccagattgacaaaatctcaagttagactgtcctcagctagagatgcgtctttggattacaagatatcaaaaatttcggaaaaagaaacatcctttgaagaagaccctcactttagagagagatataaagaaagattgttgggtccagatctgttggtaccttcgtcatttgcaaccgtcaataattctattaagtcaattgccaatacaaaaatcgaacaggcaatgtccgaaggtaagttcaacaacctttcaaatagaggaaaacctatgaaacttgactcttcttcccaatctgcattcattgacaagacagagtatcacttgaacaacatcctaaaaaacgagaatgctcttcctccgtggatagagaaacaggggatggtattttcggagatcaaatcgttcagaaacgaactagataagacctggagattgaaactagcaaatcacatcaagtcgttaccattgtctctggagcaaaaattagcatatcccaccaatgtcaaatcaaatcctacggtgtaccgaatatcatcggctgaaaaggaatctctctctgtaaaaatgaattctttgaatagctccctgagaagctacaacctgcaagcgcccttaccatctcaaaaaatgtatttatctctggaaaaggagctgcaagattgtttcaggcgagtatcagagacttcgcaagagatcattctaagacatttaacgggctctccaacagaatcgaaccccaaatccctgtcaacagcgaagaataaggagctccccacattcaaagatatcccccaacgttccaatatttaccaacactctactgaacctttaggaaaactatttctgaacttgttcaaagaaaatactaatgaactatatatataaaggtcaccatcatgatcggatccgtcaagcaactagcaacttcaaaccaattccaactagacagtttcgtagattaaactgcgcacttcgtagttctcattggcttcttctatgtcttcccagttgccaataaaatcgtccttaccgcggacgattcccggaagagacttgccagaggaataacgcttccaaactttgcgagcctcctcgtctgtgccaagatctctcatttggaaagcgacttgattagcagctaatatagtttgcaacctattggtacgggaagccacctggaaccctccggcaagagatgtaaataaataaactggctcgttttcgaaagccatggtgttttgtggaacatacgctgaatcgtcaccttcagcttttgaggtggataaagagcccttcaaagggtgggagtcatccccctgaatttctaattccaactcattcatgaggtcatccaagtcgtctgtggaagttactttagattcactgatatgcttagtttcctctgccaccgcctccgatgtggcatcagtggttttaaaaatctctgaaggttgtttgtctgaaatttgatcagaaggcgcaactttcgtttcagatccagcaacatcctctttcttagcctctgttgccttggaggaactgtctgctacttgagtgctctctgaactactctcttccaagaaaaacgttccagtcttcgatgcaggattttcgtcttttacaggattagtccctttttggtcgcctagttccggctcaccttcctgtaggctggctttctccgtttcttcctccgtttgatcatcactttcagaaccctcattctcatcctcatcttctatatccacatgcccatcaaccggttttagtgcttcatcgactgcctctgttaattcaggcattggtgagtattggtcatttgtcaacacaccctcctccttcaattcctcttgggtggcaatatctccatgagcagatctattcaatctagatctagatctagaaagtgaacgcaaatagttaattgaggaagaggaaactgatgactgagtcctctcatgtcggggaagtctttcgttgtgaccgaagtcacttggatgaacttgttgataggagtctccccgggctagatgtggtctacttgcaccagcacctagcctcagactagaagacgaatcaaaattagttaattcaaacttcatcggtgttgcttcacgcgagatgagactttccttgtccttatctatatcgtctgactccattgctctggatcgagacccacttaacgagcatgctggagcagcataacgcatttcaggatcataaaactcctgattatatttctcttcattagcgctgatttcagagagactgacaagtttagctcgagacacattctgggcgtccttgtttcgatacagtttctgtttcaagtccaacgcgtcttctttgatatgcccctctccatccatgacagaattcagctgttcggtataaccatcgttcaaaagagcacctccctctttgagttgattgacagtaacatatgaaggagacagagtgcctgtcagactctttgagtgacgagtcttggaaggtgacagggttcctgatggaggttccttatcaaacaattcccggtctggggtgtcaatggctcctctaatcgaggtaccaattaacgaaggcgtgctttgattggtgtccattatcgatattgaaatacgacagtattatgataatgtttcgggcgagaactgaacggtttactagataactagagtgcagccagtgcggtggtacgagcgaggcaagataaagtgagtttcaatgatctctattcgcgcaaaatgattgtgccccacttgtcagacggatgatagatgtcggattaaccggtactgattggtgattccaagcaaaaactaatttaaatgtctgttctaacttacttagtattatttggttagttcttcaatacgaacttttaccttctcaatgtcctcaggagctcctgaaattgtgatcacctcagagtcggaacctttcttgggaatgtttatggcaactttaaactcttccattaactcgttcttcacagacccaccataacctatcaatcgcatatgcctatttctagggacagtaatcttttctgtagtattgctttccaaacgaccaactaactccttaacttgactgattactttctccacaatggctttttcaccagagctgatgatttctgtggattcagagtcaacactagggacttgtaggtaacttttccacacacgctggctttcatctacattggctccggccttgcggataatctcacgtaaagtggaaccatgaggaccaatcaggtccttgtggtacttgcgttccacagaaacagttttcttaactctgttctcaactctcttgactatttcttcaatacgaagacgtgcatccttgatacctttcttagtaccaacaaggtaaaacttctcgccagatttattgctctcgtcagaggcctcatcatcaccatgtctggtgattttaactccagtctcttcactgatttcacgaatagtctgaccacttcttccgataacagacgaaagtgctttcttaggaatggtaatgctatcagtaactccattttgacgttcatagtcgacaaattctttgatctcacctaaggctttagtaacaccctttgacggaccaacaagtatgatgtcactatattcagcttcaccgtcgtcgaccctcaactggacgttatatttctcacggaatcttttgacgtaagttccattacgtccaataatgctgcccagatatttcttttctacagtgatcttacctgtcttacggtcagcccattctttctgcaatgctgaaatcttcttgatacaggcatcacaattggctttcaacccaacaagtttaactgggacttcttgttgctcgtcatggtgctctctatctctgccactctcgacactaacctgaacgtcaaattcttcacgtaaactatctaagtgatgacctttctgtccaatcagtaaagaaagcagtttcactgggaacaagatctcagttgtatatttacaagcattttcataatctttaagttcttcgataaacttttgaatttccgtaatggcttcgtcaacgtcctctttctttccaacaattacgagtttgtcagcagagtaaccatctgcatctcggtttaggttgatgatgatagtgttttcaaacttctcggtcaaatgattcaatgttttagttgaaataagcttttgttcattttctgggacttcaactactctttcttctaagtttgagctgagctgtctccatttagcaagggactcttcgactttgtccaatctagcatcaatctcagcctgagatggtaagaagtcttcatcatcggtggtgttagcaactaaaaccagcaggttagatacaccagccaacttgcctaaaggaatgagagccacattctcttccttggcagctttctggtctatacggtcaaagaaaaatgcattgacatcatcgatagcacgcacagagcttgggggaattgaattgactttgttaattatctccttcttgacctgttgaagtttctctggttcgcttgccttaccgctaaacgttacattcagggatttggaatcatcagaaaccagctcgttaaaaaaaggactggtaatgaggactccgttagtgtgagccaatttatcgaaaaaagaggtgaatctaaagtaagcagccaatctctgggcatgttgaaagttaccaccatgtgccttggagatatctaaactgtaagaagagtaattctttgtctgactcttggcaagagcgacggcattaggaatgttggaagcatcgccaaaaaagacgacctcggcagatggatcatccgcatttggaattgagacagaaacacctgtttctttgaaaatatcatcagcgtctagatattgatgcagtaccttgggaaccgtcttggattcgcttacaaccgaactctccacgcgttcaatgatttcccttaaggcgttacgggccttgattacgtccaaagttgggcccgaaacaatgatgttagaaactccttggtttacctcaggaaccagaacttcaactgttgaagggagttctagctgtgaaatgacaggagtgaccaagggtctcaaggctttggccaatggtatgcgcacagatgtgttaagagtgtgcttattgacaatatcgaaaattaaagacttggcaagctcacaagattcaacatcaccttgcaccttgacggtgaccagaggaccaaaaatgtcatcttcgtcagaaccaggttcttcactcttttcagaagtgttgtcatccttttcaatgtcaatcttagcgtttgttgcatccaaaatgggcttcaatgtcttaccctgaggtccaattacggcagatcttgccttggaagggatcttgaactcaatatcaacaggcttgcagagctttcttagaatttctcttctagcctgcttaacattttcgggtagaccagaaatcaaaaaagttctggcaccagttcttacagaaatggttgattcgatgcgaacatttaacctattcttcaggtctccaacggccttctggatttcagccttggacagctggaatgactgctggtcgttgtcaatggtgaaggtgtcctgaacattctgtgatctcaatacagaattcgatttcttgggtaaattggaggaagcgggcgtctcatttacccaaacaggtcttgagccattagaagatggtgacgtggatgctgacttgatcgaggggaacaatttttcattgataaaagaagaatctccagaagacggagtcgttgtacttggaggaagtgactcttcagcggtgccactctcaacgttggagaaacttttggtgcttaaaagctcggcaggggttgacatttcaaatatgaactattaacaggtaaaacggaggcaaaaaaaagagggcaaatcggggacaggaagaaaacaatgtagtcgaaaacgaatatcaaacaaagccggtgacttcttctcaatattcacaaatagcaagttgtaagacgactgaaatctttggttttctaaacgagagagttcgaatggtcaaggtggtattctaccctggtcctgtcgggcgcgccttagtgaaatatcaaatcgtggcataatgggtagtacactacaacggttcggaattatctactttatggaataatgacgatggattaatctatagagaaaagatagctgtacgtttcttaccaaacgggtaaacaaagagagtagcagcaaagagaccaacactaattcctatagcaacctgaaccatggcaattccaaaggacatggaggacctagtgttttgttcatcggtggtagtggagttggaaacaatagcgttagcagtttgaagtcccgccaacagagatccttgcgaggcaattcccgaaggcacttgcacgaaaattcctggtaacatggatgtgacggccattcccttggcaaccctagaatataaattagccaacacaccaatgacaaaagctccaattgatgctgtaaattctgtagattgggaaaaatgcaatcctgcgaagtagttgcatgcgtagccggcggatgatataagaatcatcactggaagttgaatgggcttcgcttgattcacgagagccagaccaacagagaacatgggtacaaatatgaaacgataccatggcgaaagtgttctgggacaaactgaattatttgtagcattggaatctatccagccgtacaaggcagccccaagagttattccaaaacctaggaacaacgaataaataattgcgtagaacattcgaactgctccagcaaccaaactacgggattgtagctccaaagatccacacaggatgatgtaacccggaagaattaatgctagagatccttgaacaacagcagcaaaacaaatgtattctccgccgtgaatggatcccaatgctcttcctaaaaagctcaccacgatactagcagaaacttcaaaaaccgacgaatataagtttgatcggggtgccatgtaaaattgcaacactccaacgcaaagaccaattccaaatgccacgggcatgtcaagccaacgtcccccaaatgcgaaaggcgtcaccattgcgctagaaaagccataaattaaaacgcaggcccaaggagggtaaggattattggaagacaacagttcatcaattttaaaactggcttcttctactccaattatatcatgcacaacatctttgtaaattttatgagcttcatccagttttcctaaattcagtccttgagaacacttgactagttgcatttctgaagtcctggttgcagcatctccaaacgagaccagcatacagcctggaaggtataagaactgggcgtcaatctctaatactcgggctgtcatggttaaaaattcctctagtctatgagttggtgctccgtataacatgaatgctttgcacatccttaaaatgaatcgctgacgctgcaaaatatcagcaatatgaacagtaatctttgcacgagcctcatgctttttgggaggtttaaagtacttgctagctttcttcttcctattggctgggttctttgctcttgtagtagcaaaagtgggcagatttatctcttcttctccttcgacaccttcagcttttgcatctttgcttttgttcttggattgggctctggctttagatttagagctgaatgaatctctggcattcttcttcaaaatccccggtagtgagacggcagaatttcttgatctagaaaacttgggatgcaaagttccttcatcatcgtcagaatctagatcattgtcgtcgcctgattccggtatggttaaagtttgctttgatcgccctatattcttgagcttgcttgtgagtttggcgacatcaggacctaaagagtgacccattctggatggactcatagtgcccgataaaggcgtaacagagccactggtttcgccactcaaagcctctcttgaaacgctaccagcctcattctgataaagcttcaaaagagacgataagacaccggcttgaaactttttggggcgggcgataacactgtgaacatcaccgtcctcgtaatattgatcagaatctaagtcttgttcaagatacatctctggattaggagtcaaaaacgatgaactgccatttacggacgatttggagtcgtataaagtggcgtccccatctgtgatcaagctggtagatgatggaattctattgtagatgtcatgctgatctatcaacgttttagcttccgtttgcaagtttctagtattcatgttttcaagttgaacgtctctagtgttctgaccattctcttcatccaactgctttgtcggctgatccttagttgctcctggaattaaaccaccgattccggatcgaaagtttactattcttgatactaacccattgctacttgaggaatcatttgtgaccttcgacgccactttctcaagttcgttatagttttcgtctgcctcggggtcatcacttttacggaacaaggacattcttctctttagtcgttgtccaagacttggctgttgctctattgtggatgcatctattgtgttgaagcttccagtactagaatctttttccttctctcctccatcggttccagaacggttacggttaacatcttcagattcctcttctgttgtaacatcatcgtcatcgtcactactgttgtagaattgcacaactcgtttctgattcggtcgctcgttgatgtcggtgtggttcgaaagtgtaggaagaatacctgtacctacattaaaatctctctcaatgatagagcttgcatcttgatccagttccctctccataacttgtcttctgtccaaacttctttcggtgcgtgattccagatctgtcgctttctgattgtcaacaaaagaagaagcttccacttcacccattccagaaaagaacttgggtaacacaggcgtatttccatcatcactctcactgtcttcaagaagtggtggcgaactaatctccgtacgggaagacgacctattatgggagaaggaggcatctctactatatgacttattcttgctgaactcttctctgagtcttctgccgctaggcgactgtgatcttgatcttgccttgggattgaggtttttcatcgtttgcgacagcctgtttccccgagaagaaagggagcgtaaatctgtcctgcttggagatcgtgaagatcctactgagtcagacatattatattggcgtttatcaggtgtagtagactctgtttcatctattgaacaaagtggaaaaagaaaaaaccgaccttatgaggtaactgcgcatcaaggtcgaaggaggaatcgcggttgatgacgtaataaggctttgtatttttccggataagacgtgtgtgcgccttacgcgtcgatcctatatttagattgtatttcatttttttctgtagttagctagttctaattcattcgtaaatccattaatacaagtgatgcatatatgtcctatgtcgttcaaagtgagaaaatagtcgtgtttttctttccgaaaggataaaccacgatgatggctgcaaatagaccgacagtgatcccaatcaccacccttaccatggcaaacccaaacgaggtatcaatgctgtaagaactgctagtgtgagcgttagaagaattggtcagttcgtttgctatctcgatacctgaaataagagaactttgggccgcaattcccccgggaacttgcagaaatatccctggcaacatcgcactgacggccatacctctgccaagtcgagagtagacattggcaagaataccgacaacaaaagacccaatcgaggcagcaatttcagtagcattcttgaaccgaagtccagcaaagtaggtagcaacatagccaatagatcctatcaatgccatggccggaagttgggaaaacttggcctgattggagattgccatggtagttgcgaaggcaggtacaaatatgaataagtaccaaggagacaagctcgtagcgcatctggtgacattggtggccgagtgatcgatccaaccatagagcgcagctcctaatgtgatgccaaaacctagaaatagtgagtagatgatggcatagaacactctcacggctcccgatactatgtttttcgactgaagctccaacgaaccacaaagaatcgtgtaaccaggaaggatcatggcaatggatccctggaccactgcagagtagcagactttattctcatttatcgatcctaaggctcgagcaacgaagctcaccacgatggtcgctgagacttcaaagactgtagagtaaacgttcgataatggaacaacataatactgaagcatggcaaccagtcctccaacgccgaaacttacgagaatatcataaccttttcccctgaaggcaaagggacagaccatggcacaggccaaggcataagtcaagacgacaactggacgagagtagtaatctttcccatttagaagtttctcaatagctgatatagcctctggaacgctcgtgacatcatgaatcacgtttttgtagacctcatagacttcatccagttttcctaaattcaagccctgaacacttctaactagttgcatctctgatgtcctagtaagaacgtctccaaatgctacagtcatgcatcctggaagatagaggaactgagcgtccgtttccagaactttcgcagtcactgtcataaactcctccagtctatgagttggagctccatatagcatgaatgctttacatagaagaagtataaacctttgtcgttgcaaaatagtagcaatgtgcacagtaatctgcgctcgggtttctacttgcttcttcttcaaaagtgaaggacctttctttttaactttgggtcttgttgagctgaactttggcaattttttaaattcatcttttgcttcttttgacgctgaacgtgagtgttccttgccaaataaaacgctgggaattgcgtattttgactttagaattcttggttcactgaggcttctaagatgagatttgaactgtttgggaaatgcctctcctgatgaatgacgtagattgcccatttctattatgcggctttttgatcttgagctggagtggtgtcgcaagggagaagatattttcaagtggtttcttttctttctagatcgacctcttccccgagtttcttgctcctcgtcactgtcttcggaatctattgatagagaatggctagtttgactaattggattctcatacagtttgagaagatgggagagtacaccttggtggatgtttttaggtttgccaacctgtactcctgccatttcatcgagatcatttagaccctcagttaaataggagttgatggccagggcgtgatttttgctttcattctgatttttgctgtgatcataatgtttatcaacaagatatgttgtaacatgttttaattggttagcatcaagatccgatagttggatatcttggcccatttggctttcttcatctttgggtggaggtttgtctgtattaatagagggcccaatcatagttcctttgaggtttagaaacctagataaaaaattgcggccatgctgagttttggttgtactgtgtgtacattctttttgaattgcattttcattttcattttgattttccatgtgtggaacattctcaatatcactggcctccccctgagttggtgtattactgtttgatgagatactgctagtattggtgttattttcagataaaactggcctattagcaacggtatcgttagtactgtcaagactaactctgtcgaaaagacctactgaatcgtcttgaacatttagttcatccgcatcttgatctatatcctcctcgatttgtcttcttcgggatgaatcaggactggttacaccagcttgaacatgaccccttagatggtcaaatactggtaacaatgggggtaaatcttcgggttcatcttcagactcatcttccattaacggtaagtcgttctggatgcctggactgtttaacttggaaccatacctcgacctagaatgtgactgagacctggaatgtgaccgggacctcgaccgtgatctagacctcgaacttgaattggaccttgagtgtgacaccgatttacggagaaaagaatgtgaacttgagttctgatgtgatggtggaatatttctgctagctgaatttctgattgtcgtttgaaatgagatatctttggggtttggcagagcacctggctcgggtgagggattggatacagaacggtctgccaaggagctaatgtctgagtagcatatggagcgggaaggagatcttgatccggggatggtttctattggaggggaatctctatctcttaaagagctcatttgtacagacgtgaattatcaagcgtgctctaatttatttggctggtgacggttgataggtgactttattagcagatactcatggaaagaagtggtcgaaatgaaataagtaacagttctcctttttactggaatgccattcggaaattctcagccatttaattatgtaatttctaacagagcgcgaagagatgagatgagctgataagatgagattgtacaatcggaagacaggatacgacccgctctcaagttgttaaaacatgtaataattcggtattactagcagcagtattgtagtcttgaaaaaaggttttattctacaggctaaacgcctagagaatgtaaagtaaggaagtgggaaagcagcatcgaaatccgtgatagtttagtggtagaaccaccgcttgtcgcgcggtagaccggggttcaattccccgtcgcggaggtctttttttaaattgtggaaaggcctagaatacagttggagcgccttagcaacgatttgtggaagggaggcgtgagtccaagcactatccggagtaatccatatactgagtgcaagcagtacctagtaatggaatcaactacgccagcattcagttcaagtgtcagatattttgacggaacgcacagtttcatcctgaaacgaaccaagttctagtttcttttcatgggacgagagtaagagctacttttgtagccctgtgggaggtcctgtatcctattatcatcttgagtcatcggaacaatatacgtgtcattcgttgcatttataaattctagcgcgtgtgcacttgtgtactgattgaatgcattacaccagtagaaacctggtacccatggataccattacatgttcgtaataaaaatgcgggatgttgttctgtcggccttttccccccattctattcatcctcggctttgacgaaaagatctacaaaaaagtaaacatcatcagataagaatggcaagttccgagggttgctaaaagccatatggctagaattgcacaacatggatcagcctttgaattaaaaggtttcaaaggcttatggcggcttgcagatggaatgtttaaaattcgttctttagattacaaaaccgactgctcctattgcacttttttttttttttcagtctgaaactgacaattatatgaaaactttcccgatctggaactttgcgggaagagttgccagagaaaaaatagcaacaatgcatcagattttctaacctattcataaactgcatgcattatgcaccatttgatgcccatgggctatcttgagaaatgacaccatgcatgtcgcacaccaactctccttcataaaacaactctccctatacttaaagtcgaaacaagggaagcagcatggggttgtgagtagccttaattattcccggcagccaactttaagcagggacaaccggagtgtatgcacagctctttttgtttgtctggcattcaatataaaacatctcctgtttctacttgcagatcattactaaacaacgctccactatcaaatccgggtgcgcttgttgtataacacaaacaggcgaaaaaacatatcgagtttgcttttaactctgtttttgccacaaagggactaaaaggtgtatttaagtatctctttgttccagatccagctttcacctcccaatgctgttatcacaacacgacatcaagcccaagagaagagagtccaagcagaaccgtcccgagatcgccctgccttctgacctacaggatcccccaaaggaaatccctttaaggtccttgcaagattgttacaagacggtcagcagcctaggaagtggcagtttcgggtctgtggttctagccaagatcaaagatgaatatgttagtaagctggctttggacttgacaaacccagtccacaagaatactcttagatatgttaacccctcggttccttgtaacaagtcgtattcaggtcttcatgtcgttgccataaaaacaatgacaaagaggctgactcatctaagagattacacaaaggttaaagaggttcgattcattctatcggtaccatctcatccaaacttagttcagatatacgacctattgattgactcaaccacttttcaactacaaatcgtcatggagtcgatggatcaaaacttgtaccaattgatgagagcaagaaaaagctcacttttctccccgaacacgcttcgaagtatcttagtgcaactcctggcgggtatcagtcacattcacaaacataatttcttccatagagatgtcaaaccggagaacatcttggttgtttctaacactgcctattatggctccaaagagagcatccctccgtcaagaagaaaggatgcttatatcattaaactggctgactatggccttgcgcgtcatgtggataacgtaaaaccgtacactgcctatgtatccacaagatggtaccgctctccagaaatacttcttagacaaaagttttactcctgtcctgttgacatgtgggcgtttgctacggttgccgtcgaagtaaccagttttcgaccattatttcccggatcaaatgaattggatcaattgtggaaaatattggaagtcttgggttctccagagccaagttctaatgcttactctgcagaatttgagcctgattcgtttgcaagttcagctgtcccactgggtggatattggcccaaagctcaatctctggcaggtgatttaggctttagtttaccagaggtagccggtatcagtatgtatcaactgattccaaggactgacttacctactaatgaccttcttgacctgctcaaggttgtcaaagcgtgtcttgtttgggacccagagaaaagggcttcagccactgacttgcagcaaatgagctacttccgaaaccatgtgcctcaatatcacttttctgatagaacttccaacgaatttgtgtcacatgcacctttagctacaagaaatcaccattcgattcacaacactgggtggtccaaaacaactaatggagaaaatcgctttgtcaatgtccaaactgccccgctgtacaataataacgacgagaatatggaatacagtaaaccgtcataccttcaaagtaagaaacgaaggcaggatgaaatggtaaatcccaagaatattgagaatcccgtgtatgatgtggatgaacaatccatacgcaaattcaaagaggatcagtaccagattgatcatatctctcaaataactgacaaagatcagatgagtgaagatgataatgaagatctatttgtggagtttgaccctcaggacgtaagggacttcactgatttcagtgaattcaagaaagatctcaatccatcctcaattgaagaaggggtcaactatcaaacacaacatggaaagtataaatcacagttacaggatgatattatgactggcattagcaaagatgactggaataccaacgagtatttaaactacgttggaagctcgaagtatcaaagtgactccagtttatcaatgatgaaactactacaaaattgtgttgatttcgatatgctacaacatgatcaaaatacaagtaccctttctgactcagaaattcaaaagttacacccagaaggcaatgatatcttaactggatctcctattaacatcaaaccagtggaggaagaacaacaggaatatacctggaacagtgaacgcacaaaccaatttcacagcagcaccccattgagaccccatgcacaagtacaagggaatgccaatattctcgttcaagatccctcattatcaccaaaattaacagctatctagaacaagatgaaagcagaatcagtagatgaacaacaactaattaattaaattaggtgcaggatccattatcatggttctatagatttactaataaacgagctacatgatcggaaggctcaagagaacttgctctgattcttcaacagagccattctgcactctttcccactcctctgttggttctggctgagtttctgaagagttgtcatcttctgagtgcatatagacaggtgctttccatttttgtttatattcttcaggattccaaactttaccgatattgctggagagctgttcatttttcatttttttaactctagcctctaaatcctctatgccttgatctatttcatcagtagggtcttcgataatcgattcttgattcatgaccacttggccgtcagcaatagagatgttaaatgcatggctcgcacgcccagttttagctttctctgaagattcttgttttcgaagctgcctctgttgtttctttagttgtaatgctctctctacagggcttgcccacaagttaaaattttgattaggcagctcaaagtcagaagcctgatcaatgattttagtcctctcagcactagtttcttgaaagttcaacaattgatctagacgttcttgggcctgtagcaattccggagatttgtctttgattttcgcatagtattccaactcaaatttctgctggtctaacttcttctgctcttcttgagcttctactgcctgttgaagttgtttttgtttctgagagtcaatttcattgaaaaaaatctccttttccaaaaagttgtttttacccttttcgttcatagaaaggatcagttttttcttctgtttggctttggttttgtcatttgaagaatctatacctgccttctcttccagtttgagtttctcctggtttagtatctcttcaatttttgacttttcttcattgctgagaagttctttcccgcatgaggaacacggttgaaggccctcctttatgcaaataatcttcccgcagttaagacagttgggaaacatttcgaataaaggatgcctttgagccatacaatcacagaatcgcttggcaggccgaggctcaccatctagggggactggctcattcaattccaattcggctattgcgctgtcgatgtctttgagactatttagcgtttttttcattgttttctgagtatcattagaagaattttgtacttgtagttgtgtccgtaatggattattagatgaatcagaggataacgctgagcctgaacttgatatgggtcttgtaacaacttttctgacagtctttatcttgcttggtttgcctgatgttatttttatacttctgagcactgatggtttagactgcgatggtgatggcgatggcgatggcgatggcgatgtagatgacaacttggggtcaggccttgctattgaagagtcttcttggatcgccttcccagtcctggggctcggaaataacatttcttggaagttggaaatgaattggaacgaatctgggctttctcctagcaaattcaggaaatgttcagcaatttcttcctttgttcgtaaagtgaaagcatatgtaatgacttgatctaaactttcgtcatccaatggcagtatccttgaaagctctatcctagcacgttcctttacttggtttctagaaagatcggacatgtttatttagtcacaggataagtcttacattggacatctcccattatcgtttttgctaagtaatcgcggattccttttcttcagtttctctcttatcaatactcttattgtgtatatatacctttggattgactctaaaccaagttggatagactctttcatgtccagtactgaaaaacagttggaagagataaaaaggcgatatgccgatttacaaagtaagtaatttgttgcgactcaaaaatcttcaaacgacctactaaccaagtaagaatccatcgatgaaagcaagaaaagactcaagacattaggaacaatcagttccgctggacagaagaatcattacgctattgccaagccatctataccggtattacacagaaagcagaaaatgttaaatgtctggtgcaagaagaatgcaagtgaatatagacacaagaacaggatcgacatagacggcagcaagtacgttgagattaaaaatgcctcgaggttggttccagtgtctcacttggatgctggggcttgcgatgatgaaaagaaaattaccatagataatagagaatacgtcagacagaaaactggttcatttaaattgttggacaaatctaaagagattcaagaactctgcatttatttcgttacgaccggaaattgtgctcgcaaaagcagttgcaggtatttacacgatgccaacatgaaatcattatgcaaagagtttctgaaaggaacttgctacaatgcttattgtacattatctcacaaaccaacacaatttaattcaccttcgtgcaaattttacaacactggattttgttccaatgaaaattgctcttacacacataagaaagactcttccgaagctgccgtttgtcggccttttgcagtcaacgggatctgtcctgatggaatgacttgcaagctacgtcacgaatttatatgcccagagttcgatgagagtggaacatgtcacatacggttctgtgctcttcctcatccttcaaagaaggcccccaccactaaaatgttcaataatgtgcgaaatgaagacaatcatgccgataacaaggcccctctacgtgttgatactacaggtaactcggagaattcaaagctttggagctccgtctccaaagggcttgaatctctgctacatgaaacaaataatcattcaaatgagctctctgatctttccgaagactcggacagtgaacaattaccccaaaaatctcttgaaggtcctgatggactagaacacaacgacgactatgttaagatcacatagagaccctagattagactttaaatagtaaccgttacccgacgtcaagattttttttctatggaagggccaggatttttttttccagtagaaagtttcgagcccacgcacctataaaaggacccactatccttaaacctttttttcttcttcacatcagtagtggttatactatctcaagatatataacttatttacttagaaacccagcaaaccttcttactagcgttatgctcggtattagggtttgcgatcagctaaatgcctattgacttttttaacagagaagtcacaatagctatttcgtttcggtttcttagatttatttggcatatgcgttagggctagaagatgtaaacctgtctgtgctcttttttgagttgacgatggtatacatccgtctattgcgatgctacatctctttttcaatttgtcttctaatttatatacatgcatattactctggtttggatgaatcttttccagatgctccttctcttgcctttagttcttcctcagctgctttcaattcggcttccaagcgttctttggccctgtaaattttgctttgcaagtaaaaactacctccattctctttactgttgatatcaaacagataattgtacttttcctgtatcttagtgttgtccagaccctttggttgaacatccaatattttgcaggcctcgtctaatgaaattccggtgtctctcactgctgttgcagcagccgaggctccttgctttgaagtggcggctgcagcctgtctgtaggcctctgtgaacgctctgccaaacaccttggctccagtgaaaataacctgtgtaactaatcgatgagcctaaaacttcctgttagtatctaacgtcccggacaaaaagatacagtggtaggaatcacacttaccattttctttcttccgtttgtgctgtgtagtggacctttggggaaaaaatccggtggttggtggtagaagtgacctatttgatttttctctcctcttcccaaaaaatagtcgtgtacaatggcaatattgtgtaaaataaattttgtatcagtacaccaccacctttccttattgaaacatttgatcttcgtacacaacttggttcaatttgtaacctgctcagtttagcttcgttggatacttttgcttttctttgctaatggctttgtaaattgtctgtgtgagctttttatcagataattttttgacagggatacttcgtgccaagtaagatttttatctgcatctctgatccaaatgtctcaggacaacaatgaaagtagtccaatcaaggaccaagatgctgctgcgttgctaatgctctttcaaagccagccgcagaactatcatagaccgaatcagcagcagcagcagccgtctcaatcctcatatatatatcaagcaccgtcacatattcctgataaaaccgaacagttaccgcatttgccacggatatttgattacgaagtaccgaatcaacagcagcaacagcaacagcaacagcaacaacatcagcaacatcagcaacatcagcggcagcaatcacaatctaaacagtcgcagcaaccgctgtcttcttatcatttgaggcctccttttagcgcttcgaacgagtctcatggaaaagagcagaacgctctaacgcccgtctcatctgcaaataacgacggcgacaagaatggttcaaagatgtccgataataacacaagtccaggtcctgcagtggctgctctgaccaacgatgataacagagggaaagctcgtatagcagctgcggcactggcggccgccgcagctactcctatgccattattgaacagatctcatattcctgttttggggcacggcagtgctccgactgtcaccactcaaactgttacgaccactttgcctgttcaaaatgatcagactttatcttcaattccgaattcagctcatgctaccgctccttcccccgagacttccagcacgtcctacgccagaggcccatcacttgcgttccttctttcttccaactctcaagaatcgcaagagggaaagcaggcaattgaaatttacaagaatgaaaagatagaacctgaaatagaaacaccaagaactattttcaaaggcgaagaaacagaaccagagactgagcaagaagaggcgcaaaatgttgctgtcaataaagattcttcagctaaaaacgagaacccagcaaaagtgtcggacccacttaatgatgaaactgacaacagctctacagatagaatgcccaccatggaaaaggttgactctgaagttgaaaccgaaacagaggcagagccaaaaacagaagaaaagattatcttggataatcaaattccacatagagtcgaccctgacagtggactgattggatgtatttgtggctctactgaagatgacggctacactgttcaatgcgataggtgctttagatggcaacatgtcgcttgtattgatccagttgcaattagtgacgagaatgctgtgtattggtgctatctctgtaatccaaccgccggtaccaggaagaaaagagccattcaagactctaagactaataaaagaagacgaggacccaatactcccccattacttgatgcttcaaatgaagataactccatcccaaacacagataatcgcacaaagggtagtagaagcactacgccaaaggctccagaggaaagatcgataccaaaagaaaagcgcagagctaaaacaatcaaagaattggaagagtctgacgattccttaatgttcaaagaaaaccctgaaactttatattactctattgattccaatgagtacaacgataaacttgtgaaaacatttgtggagcagctaccctcaagttcaagtttgcaagaacaatcaatgactaatctgtctaatgccaaactagacaaagcactggatcagatatctagtcgtctaaatgtccgaacttattcagaaaatgggaaacagaaattcaatggtatctccaaattaggtctatttttggacgatgatgctgaacctaattcctatgttatttcaatgctgggcaaggttgaatttaagcaaacatatgttgaagaccgcacaaatcaatactcaatttggggcgttgaaaaacctaatgtgttttttcatccctcattacctgtcgtctttgatgcccgcggattaggaggtaagtccagattcatcagaaagagttgctttcccaattgcgagatcaaaactgttctcacaaaggatggtaaaggatgttattttgtagtaactaccactaaggaaataaaagctggaactgaacttacgttgccctggaattgggatagaaattctcctatgaggagtatcttagaagggttgccattcgaccgaatagaagcacataagaagccccagctggtgagagcagttgagaatattctcaatttttgtgagtgtgcttgcgctatacctgctaattgcgggctcttcaaggttcgcaaggcaacttcgtacttgttcaggtcaacaaggaaaaccaaccaatcgaacttatctaatggacctgtaaacagtctaaacaagtatgacgaaatttataagaccgagaacttttctgaccacatacctattcaaactcgtttgaggaacagaactttacaaattgataaattggcttcaaacgaaactctcgtagacaagactgaaagtacttcagctgaaaagtctgagggggataataatggcaactccttgaatgagaatgcgtttgtgaataaacgatcgaagtcaaatcaatcgattcttgacaggcctcgagaactacttccatacatttacagaattttgaaagaggctcaaagaaagagaaacagtattaaagacacaggaacaaaactatctgaacgctccaacgatatgaagccaaccattgaaagcacttcaggctctattgacgattttccaactccagtgcttttattgaatgatcctgttgaacggacgaaacctgggattaaatcggccagtccttcaggcaaggaagtgaaggaaaagaagaagttttctcttgctgattatatgaagaaaaaaaatacggcataatatatactgaagtctcacattgatatatgagctattcataataaatactggtaatgatttaatcgagtactggcagaaattggccaactattagcatgggaatatcaaacacgtctctctttatcgtccaaacgcatgcacatcttaaataatcatcttgcgctgcctttcttaagacacaatttgtcaacagagttgcattcaggtctccaaaagcaatgctgctaaagagtttaaaataattaaccacagattcatcatccatcagctcaatgataaaagttcttttggacagtaaactcattcgggagtaaccagttaaaacggaaaactcgttagtcaaagcaactatctcaccagtacgcctccaaatgattgttggtgcagcagacattgagataagactctcatactccagtaacgatcgttgaaatgacctctctgtgaagatcaagtcattttcgaccaacgatttggttgctgaaatgaaagaaggtcggtacttggacatgcattttgctatttcaattaattgagtacgctcaaaccgagtttttaaatatttcgttaaagcatgataagcctttggatattggtaagctttgaccactctggtcagatagatatcatcaggattttttatgatgtgtcgcaagataagcgggggagtaaattcttcgtcttgttgaatttcggtggggacctctttggcggtattcggtattctcccatgactgcggctatgatcgaaaaatttaggagtggagttgttggggtaagaggaaaccatagtattattttccaaaaggcgaataaaaggcctctgcgtaaagtccatgtcaaaaaagtccagctcttcgttatttgccgcctccacaaagcttgtaagttgcaattcctcctgcttggcaatttccgactcataaactacagagggtgaatttgttaattgtgaatttgtgtgtgattgtgtatgagagtattgtgacaagtagctggaaggagaattaaggtttgttccaggctctttttcagcgtcaggcgatgccctttgctcccctggctcactgtatccaacgtagaacatatgttgaccttggggtgccgcgttcacgtagccataagaattattttcatatttcttgggtggttgaaaaagtgtatcatgttgatacatagagttattctctggaactgacatcttcaattgatccatcaaagtattacttccggtattaaacatctgagatgtggtgggtgataagaatgaactattattttcagcgttgggatgcggtatcgttggtattgtttctaaaccccgtggggtctgctgagtttgttgagctaccatgggcagctctgaagattccagtttagactcattaacggcagaagtcccagcattagtggcagacgaagctgaagggctgtcggattgaaccttctgagcactttgggcccgtttcttcgtaccatttgatccatactttcgtcgttgtatgtcttcacaactgtcaccaatgttgcgcttaacacagtttttacagggtctagtggcgtcacactggagatgcttaaagtgacaaaacttgcacgctctggaagttggacgcctgctccgtttaacttccagcggcaggggtttcgtcatactgtttacctcacgtcttttcggagtaaaaaagaagtttctggggtactttgatacaaactccgggttgagattcgagagccggaaaaggtttttttgaacgacaacatgcggacacccggaacaaggaagagactgaaaaagagcttacataatcaagatactgaaagttataataaaaaagtaagcagttctcactcacaaagtagaatagtattgaagggtcaacagttgactaagctggagccagcaccagcgcagttctgttaggaatatagacctggaaaaagttctttcgattgttccatggcaggtctgtagtgtagaattcggaaacttcctcgtcaatacgggaatgacctccatattcttctctgtccgagttcagaacaatcttgtatttgcctggagtctctacaccaattctgtaatcagtataggaattagttgggtggaagttaaaaatgaacaccaagttgtgacgttcaaaagcaataactttatcaccttcgtgtttcaaagaaacataggcttggggataattcaaccagccatatacttcctcagtcttattcatagcagcatcaaagttatttaaaaacttgtagcgcaataactcgtcgtccggcaaattgaattgacggcgagcgtagtgataagaatctccgtttccaactctagggaaatccaaccactctggatgtccaaactcattaccttcgaagttaagataagactcacctcctaaggaatgagtgatcagtctaatcagtttatggagagaaagacctctatcaatgactggagtcaaaggagatagtacagacatgttggtatacatttccttatccattagccagaacgccaaagtcttgtcaccaaccagagcctgatcgtgagactcagcatatgtgatacatttttcaccgtatcttctgttcactaaggtgtgaacaatgttgcccatattccaatcttcatcgttcttatgcttcagaattttgatccacatatctggaaccgacattgaaaggcggtaatcaaatcccacaccaccagctacccttggaagacaaagggtgggatatccactgacatcttcagcaaccgtagttaccttaaaatcaatggttttgccataagattgacacaaatcgttagcaagcataaggtacgtcagtgcctctttatctacggtaccaaatggattaaggtactcattatagtcaccactaaaaccttcacctactccatggtgaagatacaacatggaggtgacaccatcaaaacggaaaccatcaaatctgaactcttcaagataatatttgagattggataaaaggaaccttaatgtctcgtaacttccatagttgaacaatctggaatcccactgactatgggttcccttaccaccactatgaaagtagcagtggtcagtgccatcaaacatattaagaccgtcttcgacgttctttgaagcgtgggaatgaacaacatctagcagaacatgaattcccaaaccatgagcggtatcaatcagctctttcaaatcttctggagttccaaaacgcgaactaatggcaaagaaactagtaacctggtacccaaaggatgcgtagtaggcatgttccatgatagacatcagctgaacagcgttgtaacctaatgcttttatacgaggcagaacattgtttgtaaattccttgtacgttccaacctttggctcaggtgtggaaattccaacatgagcttcgtagatcttgaaggactgaggagccgcaggacgagagcttttaaagtggtaatgctgttcttccggtggattccagaatctggattcgtatgcaggattgttgtattccttaggaggctgcgtggctcttctaatccatggaggtaatcttgcaaccttctcacctgagggcaaagtgaatagaactttgatacgtgagtcatgcggaattgccacctgaccatccgcacccggcggaatagtaatgtgaaactttccaaaattgtcttttgtcatgacatgtgtctcatgttcccagttgttgaaatcaccaataacagcagcctgaacggcgtttggggcatattcgatgtagctaactgaattgtccttgttcacttgaaacccatacctcttgtaggagtcagcaaagttcaagatacctccctcatgttcttggaacttcttcagccaatcatcagctaagttacgtctgtaaagaagctcctcactgaaaggcttcaaccaggggtcgatgtccaaggcacccttaatgagaggcgaatctacagggtctgtggattgttgttgtttaatttctgacattttctggttgcctaaaaatattagaaagaaaagggggaattggtttggtggtcaaattattattttagttatgagaacaaccagtgggatgacctgaaggcgagagatttcagagttgacagattcgaatcggctgataaggccttccaccgagggtgcgatgagcttgctggtcgaggggagaaatcaatgcccttgaatgttggatgttgaatgctggatgttagtaacgaagttgagatgttagatctcgctattcgctatttcagtttggtggaatttgcaaccctaaccctaaggtcaaaatcgtgaccaatagtaagtagtccgggtaacataatggaccagctcggtggaaaaaaaaagttcaagaaaagtttcaaacatctaacataatccttatacaacaacatgtctactagacctcaagttactgttatctccgtcgagggaaaaccatcttctacctctttgcctttgccagctgtcttcaaggctcctatccgtggtgacattgttcaatctgttttcaccagaattaacaagaacaaacgtcaggcttacgccgtctctgagaaggccggtcaccaaacttctgctgagtcatggggtactggtagagccgttgcccgtattccaagagttggaggtggaggaacccaccgttcaggtcaaggtgccttcggtaacatgtgtcgtggaggacgtatgttcgctccaaccaagatctggagaaaatggcacgtaagagtcaacttgaacgaaaagcgttacgctaccgcttccgctattgctgccacttccgttcaatccttggttctggccagaggtcacagaattgagcaaattgctgagatcccattggttgtctctaacgatttggaggctattcagaagaccaaggacgccattgctgctttgaaggctcttggtgcttccgacgacttaatcagagttatcaagtccaagaagttgagagctggtaagggtaaatacagaaacagaagattcacccaaagaagaggtcctcttattgtcttcaacgaggacaagggtttggtcaaggctttgagaaacattccaggtgttgagacctgtaatgttagaaccttgggtcttttgcaattggccccaggtgctcacttgggtagattcgtcatctggaccgagtctgctttcgctgccctggactctgtctacggttccgagaccactgaatctgtcaagtctaactacagtttgccaaagaacatcatcaccaacactgatatctccagtgtcatcaactctgctgaggttcaagctgccatcagaccatctcttgccggtaagccaactcacttgcacgtcaagaaggtcaaccctcttaagaaccacgaggttatgctcaagcttaacccttacgccaaggttctcgctgagaagaaataaataatttagttagaaattactctgtgttatatcaatactattaaattctactatacaggtttcattactctagcgtaagaagtagttatacttcccatgctttgctctagggtcagatgctcccaacccttggaaatcccattgcaactcgatgtccagttcccttggattggagacatttggacgcgaagccatggatccagtgatagtctctcctctcttaacatccagcacctggttcatgtaaaatacggtttgtttccaatgggtgtagtgtgcatgaggtccggtggaaaagacaactttctcggtgtccccgggaaactcgatatcaaaccaagcgatgtacgcatgcactaattcgtctcgagtagcagtaatactgaaatctctatggaaagcaaggtcctccaaagtgaccgtgtttagatcaaactcaatcaatttggatgatgtggtaactacagatccattttcaacagtgtccacaaggggttcagacatagcaatttcaatgaatggactgtagtcaaatccgtaaacgttttcccagtagtggatcttgtcattcttataatttccatcctcaatggctgccacatgaattgaggctttatcgggaaagataaggcccccttccttcaagtacttgtctcttgcaaccaaaacagtgtccagcatggactcataaagtaaaaagtaacccatccattcactgatgatgatatccacttctggatacggtagttctacgtcttccagctttcccttcaatacggtgatcttgtcgctgaatccgttcaattccacaatcttctcagccatgtcagcaatattagacatatcaaccgcaatcacatgcttagcaccagctcttgcagcaaacatggaaaggattcctgtcccgcatccaacatccaatactatcttatctttgaagttggccttgttcttgagaatggcagatctgtagctaattgtgcggacctggtccttcaacatctcctcatggattccaaaatggtcgtaagaggagaaatagtgctgctcactgaatggcagactcttcttgtctgtggcataatccttatgggagctcatttgaatgtgcaggtgtgaggatttattcgaactgaaaatttattttagggaaaagaaacttgaacatccattgcatccatacaccacatgcacttgatgtatctcaaaggtacagtggcttgaatagtgattctgttagaccaactagactccactatccagctattccctcaaccaaaccacaattgagtccgttgtgcctttcagaaagttttgatggataattgaacttcgttattcgaataattcctctggccgttattccaattctctcacaaatagacttaaactctatttataaaacatgggtcgcaaggcaacaagagggagtcaattgagcacagagccgaatccgctggctgccaaagctgctgcgcttatgtaccaaaagagtgtgaaccacggcaatagtaatggtagcaatttggcaagcaacaagccgtctactcccgcccctcccgtttcacaaagaagagttacgaaaaaacaagagtctacagggccacacagcgagaatcattcctcagctgacaatctggctcatctgaaagcttcagggaaatcttcgagttccaatacagacatcatatcaccatctgcatcaattcaggaaggaatgaatagtgctcttgttgcagctatgaaggttgccaccgatagtccaggcttaatggtatctcaaaccacccacccaactatcaacccaatcagaattcctgctgcaggctcatatccgccatccggcaatacagagttgcattctcagaaacaacattcatcaagtacgttgtcaaaaacattgctatcaactccaaagccctcgtaccctgcatcgcagaaactgagctcttccccttgctcattagcttccagtatttcaaacatgtccgataccaagttgccttattcttcaaaccatttagcaattccgaatcctaaaatgaaatctgtcacaagttcaagcgatgcgctgttggaggagcccgcagcctctagaatgcctacagagaacaactctcctcagttactatattctcctctggtttttccatccacaattccgaatctttcaggggatctatccgatgccggttctaccagaccatctcgcaagcctccagctcaaataaatgacgactggtccgacaccaattctatagggtcttcgatagcttcgttgattcgctcagcaccaccagtttcatcatctatgccatcgaatgactttaaagattatgaaataccagcgcagccgttaatataccctcaaaggcgcaaaccaccaccgatagatatagattcaaacttaagtgacagtgaatctgatccggaggaggagatatccgaggtcgaagatacaggaataccgaagtatacaattggccttcagcaccattatcctcatactgaagatcatgatttccgtcatccacaccaccagcattatcatccgaagaatagcaagcttaagaaaatatttggactcaaaatgaatagggcttctagaagcgaagtttcactggaacatactgtgcagcttagaagtaccatgcgtaaagaaaaacctaagcgtacattcaacgaagataaaccttggaaacatcgaacaaaaaataacgtcatagtaccacaagaagctaagaggtaccaaggagtatgggctgctaatcgaggactaattttacacagagatgagaaggacggcaagtcaaaatctcgtcatattgatccattgcaggcagcaaagatttcatttgcgtcgcaagacgatgaagattcaagtcagcttatgccaaacatcgtcgttagagaattgtggagaagatcacgattacctgaattcacgctatccaaaatctgggacttggttgctgattctaataagaactatcttcgtaaaaatgagtttattgttggaacgtggctggttgaccaatgtctctatggaaaaaagttacctcgtactattgatgaaagtgtctggaacagcctgaatcacggaggagtaaacgtaaaagttaaatagcttatgatttgtacgcttgcaaaagcttttcaaagtggtttacaatatcatgtgcaaactttccatcatctgagagcattgttaatactagataaaagttgttgtagaaaaatagttccttttggttgctgtctttaaaacttgaactgagtttagtaagtgctgcttcgaattcattactgagccttgatactccgacagttaatggttctgtctgttccgtctcaaacaccttgtgagtagtcaattttaatagtcccgcaatgagttgaccaaactgttgagtaagcacaagtggaataagagtgttctttgtcttgtgtaattgcactgctaacttgggaacggcttttttcaaagactcgcagttttcgtctataataatttgaaaatggggccacaagttaattagttgtaagttgatataatcatccattacagggatcttgcgatgttgcaattcataatcgtacagctgagacaatcggatacaaagcaatactccatagatgtcaaatgtaccacgaataaggttttttgtgtaattaataccaattgtgaaagttggttgaaaaatcaacttgaatagatcgttcacttcatcaaacttgtacagctcaaaaaactgactaaggaacagatactcggttgaaacattgtctaaaagagcaccgttgaagttattgaaacctgtttctatgtagtaagacaactggtttgtttcggcaatttgagcaggcatcaaagtggagtgagaattgataagttcagcccgggtccccaagtttaaatactcattaacatgtaattgagagtctacggtttcccctaatagtacgtctcgcggaacagttcgatattcaagcctctctaaagaatagaggtatttagaaaagttctgatggtagtaccatctcattgtgtaggcgtatgcttttcttaattgcgtggccaactccggtgagttttcttttagaaaagaataaatgagtttacaatctaataattgcttttgaatcacttgagatgaacaattaggttttctcaacagcttgatctggttaattataaaatctcttgatcgttcaacaaccgtgagtttcagtaattctagcactttgactaccattggtgagcatttgatttgcagctcatcttgttcagtatactttgatagcagttgttgcttttctttgatgaagatgatattttttgtccatgatgcgtcaatattatcattcaagacggaaagaataacttttggtgggatcacaaggtcattaactattggagccagttttctgttgattttatttttctgttcgatctgctggtttaattcgttgcttctttcttgtagaaattccatctgtaaagagagctccttgagctgaacttcaaaattgtttaggtatctgatcagcggctccaaagaagctttggtatttaccaatatattgctgtagtcttcctgggcagccatctcatgcttccacgtacgcatagaaaagtctttgcattgctcagaaaactgagttgtcaagaatctaagctcttggagactatagacatcttggacggaaaaatcagaaagcgtgtagtctgactggtatccgttctgttcattcaattcggtttcctcttcctgtctgacgttgagcacttgcttgagcaattccaatttattagtattatcctgatcttgaaactgctgatggcggctgatcgaccgtctactgattctctgcttttgtctcataatcagagttcaagacaagtaagtggatctggatgggtgtacccaagtactgagatatcgagttcagatcgcggattatgattaatcctaattcttattacttacatgccctatacaactgtgccagtaattctggctaacatgcccgccaattgcaagtagctagagacaccttctagtactctcatgtgagtgaatccaatctctctcataacttccagacgatcagcctcaggaatctcggtaacagacttcatcactttgaagctggtacttacaatatcaacagcactgtatcccttctcccacaaccgattcagcagatccacggcggcatcaatgtcagagtccttaacagccttaaacaacatctgtcggactactagaggatgcggggagtccacaattcggaatacattgtccccattgaccagtcccattcctgcgacagtactctgcaagttgttgatagcctgtctcatatctccttctgcggtgaagatcaaagcctccaaaccgtcgtctgtgtatttgacaccctcttctttgcaaatatataacaatctggaaagaacctgttcgtcgtataattttgagtatctaagtatggaacacctggattgcaaaggctcaataattttgttggacatgttacaggcaaaaacaaacctggtggtacccgaatagatttccatggtccttctcaacgcttgctgggccccaggtgtcatagaatcagcttcgtcgaggatcactatcttatgtctcccaggaggtaacgatacctttttatgtgcaaattgcttgatcttgtttctcaccacttctattcctctgtcgtcagaagcgtttagctctagaacagcatcataatacatatcacccaatagctcatgggctaaacagtgaactgatgtcgtcttccctattcctggcaaacctgagatgatcatatgagggacattaccgtctatagcaaacgctttcagcctttcaattgtatcttcgttaccaacaatatctttcaaaagttttggacgatacttttccacccaaggaagctcgagtttaagcggtgctgccatgtttggagtatgctttaatctttctggcgtgtatccctatcctgcctgacaaaaaatgtttcgcgttctcacttagatggagtaattactaaatatggcttactcatcatacccacacaatggccctcgtaaagatctgcggtttgcaaagtttggaggctgcggaaacggcagtaaacaatggagcttcattagtgggtgttattatggtccctggccgggaacgaacggtgaaacaagaggttgcgagggaaatttcgcagatggtgcgggaaaagagaatttcaaagggctcaaaatacttggattccagacaactgaggaaagagtgggacgactgtcctctggaagactggtttgagtacaacgtgaaagaaataaacagcagtggtccatttttagttggagtttttcgtaatcaaagtatagatgaaatccagcaagctatccacactcatggtttggatttcgtccaactacatgggtctgaggattttgattcgtatatacgcaatatcccagttcctgtgattaccagatacacagataatgccgtcgatggtcttaccggagaagacctcgctataaatagggccctggtgctactggacagcgagcaaggaggtgaaggaaaaaccatcgattgggctcgtgcacaaaaatttggagaacgtagaggaaaatatttactagccggaggtttgacacctgataatgttgctcatgctcgatctcatactggctgtattggtgttgacgtctctggtggggtagaaacaaatgcctcaaaagatatggacaagatcacacaatttatcagaaacgctacataaaagtcaattaaatacacgcttgaaaggacattacatagctttcgatttaagcagaaccagaaatgtagaaccacttgtcaatagattggtcaatcttagcaggagcggctgggctagcagttggaacagcagaggttgctgaaggtgagaaggatggagtggattgcaaagtggtgttggttaagtcaatctcaccagggctggttttgccaaaaatcaacttctcccaggcttcacggcattcttgaatgacctcttctgcatacttcttgttcttgcattcaccagagaaagcaaactggttctcaggttttccatcagggatcttgtaaattctgaaccattcgttggtagctctcaacaagcccggcatgtgcttttcaacatcctcgatgtcattgagcttaggagccaatgggtcgttgatgtcgatgacgatgaccttccagtcagtctctccctcatccaacaaagccataacaccgaggaccttgacttgcttgacctgtccagtgtaacctacggcttcaccaatttcgcaaacgtccaatggatcattgtcacccttggccttggtctctggatgagtgacgttagggtcttcccatgtctgagggaaggcaccgtagttgtgaatgtatccgtggtgagggaaacagttacgaacgaaacgaagttttcccttctttgtgtcctgaagaattgggttcagtttctcctccttggaaatctccaacttggcgttggtccaacgggggacttcaacaaccatgttgagaaccttcttggattcgtcagcataaagtgggatgtcgtggaaaggagatacgacttggccgtctttctcgataaagactctgttttctagagtgtttgcagctccgatctggcgagtggaataagacattttggaatgaacttgaagtgataagttttcttgactgaaaaatcaaagtatcattgacgtttcaaggtacacacggcgggaaggagagtcaattgctgcttatcacgtgatctgcgaaatccacactaagggctttccagatcaagtcgagatagagtcaaaaggacatacaatacaatcaagaatttaaaaccaatttaattaaacaataaaatcaaagcccatcgaccacaattattctttcacggcttcttcgtaatcaggaggcaatccggtgtacaataatgttccatcatcctggatctcagcattctggtcagaaactgtgactccatgttctcttgcggtcgagactgcagtacgagaaagtccgaaggagtctcgtgggatccagatctgcggcggagcgtcacgtaccaatggtgatgtgtatccaaactcgacggtttgtggatcgtaacggactcgcttgttccatctgacagggatgatcttgcggagggcctcgaaagatgagtagacgcgtggcttgaagaatcgctgcagcgttttggcatttactttaccagattgatcttcgtcatctctattcaaaaatccaacatgagattgggtatctggctggatgctttcattcttctccggagataaaatggaggacagtgatccagatccggtacctgtgcgtgccggactctcaatatcttgcttgatgtccttgttagacttggaaatcttttcggtttcaacaggaccagtaactggggtctcggtgaaaaactccttgccggtctgggaaatttctgataacccttgatctttcataggatagtggaaaccactgtctccttgggcgatatgaatcgctgacaggggaacagcatcaaacaacggctcaaacttccatctcatgtataagtgagcggccacagtgactgccaccatcacagcttctagcacaacacatgcccagttctcgggcatcacaaatagggcaatcaaaacgaactcacccagatatatgccaacaaacgtctggaaaagagccttaggatagtaccttccacgggcatctgcgctgtgttccatgacgaacgttaggttgtacatgtaagcaatgtaaattagcgtcaatccaatcacaataaaaattataatgagtggagagacaattgcataacaaagcacaataaccaataaaagctggaagattgggtaaattgttccccatcccggttgtcccaaggtattgtatcgattccacttcttacgtggagttccgtcaagtgccttacctaatacatggtacaaaataaggccaacaacctgagccaagacaccacttgatatggtcagtccttgtaaaagggcataggcgatgtaaaaatttgaagacttgggaagattctctcctaaaagagtcatggcactagatgggtcatcgattatagactctacaacagaggaagcagaggatgcaagggtcgtcaccaaaaacacttgaataacttggaaggcaaaataccaagactgacaccacatctccaccccttgaacagtcaaaataccagaaattttacccatcttcttgatgaaagggggtaataatgacattaagacggccaaggccacagttggaagcaaaccagtgataatacccattaatacgtctggcatgttgttgatgaagtcaagccaaggcaactttgtagtaagataattgatgtttgatatagcaccaactacagcaacaggaatggcccaaaagatgagggtcaatgacagcacagtctttgcaagtatagccttagagttacgagcaacaaaaccgacttgcaagttctcccagattatatcatctggagctacacctgtaactctgcgggacaacttcaattccttgttatacggaacagcttggtaagcacgctgcaattccagctgagtaggaaattcaataaagactgaaccgaccatctttgcatcttgccagtcgttttgagcagttgcaagctcatcatttaactcagatagtctctttggggcataatccaaggttgacactttcttaccgatcaaaaatttcagactgtgggttggaagttttccctctttgtagtaggtttcgaactgatctgctggttctggtaaagcagctcccttctttgtgagcttctttctgtccttaaccgcttttttgatcgatttcaccagggtgctttcgtaggttccagcaagtttggtacgttccttgacaacatcctcgagctccttatggtctctagcgtaccaaacatggttggcggcaggaaatactgttcttagctctccctcggacaacagactctcagggacgttatccaggagcagagttctcgatgacagcaacgaatcatatctcggacttacctgcaaggcatgtctaaatgaaacatagtacaccaattctttgtaaatggtgtatatacagaacccgaacaacacccacgagaggaatacgtgagcaaacactctccatttataggtattattcgaataggaaagaatatctagtccttcctggccacctcctccagtggcattaattgggaataaaattggccaaatcaagaggccggtaagggtaaaaacgatgataaacacacggaggtatctcaagaagaagaacccatcagggccacatttctcaacatagaagctggttggctgtttccacaagaacgaaacccagccaaatactcctgagggttgctcctcgacctgtagttcccccggcactgtatccacaacatgacgaggttgataaattcttgactgtttaggcttgagcacaataaacagtgaaacaaaaatagaaaagatgaccacgttcaccaccagcgttgaaacaaacgccgataccgaagatccttgagtggtggtttcggacattcttatgggtcaaaaaagctagtactatagggaactgtaaggggggggtagaaagcgaagaactcagagcttgatcgttttcttatacacgcagagatggattgaccgatgggaaataagcgcgaagatccagatggggaaggttttcaggtaccaatctgtatgacattgctattcagtagcagcaatgtaccaatttcgcgcattttgtttctactagtgactgaggctatatccatttagtggaggttaaatgtgagcgaagaaaagtttttgctaggtgccgttcgtgcaactgttccattagggcaaatagttacattccgcaataagcaaggatgacgaggagcaagcgtaaaagaatttcgtgaaggccaaagctgaataaaattgctatggcggtaaaatgatctagaatcatattctgcatatgcaaataataaagttacatcataagggggtttactgaaactgttatcaacaaccatcccatatcggctggtgcgagacaaggtttcatatgcgtctacatcttccatctccctatttattctgtgggagacatccaacatcgagcagagtgttttcatgcttcgggttctcagcattcacggatggctggcatcaacaatgctttacataagcatatcttatcatcagtcgcgcccgcccatcaaacataccaccctcgtggacgaccaataaaactaatcttcaactcactaccacaaagctcttcgataattaagcacagactgtgcatgctacgttcactacaatgaagttcattgatgaaattgatatagagctggttaaccaggctctctgttttgaaactcctgactattcggttcgtggcggttgcgatttgttcacgacgaagcctgtggggtcggacaagaaactatataaaacgattgataagcatctagatgacatattgcaggaaagcttgaattggaacatgtctcactctccgcccacagcttccaggataaccgacaatgttgattttcagacgcggtttagccggagggcctcctcatctagtattgtgaaaccaactttgaaaagaaagtctttcaaccaccaccaagcaactacattgagtaagtctttggagaatattgacataaacgaaagcgcgctgtatgacgaggagaccccatttggtcccataacttccacacatagcagaaaaatcttttcgtacctaataggaatactgaacgcgtcgtatcccgaccatgactttagttcattgacgccggactacttcacagcagttgactctgcaaattccatgatgaaccgtttcaactcaattgtattgtctttgggctataaggatcagatagacgatggtgataaggatattaactggatttgggagactatcaattcccatatggacattcaagactgctccatttacgcgttggaacccaaggatggagttttggctgacttagagcctaatacgctatggtgtttaatgtggttcatctttaataagaaacggaaacgggtcgcgttcctgcatctcaaggccactattaagaacaaatactcccctcccatgcgaagaaattccaaagtaagcactctagacgaagttagtgggaacttcaatctaaacgatgaagaatatgatctcacttacgacgatgacgatcctaatcaagaagatcctgatgtatttattgaagaggatgatgatgaggatgacaacaacactattgttgcggaagacctgcaggttagttaaccaccccccttataccacctttccagatctcaaatctttggaccttatcacttgaatacccgttgaatggactgaaacaaagtctgcaccatctctctgttgcccaattcccttcattcatcattcggttttcttttagctgatcgatgtttttaaagtctgataatcctaaatcaaaagccatgctatcgattaaattttcatcaattatcggtctgctgtttttgaacaacacaatgcgcacatcaattaatgtattccataaatacccaagagcaggaattttggtctcttttaatttagtaacttcattcccaaatagatactcatgcttgtctagtttgatctgttctgtgaatgataattcatcttgaagagtgaaatttctctcgtcagtgtccgtatcctctttggtgccgtcatcttcctcatctgcaaagtcctcttcagtcatacttgagaaatctctttttctgctacttgacgtgaacgaagcgtctgcgtctccatcatcatcctgatagttttgtctatacaggatagtttcgttggaccagccgctcatccagcccagttgataatctagggcaagtcgatcattactaatgagtttagtaataggcttgtcactgacttggttgctaaaaacaatgcaaacctcatactgttttgccagccgtttcaaatgtctgctcaagtcgtaaagataagtattccgagccattgactcttggtatgatcggttttcgaattccactcttacatgatgcgaaatgctatctatgcagatcagtttcacctttcctgattctttctctagtaaagctggaagctgtacaaaaataatgtggtcttgcgtttctaaatctgaacactgaatttgcaagacatttgaggttgacggatacagatccgaatcagcaattccattggttgtcatgatatttccataatagtcacacatttcacttaaccgtctagtttccatatacccctctgtggaaacataaacagctttgcactcgttagttcgttcagactctggcgcctctaggtcggcccctaagcctccaagttgaatcggtaactgcactgtaagacaaaattgcatcaggaaatgagatttgccgcatgaactgcctcctgtcacttctatcagataacccaagggcaaaacgacgttatcgtcatactctccccgtagatagtaatccaataattcatctcccgtggtaaaagataaatcattcagcttcagtgtttgctcttggagcattgatgtgttcaagttcaccaagttggactcaatttgcgagttcaattccttcatcaagagacttctaaatactatcagttcattcagcgatatagtcagttttccccctgtcaaattggagacacgtttgtgtatgtcttgtggggaggaaatgactatatcagaagtaagtatccacgccttagtcagcaccgtcagcaaaggctcaaatcgttcgttcaacaaaagttctgagctcggacattgctcatacagatccataactatcagctgatctgaaaagacactggaaggtgaaaccaaagcgtgttataccaagaggttcctggtggaaggatatcgagtagacatccgaaggtgaattaaatcgagcacagataatggaacttccgaaatcttccttagcaataattatcctctatattaaatatcgtaattttagtcaacctccttaaataaacaaactatacaaaatgaacggcgagttcagagtcctccaatcaccatggtcttgatgttgatgtaatcgttgacaccgtacttggaaccctctctaccaaaaccggagtgcttaataccaccaaatggtacagcggcctcagagatggcaccagtattgataccaaccataccacattcgatttgctcacccaatctaaagattcgtgagtagttgttggtgaaaaagtagccagcaagaccaaattctgtgtcgtttgcccattctagtacttgctcctcggagctgaactttatgagaggaaccaatggtccaaatgtttcctcgtgtgcaactgccatctcttgggtcacatcgccaatgacggtcaaatcatggaaatttggccccaaatcggttcttactttaccacctaacaaaagagtggctcctttgtccaaacagtccttaacatgttgttgaactttatcaacagctctactgtggacgagaggtccgtgtgtagtgccttctgtaagaccattgcccagtttgcatttctttacctttgcaaccaatttttctgtaaattcatcgtaaattgactcatggatgtacaatctgttggcacacacacaggtttgccctgattgtctcaatttagatatcaaagccccttctacagccttgtcaatgtctgcatcttcaaaaacgatgaatggagcgttaccaccgagctcaaacgaaagcttcttcaaagtcttagcggattgagtcatcaagacacttccaactccagtagaaccagtgaaggacacttttttaatggtgtcatcctcacagaaaagttctcctatagacttcgtagtcgcatggtccacaggcaagatgttgaaaacacccttaggcaatccagcttcgtgtgccaaatatgccatggcaagggctgacaatggagtctcagatgcaggcttgaccacagcggtacaaccggttgcaatggcagctccaaccttcctggaaatcatagcaagagggaaattccacggagtcaagattcccacaacaccaacaggttgcttcacagtgatgattctgtttgaggggatgttggaggggattacatctcccgttaaacgttgtgcctcttcaccaaaccattgatagaaggaagcggcatatttgacctcaccggcggaatcagcgaccggttttccgttctctagagagcaaatgatagccaagtcatcgacattgtccattagcaaatggtacatcttgtttaggatatctgctctgtaacgggcagtggtggttttaaaactttgaaagcatccgaagaactctttatggctttgtgggcatcatcaacagtcaaattggacaccttgagtaataagtcatcggttgcagggttggtgacatcaaatgtagaagtgctatcgcctacccatttgccgtcaatgaaaccctgggttctcaggaggttgacattcttgatgccgtatgtgcttgctaaggaactaatggacattttggcagctttactgagagaattcatctaccagggcttttcttaacttatatatcctggggaattttgatactagatagggcaaactgaaatagcaaaagaaagccgcgcggcatatatggcggattgccatattgagagagcaaactctgaggctggtaggaaagaagagaatacaaaagagggctagaacagccaaaagaatctaactgttagcattaccagactgcgtttggatgtcaattggtataatgagtattatcaagtgattccgagctaattgacggtcccagatggaagacaagccagggtaccactagatgaatcaatcgttctctattgaccacgttgaagacagaagagcaatgagcaatagaagccaaggacactatagagcatatatcccaacttgcattacagactggattgtttttccaagcacagcacttaaccgttggaaacccccataatgtcttcctgctatctccaccgatgtcatagtggaaacaataggagaagcgcgacttttaagctgaaacctccagtcttgcaaaacacaaatcctgaagcgttgtatcccgtcgtgtatgcaccactaaactctgaaccgtgctgtcggcgaaatgcgccggctctccagacagttaacatgccatggaggaaatgttctgaaacaaagtaaccccactatctataccttgtttcgaaccttgttttgaagtgacaggagataatgttactttgtacgcttatcagcaattctagtagaagagttgtagagatcttttgtgatctaattcgggtatttccatatctgataagacgttccagtattttttttttactttttttttaggtcaaatcctccaatctcttatctatgattaatgtcccatgcaagaaataaaaattcttcatgcgctccaccatcttaacccttccttttacctcagaagactttgtgtacctttcttccttactttaccatgtcaagagctatatcctctaccaaggtggtcatcgatgaacaggtcatccctgccacgataatcttctctcttcacaatggtaaaataattgagataatcaacaaggtcctatctccgacggacccgctactccaggcgtacaatgttttaccctcagactatcgaaatctgacacccttggtgatcttgcccggactggtcgatgcccacgtacatctgaacgagccaggaaggacggagtgggaaggctttgcaacagggacgcagtcggctgcttcgggaggtgtgactaccgtggtagatatgcctttgaatgcgatcccacccaccacaaccgtgttgaacctgaatctgaagatcgcagcggcacagggccagtgttggtgcgacgtaggtttctggggtggtctcgtacccgacaatatagaggatttggtgcctctggttcatgccggtgttcgtggcttcaaaggattcctgcttgattcgggtgtggaagagtttccggccatcacgatcggatacattgaaaaagccatggagaaggtctcgggtctgcacacgatattgatgttccacgatgagatgcagccatgtgcctcaatttcttctccaaaaggagccgataggattcaaaacgttgacagcgtaactggtgattccgattccagctccgtttcgttggaatctggattcagctccggaaccaagctgaccacccctgcttctacaaatgtatccaataccccaaaatcttgctcagatctacttcacgatgacattgaaaagttagacctaggaatgtcacagtcctttattaaacgggctcccgctccagtcaaagatcttcttagaaaggccgtgcagccaagcgccaaggaagaagatcattctcattgcaagctcccccatgtccacgctcgttcaatcaatcattcggtattgacagattcacaggccaaagctctggctaaatcgccttacctggcttcgtcagagccaatctatggccgtgccgcaaggttggccaagtctccagaactcaaaccattcaccaacgaatactatcaggaacgtgaacgagaactagagttagagaggaaagcccgtcacggtcaattcgtcatatacgatgaagattcagacgagtacaatgcgaaatccccattagcaattgcagcagttgaagactctgtgctggagactgtcgattccagagcatacgcttcgtttttggcatccagaccagactcttttgaaactaccgcaattggagagatcatcgcttgcgctcaaaagaaccccacagttcctttacatattgtccatctggcaacccatgaggccgttccactgttacgtgctgccattgaagatggattgaaaataaccgctgaaacctgcttccattacttaatgtttgccgccgagaacattcccgatggtcacactgagttcaagtgctgtccacctattagaacagaatccaacagacagcttctttggcaggctttacgcaagaacgtcattaccaccgtagtttcggatcattctccttgcacgccggacttgaaagacctaggtaatggtgacttctttgctgcctggggaggaattgcatcggtcggtttaggattacctatcttgtggacagaaggtcgcaaactggatgagcctatttccttcacagaaattgcgaaatggacttcgctgaacactgccaagcaggctggattacatcatcgcaagggtcgcatagctgttggttatgatgctgattttgctgttttcgatcctgatattgagtatactgtggagactgcgaaaactttcttcaaaaacaaactcacagcctacaatggtgtcaattttagcggcagagttgtggagacaattcttaggggtaactcggtctacgctcttggtaagggggtatctaccatcccaatgggagatttgcttttggaaccaagattccattgatttcttttttcctctatatatgaatcctgtaacatattacattcctactatacagctatatactttttaaacgttgtaccgtgcctgaagcaaatctctctcttgctggtctaaagcagacactatcacgttccattcagaaccgaagtaagcgctgaatccattcaacaaagtgaaaaacattctatagagttcttcactaggagattcgtagtataacacacagcggagaaaattagtgagtcctgctaatccggcctgtctattcgatatgaccaagttcctgggatcaactgataatatcctgcacattccaataaaagatgtttctttttcttcgttctcctccaagtatagcataagtttacaccattgattgatgaaatcattagcatagggagcaagagcttcgttggaagagattcccatgcggccgatggtaattgcagcattttcaaggacagtactctgcatatctgaagcttctaagagtggaatcaacagcgagacaaaactaggaagatatggcgttatttcctccttggaaagtcgcatagaaatttcacccaaagcccaagtggcattattacaaacagcgttactgttgtagttacggtgtttgatttcattgtcaatgcagatcatgacttgatgcaagtatggtttgactatgtcattcagcaaaaaaatagacaagtctccaagcagtgcaaatgcggattgacggacgtcgtcaaaagaatcctcaaaacagatcagcagcaaatgcatcaagttcctttcgttgctattgaactgcttaatgagctcagcactatgagtagtcaatccctgaaccaaaccgtcaatcaaatcgatggatgtgactataaaatctttctctggcggagttatcagctcactagtctgacatctttggtcttgttcaacacaggtttgcaatatgttgatagctctctcgtacacaggaacagcatactgagcaaatgattctcctaaagacgcagcaactgtggacatacactctaacaatggccataggtcttggtcatcatcgctgaattgttgccatttttcaataagaggaggaagaagtaaactgatatagccttcgtttgcctgaatcatttcacctgccttctccacaaaagtttgcacagcatcatagaggatgatcaaatttttcctctggtaagtcttgaaacattgctggaagtggtacaaaagaggctcaactagtggcgtaatcattgattggtctgtagcttcaacaaaattggccaaggacgaacaagcactttcctgaacaacctttttattatcaagagcacaagtcattatagcttggaaggtgggcaaaaagtaagctccatatcttcctccagatccagcctcagtacaaacccattgggcatatcttccaagagtccagcaagtaatctgacggacacggggttgcggagccttcaacttctcaacgaaaaatggtattaattcaggtaattgaggttttgcaaggtcaatacaaccgtctgcaatggcacctaaagcaagcaacgaagcctcaacgacaggccattccggagacattatacgctccctgacaatagggaaaacaatatctaacacctcttgggggaagttggtggccagtacatcaagtgtagcagcagcacactttctgaggttccactcagatagatctgatccatcatcgtcatcactgtcgtcctcagaatcattgttgtcttctaactggctggtatctctctcctttttcgaagaagtagcacggttgctgtttttacttttggccatctgtggcttgatatcttcatctctatcagcttcagtggcatcatcttttgcatcttgattctcaatcaaaaagatatctaattctgagtatgccatcttgctaagcagagtggggataatctgtggtaactttttaaccaacaaggattcatccaacaacgaagtggagaggccgagaagaaattcacaagcttccagggctacttcttcatcctgatcatttacagagtgtagacagtagtttattacgccgtccaagtgaggctgaagttttatctgatctgcgtctaagatgtccacgaaagcagtacagatacttcttctaacactgccatcctggtcagtagctaaaacaaacaatttctgcatgtattcatccaagcgactcatgatagcagaacttttaatcaataaaaagagattaatacaagtgacacttttggccctaacgcgtggaattggagagttcatgagctgtaatagcctaggaactataaactcggaaggtgtctcaccattgtagcttttgtctagatccaccgaggaatcctcgcagatcttggctaaagcgttaatggctccctcttgagctttttcttgtccctcactagaggcaagatctagcagctggacaaggacttgtggccagcctttgactccgaacagggaaaatagagatgtgacaacattaccagtaatgtttctcactaaagagtcactatccactagacccttgagtatctcattcaaaatgtggtgtttaacactatctggcttttcggcaaattctttgagcatgatactattctttagggttagcccagccgatgccctaatctgagagtctgtgccattattgcttaggagtatgtgcagtagataattctcaaagtcgggttgttgacgcgcttgcgtcagggcctcggtagcctctgcaatgatactttgagaaccagaaacagtcccattcaatatcaactgaagctgttcgacagcctgtggatcgggggtccaatatgacattttggcagttcaatatgttgttgaaaaagaaagttcgacagccacaacaagaaaactgtctatcaatactatagttgtgtcactttagactttcacccaaaactgataccgaaacaaagttagcccttaacgactgacagtttattgattatacctatcaaaaaaaaaatctgaagtaagaaaaaaaattataaaaaaatattagtcgcgaaagatgaggtagatggaattcgcggagagtccagttacttaactaggcgccgcgcatgccgttcaaagaagcaccttccatataaatagatcgacccaggagctgtcggtttgaaggctgacgttgaccactagggagtaactgtgtatttactcggttagacatccacgttcaatgcgggatgtttagcgcagaatctagagaggcttcatcgtgactgtcaccccccacctttctatcatattcgactttggtgtaaaatccatgttaatactagatcgctttcttgaagtatcaactcttattgttttctgatgcccaatagattgacctcatgctgaatgatacggtaatcgtcaccatcgattcactaccaacgaccaccagaaaagaagatgcctggaattattactcaagcttgatgccatacttcaatcgaaaaaatattgcagcacctgagtttcgcgtatggtctcccactacactactcggtcaggctcttagcagcttaactacggttgatcggacgggaaacggtgctttctgctagatatggccgcaacggtactttattttttcctttatatatgtaggaatactgccttaaatagaaagctttgaacggtacctatttcatatagtccaaacctggttgactacagccaggcttcaaacagtgtagactgttttctagcagtgttgtaaacgtctttagagtaatttttaatgatacagttcaagtctgatgtctcaactgttgaagccacagcgataacttgagttaatatcacgacaactttgaagttttctagtgatgcctacttatcagtaatgcctttccattgtgccccgaagataacaaatcaacctcgtctagaacatctggccaatcaagagcaatcaaattgttctaccccacaatgttgaggtgccaaattcataatttaggttgtctcccagcctcatttgctgataaagaacacttcgcatgcataggcacgctgtcatctacagaaagatagccaactggtacctggttatctaaactgggcttatagagtaatcacgagaatgctgcaatttaggggcaacgatgaaattggttttggggtcttttccgggaaaatccgattttggaacataatttttctaagataagagatacgaaccgtggaccgctttgtcttttcacggatcaaataaattcacggatataattgacacattcacagcctccttagatatcatagttccttcataggctcctgataaatcggaagttttcggagcgataaacactcttatctgtaattcagtatcaacgaatagggtctcaactcgtttctggaacagaagatcggagtgaattcccagtagataagaaacagacccattgaatacttcggatatctttaaacatccagcacctatcacttgatattcgcatttttgataggcgcagaagtttaaatcatctaagggagcgtatccatgcatgcttcgtgcagtgtaaatatgagaaccgtttagtacgacaaatatgctcaagggccagattacacaattatgaatttgttctgtttaccggcagattagtaacctatcctaacttgggtaaacgggtgagcaattgagtcaaaagagtgttacacacaaattggcaccgctttccgactttctttggctgtagatgaatgttgtgatagatgctgattccagaggattaagggctgtattgcaaacttgtaacctgcacggccagttcatataattataggtctacgaattcttaattgcacgtttttagggtggttatataaaacttaactaccaagtccggggtaacactggtcattcactcaaaacaccgacctacaatccacacacctaaagcaaaagatatagctcctatatgagctgactgcatcctgtccatcagactacccttattcacaaaatatgtagttacccacgccgaaaatagaaccaaaatcttcataaatttgttcatcagaatcacaaacagatggtttaaataatctgaaagattaagataggaatacgtgttagcagttagtgacaactgcgataacagtccaaaagagtctttgacttcaaccgtagactgctcaagcttttccatttcttcaagactggtttccatcaagtttgtgaaatttgtcaaaaaaccctcaaactgggcaatatcttcattataaatactctcttgatttagtaagagtaacgatctttcgatgtgggaattgagagtaattgagagggtaactaggtttgcattgatctcccgtagatacagtaaaagatcattgatttgttggtagacatcaatcttgaatcgattcaggtattttgttgccttggtcactccgtctgtatcaggaatattctccatctgatacaacctctccaaagtttcctgcgtagagtttcccactcgatctttgaaatagtctatatcagtgatgacattattgaatcgatagaggtatcgaagaacgttgcggtttttcatttgtatacttgttatcattttttgaaaggacttgaacattactgcttgatagctttccaacagagaattgtttatgtccgtcatcttgttgaaatttgtagaaacatcgatcaaagtgatcttgagtccattcaaagcaccgtcaaacaatgccctccagttttccaaatctttctgtaacggtaaatcttcaaaagcatccaatgactttgattccttctgttggtttaccataaaggagccaaaactgtacaagagagaaagatgagggtatgcttccagggcatctctgcaacgggccatattttgcaacttcaaatcttgacattctgcaactggatattcaagtttagacactttaagaaaaccaatggtactatttaataactctgcatcgagtgaattctgtttcacaacgaccttgcaagatccaaattcgactaaagcaataaagaacagccccaagatgccacgcacaaacttcatcggtgactggaattacttcgaccttgtagtgagaattttttgcgtctctacgctatgtgagctgtcagattatccctgatgtatcatgtcttttgaagagtgacaaaactttctttttctggtgaatttgtttcatagtgattaaaatggatggggactattctgaaaaactttgtttctcaaagaggatcctgagcttaagcatttgtgcataacttcgaacacgttattgacgttcatttaagtaagcgtttgaacgaacggctggatcctaataatcccattctcggatttaagtgttgggattgcgcgaacttaaagccgtccagtcatgaggtaccccacaataggcatctaactacttcgttgaatccaggcaacgaaaggtaagagacggccaatagtatcattgtgaccagcgccagttcaacagattttgactgtctctgtggagaaaagttttcacccactggctcctgaaagttattgttagaaatgcagatgagtcatgatctcataggctgttgttcacttcaacgcactaaactagcaatgcttcaaaattgtatcgtatgatattcttggattcccaaaaagtctgagcctattgttaatgacgaaaagttcacgaattgtgctttgtgaatcaaatgttgcctgtgggagccctaatgtcaatattcgaccgtttgaggaaaagcctagccaaaaatcttccagccccatgaattgaatccaaggacaggttcctgctttagtgagtgagttgttgctacataaaaccgattctctgaactttagcaagagtttagaagttaggagagtttgagatgtttaggtaaacagatgcgctcaattttcgagcaatggaggcgtatgtcttaccttgatatgcccccgctatactttctcttcagctttactttacgtagctattaggtgcaatgccaaagtatagaaggttccctgtggcctgtcataactgtcgcaagagcaagatcaaatgcgaccgaaactatccctgttcgaaatgcacattgaagggtcttagttgcgggtaccctgacaagttcaggtccctgagccttgacagattgataaggtccccagaaacatctcccatgtcccgatcctcagccccatcaacgaacgatcttgagaaaactgaatcaaattcatctttagaagatctatccgtgccagacttatcaaggttctcaagtgttagttccggttcacttcccatgtccgcgtcgtctgattcacggattggcatatcagagatcaagaaaagtatcttgttctctcaccaatgtgaatctatgtttcttgaaaatagttttgaactctcaggtagcttggtttccgtggtccagtatccccgaggagtggaaaacccagtcatgttaccacagttcgtgcgagataaggagaagaacattcagttagtaaaaactcttattgacgaatatttcctttttgctgatgtcccaagtcttagctttcctgtaactttttcagagctttgcagagtaatagatgatgcggaagaaaataacacatggacacgtttcaagggttatctttttttgattatagccattttgttccgaattctcaacatactgcctttggaacatccacttttcaccaattatgtttatctgaaagatagagaagttcagatagatcttttcaagagattttttttcatacagaatcttctctcgttagatagttccatcaatgttgaagcaatgtttattatggttgaagaagctttatacggggaagaatatgatttgtgtaagtcaactgtacttgaattacaaaactgcattttttttcaagagttatgcagctatgtttccaattatgactgttctacaacggcaaatatgaaacccaaagcaaaatttgatatgttgatcaaggacaagaaactaatgagatggagtgacctactttctaagttttgtaggtttggagcgttgttttctatcaaactgtttcatgaaccttttgaagaaaggtacccacttttgagggataataacctgaaaacagaattaaagctaaacttagccgagtcatctatcaaagggatggcattccctcttaagtggactcgtagctcagaccgtgaagatcttcttgttgatgcgattgagatcgagtatcaactcatctatgatatcaattaccacaagctaaaggttagaaatctcttggcaggtgcagggctatctgagtcttcacttgctaccatttttgatgacgattttcctataatggacgaagagtatggacagattgatgtcgatgattatgttcctttagagctgacaatctcatcatccaagatacatcatttgaagaaaatatttgacaatctctttgtcattctgaactgtcagatgacaaggttaggcttaacccttcaatcggttgccttgtgtcctgtacccctgaaactgtgcctttcctcattaaagtcgggggtgaatggtatattggacctaatgaccgtattccttgatgtgaaacgtttcctttgtgggagtttggcacagtttgaatacgatcagtttcgcagagttattcctgtcataaatctctacatttttaagtttgtgcaaggttttttccacgtcctacatttggatccccagttccttatactgcagaagcaccatataagtatcctccggcaaatgtttcaacagcttagaacaaaaataatgaccacagcgaatgctaatcctcttagtatgattattagatacttggacgcaattgaacaactttgtgagcgaattaacgatgatgaacaacggctaggaacgagtaccggtagcatttctccgaaaatcaagagctggtataatgcaaagtttccaggggaaaacgtcattggcagagatccttccgaagcacaagatattcctgtttgtttaaaggtaaagtgttcgttcattgactctttattgaaaggcttggattcatgcaagatgaagagacgtaacatgctcaaagatagcactgaacatttaacggtgaatgtcagtactgaactccttccactaccggaaacagaatacaacggtactttggataatttctatgaattgttttttaatgaccattgatagaagaattgtcaccaacttttttgtgtctgtctaagggctggctaataggctgggatactctgtaaataattggactgtaattagaataataggctaccatgtaaatatttagtcttgaatcaaagaacacagctactatataatgactaaacaagtagtaaattacaaactaaagatctgctctctgggttatagagggtaaataaagtatttattctcataatccgtcagatcaagcatagcaacatcaactttctccttaatttccctcccatcgtcgtcgtggttgataacataaccgaaggcaccttcagttccattctccgcaatccaagctctacgcttggcattacgcctagctagaattattctgatggtcagtaggataacaagattgagaaagaaggcaataacaatctgcacaatccatgaaggatagtatcttggagaatctttcggattccatagttgaggtgatatgatattggcaacaccataggccaacataaacatgacatttcgatacagcttcttggtgtacccactacaggaagacgttgtccaacctagcgccacgatataggtgacacctttaaagtttagtaagatcatgcatgctagcagggcaatcttgttatcccagggaatagtgaccatcccaatagcaacaataatacatggaaccaaataagatgccgaaaagtatccactttgacctgggaatcttctaatcaatagagctgatacaccaaaaagaaccacagaaaaacctccccctgctgctgacacgagggaggatccaaacgtggtaactccaatatccacaaatagttggttctgctggtaagtcatactattagcaagcatgagggtgaacgcttgaaaaaaaaacaaccatgacacggggtctttgaggcactcaattgcctggtgcttcttaaaaaccttttgctcaatagaagacttggtagactcttgcactttcttaatcaaatgcactttttcattagttgaaagatgagttgcctttgctggattgtcagggtaaaagaaccaaacaaatatagcaagtaaaagactgattccagcgttaacggccatgaaaattctccatggttgaatagacacatgaacatgtaacaaaccgaaggcaatgaaacttgaaattacaggcgccatcgcagcagccgtccagaataccggttgggcaatttcacgttctctagaggtaaggaacatacccaaagtcatctccatagcgggcacagctacagcctctaccgctccaaggaagaatcgaataaccatcagactggcataggaattgcatgcagcatgtagtccaaccaaaattgcccagctgagtacagttccagccatgtactttccaacgggcaacttttgtagaaggtaatgaccaggccattgtgcgagcaggtaacctccataaaacactgagttgaggttattgaatctccccttatcgacgtcggtgtcgatgtatatacccaaaatcgttgtatatccaatagttgccttatccataaacaagaccaacgtgactattatggcaactgccaggatgtacgtgaagttcttgtgacgcaacttcttctcctcctcctccgtcaacggaactgcgtcagcagcattctcttccatgaaacgtagaacctcatcggcatacttatcctgaacagcattagatttcttatctaggcgggacaccaccactacttcaccgcccttcccaacttcagttatttctggagaagaatatctctctggttcacttgatgatagtgaagtcatatttggtttctaacacgattattcagattatggtggccttgcaagtgatcttatattgaggatatttcagtgtgtttcattgtggagacatcactatttattgcacaaatcatttgacttaaactgaggcggcatatgtcatttgattaataagtccttgccttgggtctacctagaggtattcaatcaagttgattacgatgcggaccacgattgccctgttaggcaatattattatatcactacacggaggagtattaccgtatgaagaaagtgaataccgctctgaagtggcatttaattactgcatcgggtacgtgcatttagtcctttatctttggtaatttttttcaaagtgttagttcttagatctctagtagcacatacaatttctccgtggcggacgcgatatccacagtgggaaattatcacgtgccaagtagcactattgcggacaaatatttccatttatggtgaagttttcgttgacgcccccactttttcccccatggcccgtatcttgatgcagggctactagccagtgcaatggggaagaggtcacccactggttttagatttgaatagtagcatttgtggtaggaaactgtggagataaccagggcacactgatcgaaatgactcaagtggatcatctggattgctctcagtagcgctgatcaaaaagtattcttacaagtaaaagccagattagtttattcgatacctaaaatctacctccatttacgttaacgacctcgccggtaaaccagtgtgacttctctgtaaccagcagtcctaccatttcagcaatatcttcaggctgtcctaatctttctgcagcagccggaaatggtggggttggcagtccagatttctccagagactgggtgaataattcagtgataactggtcctggattaactgcaaggactgtaataccatacttgcggccaagttccgtagcccaaaccttggtaagagagttaatcgatgctttggtcgaaccgtagattgtgcttcctagttgtccgctccttgcagcacctgaggaaaggttgatgattcgtccggacttggatttctttaatgcaggaaggatggctttagtaaagaagatcaaacccttgacattgatgccaaactgaagatcaaaatcctcttcggttaaatcttccaaaagagagaatttgcttgttcctgcgttattgaccaagatatctactgcgtcctgtccaaacttctgttgtacttgctccagtaccaattctcctgacttcaggtctgcaatatctgcctgaattgcgataccagagttagctcctgccaactcatctatttgtgataccaattcagctgctaagtccttggaagagtccgagacataagtgacagcgactcttgctccattcttggccagctctaaggcgattcctcttccaattcctcgaacaccaccagtgacaatagctacttttcctttgagcgaagacattttagtaccaactacaacttcaattctgagttataatggctacgatgtaggttttgggcccctcttatgtaaaattctattacgcaatggccctagccatcagaatcaatttaactcacagtttccatcactatcgattttgcatgtaccatgcatgtagccggatcaaataatattgcatcattatatgtgcgcctcaacctctacgccaggacggttggttttatggtggctcttacgtttaccctttcggcaactacccaaatatcagcggatgcatttttccaaaaatttgtttctcttcccattacagagcagatgcacatagaaaaagaaagtcctttaaccacctcataagtttgacatgtttgccgaaaagaaaagaatacctggcactaacgtgctgaagatagagccggttgctcaaagaaggcttaactcgtgtctgtcttgtcgttctcggaagcggaaatgtgacaaatcccgacctgagtgtagtcaatgcaaagaccacggccgtcaatgctcctactacaagtcgaattctaattcaggtcagaagcccgtcatagttcaagaggctacaaaaatcggagctgaggttcttacaacgggaccaccgagaaatctgcaggcagcattttggccttttgttccaaaccacagtgactcatcgaacccatgctctagagaaggtccaatatttaccaatatcatgtcggcctccctataccgttcagtgggcaacccgcagactaatattgaggccctaagacatttcatgccaaccaaagaaaaagcagacaaattgctctcccagtttttgaaagctgtgcatcccatagttccagttatggatctggaagcagttgctacgttatatgtggcattttgggagaacagagcggaaccgacattggatacttatattactttgttttcaatcctttatgcaggatctgtttctatgtatgaggaagccaatatggctgaagaccaggtggagagcacagaatatcttgttagtgaaatgcgaaagtatgtaagtgcaactgaggtggcattggcaatgtcccatttccccagaaaggccacaattacttcacttcaaggggcagtaatacttcattctatctgcagaaacgattgcaaagctgatgatagcggtagtattgcgatgttgctccgaataggccatttgctggagctacacagggatcctgaacactatcataaactcgaggatttcaaagaaatacaaaggcgaaggctgctctggtggcacattctctatcttgatggattgacatcactctccagtggattgctacccctcatgtcatctaatgaatacgacacggagtatccttccgaagattcttctacaggaggattagaccagataatggtattttgcaattgcaagttccgctggattgagtgttgcaatgatgtaatgcgaaatttctttggaatacataagcctactacccttggcaccgagaaagtgaacttgaccctttcagaccttaatgaatactgccaacaacaaattcagaaagtaggtaagtctgaagatttgatgaagtccagccagctgtccttttcaaaggtagctatatcaatcatgtccacattcgcagatcgatgtcatatgctactttataagaaaatgtcagagaacacgtttgtatcaattgctgatgatttagaaacagaacgcacaaagaaagtgccagaaacatcatcgcttgggggatctatcagtggcaatgtttccaatgagtttactcaatgtgcgattcattttttgaacgaattttgtttctatggtaagatgccggaaaacaaacaatttctttgggaaattaggaaattccaaccattacaggccatacttgctttactaaggagcctgatatacgatggagaacaggtttgttcaatgcaacaacccgattcacaatttcattcgaagttccttctccctttggacgaacgagttgtggcgatagagcgtgcacttaataacctgggatatttatcagaacatacgactcgtctctgcaaggagaggtgggagactgtcagaattttgaaggagagagccttcagattactattttttgacgtcaatgtcaatgaatctgaatggacactttccagctctccattgaatgataatgatccgatctcagagaacctgaatagtatttcgtttcaagaactgccgtccattgactgggacattattgagcatgaaatgaaagatatccgatcttccttagaagaggcaattgcaataaaaatctgggaccaagattcgggtcattttttgctgtagtcagtgtatttgttgcaacactgtaccatcttttccgataattattttacgatgtattttacattaatattaattatataaccatatacggtacggtaaaaaactaaaaactaaaacactgaatgttccgaatctacgattttacgcttctgcttgagccgacgtctcatgtgactttctgtttctcttgatcctttcccgatgttccctgtgtctttgctgtttgatgtccacaaaatccacacgtctgttcttcttttcttcggtccaaatctcggctttaaagcctgtatcaaagggtacagccttatctaccaaagatgcaagttcttgagcgtattcaacatcagtgggagtcgcaaacgaatgaaatttagattcaccacctcgtttcttgatctcctcaatctcgtcctttctcatttcagcctcgcatggaagctctagccttccagagtaaactctagcaatcacagctccctggctttctgccaatgggaagggaataatgttcttcatgatacccacaaacgaaagggatggatcaggaatgtaaaaaatttgtcgatgtaagcgtcgagttatttgaccgtcggtgatcagagcatcttcgccttccatatacgatttcagaaaggggaaatcatataaatatcctgtgcaaaaaataatgtgatctatattggaaatggtggtattatctgctgttgtagccgttctagacgatacgtcatatcgctttatttcagaaatatctataatgtcgtcaatttcaactggtttaatgataccttcactctttttagacctgtaaacaggccatgtgacttcagtaagttgaagggagatgtcggcaccactagctgaatttccaatcactaaaacttttttacctttgaacttctggttgttgatgtagtacttggagtgagagatggaagaagggtcagcttctgcccattcttgaagaccaggaacgtcaggtacatagggaaagttgtaatggccagtagcaattatcacatacttgaatgaatcttccgtcgtcgcttgtgatatcaaatctcgtgagcgtaatttccattccgatccagtcttctgaagattaataacttctttattcactagaacagaaatgggatccttcaaatcaactgcatagttgaggacgtattctaggacatcctggcgtgatggaagaatgtcacaggcttctggaaatggataatccttataacccatgagatccttgataacgttagtctcaagattctcatacattggagacacgtattcatcgtctctatttgcaaaccactctcgtgtaatggacgggttatcagaaggaaccggagaattacctggttttgtgccagaatagttccaaacacctccgacttgaggctgttgttcgaagatgacaattttgtcaaaaacatgttcttcagcaagtgccttggccgtggcgagtccgctcggaccgccgcctataattgccacagatttctcaaaggtcattgagctatagaatcacatttggctgtggggaatcattcctgtttataaaggatctttgcctattactgtctttcacctgataacattgaaaaagtatgcacgtccattttaggaaattcaaatccgcaggcgtccgcgccatatttcagaaaatgtatatctcgtaaggtggtgatatggtgagatgtggcacacctagcaccatttgattagcagggactaagcggatcattttaccaattttacctgaccactgagaacgttcgatggaggcgtagttaggcaggatttgcttgaagcctggaaatgtgagagctgctgttcttcaagtgggtaagagtatgtctgattgaaaattgcgaggagaatctaatcttatgagactgtgggggatcactgggacgagggatagtttttcagttgttcaagttagggacctagattttttgcagagggctgaacccatttggtcagcttaaagctcttacctgactactacggttaagttatctccagtggagtcaattctggttaaaatcaaattaagtccttgacttacttatttacttagtggtgcctagtatctaatttcttcatatcgaaccatactgttactgataaacttgccatcttgagcaatcacataaaactggaaggttgcattgtcgattgtacgcaagatctcggtcatcttgcaaatttaagtctttctgagcttagcttgatgtattcattcacgaaccatcgttatgtagtttatcgattgaactcttctgccttattgttgccagcgttaaaagaacaatagaaaatagtttatcaaatccataatccaccacccattcttttctcaaaggaatttcacagattggtagacttggtattatatcccacgcactcagactttatacgatcactgttcgatatctttgcccttgatgatagtagcaaatccatcagccagctctctcaacacgacatccttaagattagcagcttttaccccagggatatcacgatcacccactccatcttcagcaacaagtacttcatagcccagttcagatgctgcacgcgtagttgtcgaaacgcaaatatgtgccatgtagccaacaataactagcttttttcccacagaacccaaactttgtaagtatgggcctaggtcagtttttgcaaacgagttcggaaagttctttaccacaagtttttctccagaatgcggggttaattcttgaagctcttgggccagagcagtacctggagtgaagactggggctccgtctggagtctgatggacgacatgcactatatttttcccattgtgttctgaagagcgatacttctgcaaaatttcagcaatggccttacgagtctgatcaatgttaacagttgcgagctttccgttgacgtactcgttttgggcatcaacgatgattagagtcgagtcattgaccgaagcagtagaggggggaatctggacgatttcacgaaaggattggacagacattgaggagtaaaggtgaatatattgatagtttaagggttgtagacatggggtggaaggagcgtatttatccagttgctccacccccctcacccccgcaggcacgtacgtgacgtgctatagacattactaacattactcagccaagcgagcaatagaaagaacgtggacaccgatttctttagtatcccttgtgacattggcttcgatcatagggttcaagaaatgagaagcagtcaatgatatcaattggcagacatccactgctgccagctgcacttcatctctatggcactagcaactttgatgacacgtaataccggactttgcatggatcttgagaactcagttttagagtagacaggaaagttacaattgacttttgtttggggatttacactgctttcgattgaagtgaagtgatggagcagaaataggttcgattggcaaatggcaaactgcgccctccagtttattaaaagagggttaggtcgcttcaagtattttttttttttttttttttacagttccttgccccagcacataacgtttcttacctcaaatctaacaatgtagtatgataggttaggaagtgatacttgattatctaatgggtcacaggcaacatacggacaagcagaattgcctttctagccaaaaaactgggaacgataattcaaaattggaaggttgccagatgtgttattgatcgtttaattccgcaagtcacgacacgagtcttcaatagagagtttcgtcttctatttaagttccttgatgatcccaatgggtacaactgtgaggttaagaataatcatttggtcaaatcgagtagagccaccacaaactgttgcggtggaagagtatatcagttttttgacttaatgtttttttattgtttttgacagattgactgttccaaacacattattgtcgtagtataaaatggagttgttgccgactcttcaactgcttttggaacagtatattgtagacccgaatcacgtttacgatatttgagagtgttccttaaaccctttttatgtcaagtccgcgtcccaacttgcttcccacttggatgttggcgatagcgtcatatgacaagttgggtaggttgccaacaaaaattacctggcaatcactgttcagcagtttcactttctagcaagagctcgaggttccatttaaaaagtccacttaagcctttgagatagatacttctttcaaacttcattcaattcagtatgccctgttttgaaagcaagtttgaacatcatatgagctgaagatggttcgatctttgcccacggaaaattcacattccgtagcaatctcgtggtgcattaaattggtagcggaaaatttatcggcgaaactaacggagaaattgttttactccagatgaaagccacacaaacctctattagtaggatccccacagaatatgcagcattcgaggagggtattttgtacgtgatctcaaagcgaaagaaaaattaacaactaagctaaaacagaattcacctctcagaggagcgttgagtttaatattacacgaacaagttactcagtgccttcagataataagcacttatctctagattaacctaatactggatggcattaatttaaagttcatcggaaatgttaatttgaattcctgaaaacttaaatgctcaacatcttaaataccaaaagaataaggtgtttgtctagtatagctttctgcatattgtcttgacagaccagactagaagagaataattcgcatagaaataaagttgggtacttgatttccagttcttccaataggcgacaattcagctatctgataatttgctgaaaagctgaaaacagctttagattccggtcatttgtctccacctgttactagtatttgagtcatagtagaataaacgatcggagtattgcttgcatattattgtgttcaggaactgagatctaaaaggtcgcattattcagattttttttcggctgtgacaatgataaatcttaggtgccaaagttagctaactcatagaactcatggcctactgaaggtttgattctcctatcatcttaagcaaccatataaaccactagccaattcttggattctcctcaaacggagcgaagccttctgactattgtttgagaaatggcagcaagacctcatgcccatggccacaattctaattgttagatttgccccaggaaacagagagtaatagtgcatatcaactgtgactataaattttggttgtaagactgcattcattcacaagtgattgtccagtcgttaagttgaatcaatcttagtattagtccgattttctcaaatctttactgttggcgctaaggaaagtgtctggtaatttttggttcgcacaagaacataggataatatatgggtaggaaacgtcgccaaagcatggattcattctggcaaacaaatagagacagaacacgactccactagataaatgagattattcgggaaccaatctaacgattgtgagctgtgtttatttccacccccatcccagtagaatgtagggtccccaaacatttgctccccctagtctccagggaaatgtaaaatatactgctaatagaaaacagtaagacgctcagttgtcaggataattacgttcgactgtagtaaaacaggaatctgtattgttagaaagaacgagagttttttacggcgccgccatattgggccgtgtgaaaacagcttgaaaccccactactttcaaaggttctgttgctatacacgaaccatgtttaaccaacctcgcttttgacttgactgaagtcatcggttaacaatcaagtaccctagtctgtctgaatgctcctttccatattcagtaggtgtttcttgcacttttgcatgcactgcggaagaattagccaatagcgcgtttcatatgcgcttttaccccctcttttgtcaagcgcaaaatgcctgtaagatttggtgggggtgtgagccgttagctgaagtacaacaggctaattccctgaaaaaactgcagatagacttcaagatctcagggattcccactatttggtattctgatatgtttttcctgatatgcatcaaaactctaatctaaaacctgaatctccgctattttttttttttttgatgaccccgttttcgtgacaaattaatttccaacggggtcttgtccggataagagaattttgtttgattatccgttcggataaatggacgcctgctccatatttttccggttattaccccacctggaagtgcccagaattttccggggattacggataatacggtggtctggattaattaatacgccaagtcttacattttgttgcagtctcgtgcgagtatgtgcaataataaacaagatgagccaatttattggattagttgcagcttgaccccgccatagctaggcatagccaagtgctatgggtgttagatgatgcacttggatgcagtgagttttggagtataaaagatccttaaaattccacccttatgtcctcgttttttctaaacaaccaaacagtaaagatgatgacgcctttgggaagagctagagctctaaattttcagggcaaagtttatgataaatttccaaaaacttacaatatctacgctattgcaataacagccaccgtttctggactgatgttcggttttgatatttcttctgtgtcctcgttcgtaagtcaggatcattacagaaactacttcaaccgtcccgacagtttgacgcaagggggtatcaccgcaagtatggctggaggttctttcttgggttcgttattttcttctgacttccaggatatctttggaagaagagttgctctgcatatgtgcagtgtcctctggattatcggggccattcttcaatgcgctgcacaaaaccaaggtatgctgatcgcagggagattgatttccggtatcggtgtcgggtttggttcagcttcagctccagtctattgttctgaagttgctccagcaaagattagaggaatgattggaggattatttcaattttctgtcactgtgggtatcatgataatgttttatatcggatatggatgtcactacattgacggcgttgcatcatttagactggcctggggtttgcaaatggttccaggtcttattcttttggtcggtgtattcttccttcctgagtctccaagatggctggctaaccacaaccgctgggaagacgcagttgaggttattgctaatgttgttgcaaaaggtgacagagaaaacgccgatgtgcgtctgcaattggatgaagttcaggagcaactattgattgacaaagatgcttctgattttggttaccttgatttgtttaagaaagattgtatcaaacgtaccttcattggagtgtcagctcaagtgtggcaacaactttgtggtattaatgttgcaatgtactacgttgtgtatctcttccaaatggctggttttactggaaatgtggcgttggtatcgtcctcaattcaatatgttttgaatgttgttatgactgttccagctttgtttctaatggaccgtataggcagacgacccctactaattggtggtggtattttcatgtgtatttggctgtttggagtggcaggattattaggcacttactctgaaccaattgaaaatttcagcggtgatgatactgtcagaattactattcctgaccagcacaaggctgcagcaaggggtgttattgcctgttcctatctattcgtgtgctcctttgctccaacctggggtatctgcatttgggtttatgcctctgaaattttcaacaacagacaaagagcaaagggagcagcatttgctgcctccgctaactggattttcaactttgccttggctatgttcgtgccatcagcctttagaaacattacatggaagacttacatcatttttggagtattttcgttctgcttaacaatccatgttttcttacaattcccagaaaccagaggtaagactttggaagaaattgatcaaatgtttaaggacaatattccagcttggagaagtgcttcgtacgttccagatatgccaattttcaacaaagagaaggtagtatctactgagcatgcagaaaatgcttccagctcgtccgaaaaagccttgatggttcaggaagaggaatctgtataattttatgatggtaggatggtttccacgaaaaattgataattgataatgcctgaactgtagctccccttccctgtaatttatcgttgttccctagttactaaagcacaggggcacctgtcatgattttctgatcttagaatttagttagatgaaaaaaacagcaacacacttagaatgaactgttaataagggggtacttcaacccgaatcgcctttgaatagtccttctggaataacattgaataaatccttcaactcattaccgttgaagtaatgttcaatgttaggaacatcatccggagaagaatcatagcgtggtgaaattggccttttcaccaagctcaaaagatgatctacaacagcaagacctcttcgagctccaagatgagtttcacataaagaggtaagcgtatccctagcatttagaactgattgcaaacgttgatcatcttcctccggtaccaaagtaatatccagtaaaaggaaggttgagcacaccaccaaagcttctgaaaaaatccaaaaatatatgaggaaggacattccgcatataaacgaaataaggtttcttgcgagtcgaatgcagtgatctctcctgttttttatccattcttctctggggataaataaaagtgtcattctattgatgtctaataattccatgttgatagcggtgtggagaagaatcttttgcgatgagaagttgggatttagctcttgatttcgtgctgaccgcgagtgtttgttggtgttcacaatcttgtctaaagtttcgtgtagttcttgtagagccttttctgcttccacgagcgtatctaacgaaatagacactgtttgaaccatatcattataatacgagctacgtttgttttgggcaatttgaaacattagtctttggtaagttatagagacaaaagtagaatcttcataaacacaaagtgtttcttcatccatgtttagtggtaagggagttttgaaggaacccgggtttataatcgatacacggccataacaatccagccagtcagtgatcagcaaaatcaaccacaatcttttcttatgctccaattctaaagtttcgtcgttgccattggcatttgcgtccagttggtccaatcccaacgccctagctgtgcaaatagtaatattaaccatcacgttttgcagatgagatccaacgaaatcatggaaacacatattgaaggcacaatatgcttctattgccgcgatattcggttgctccaagaaatttcctctatgaagagcctccaaggcaagaataaagaatactctggcataatcgttggctttcttaggacatattcccaaaacggccagtaatgcttcatttgctagatgcaagcctgaagccagtagcccaaacaacttcgaagcccataaattcttcagcgagtctccggcatatacctcgaagtcttgaatatcgaacggttgagtctgcaattgttccataaaaacgaaaggaataactgcacaatgaataaaagatatgttggaaagattgaactcaacaatttgtaaaacattataataggtaaaaaaatcagactccaagagatcaatgcattgtttctggttacagtaatagctaatattgtcctgctcttgttgcagtaaacttccaaatctggtgtttgctttatcagaatgaatgtttcgggtgataaaacgaatcgaaggtaaattagaatgattgtattccgttggttcatatggtcgtgacgatttttgttttgactccagttctgagatcctggactttagttctttgttttctttcgccaattcatcataaccaagaggtggacagttgttcacattatgtagcacattgcgaacaactactggttctcggtaacagaattgagcgatattcttccgtttacagtttgaacagggaatgttcttatcacatttgattttggcgttggcacatggaatacatcttttgggggccctttgggatttgcggatcctgtgtactcctgcctccatgaagtaagtcgctagatgatctccaaggtttattgtcagtacacttattcgtgaatattagttcctattcgattatgctcgctccctctaccttttgactgaaacgacgatttcacaaagttgaacgacattcaagctttcttatagccaattcttttgaatctctagaatttttgacatttacggtaacgcaaaacgaaagagaggaacatatttgtgccttcatgaagatattaaaatccatcttcatactctcactgctctgttagcatgggaattctgcagtctgaaaacacttccattaatcgctcgcctggtaatctgtctgatatattacatactcaatctaacagggccgattgcacagtatagttgagtgcagaattctctgcaattgaagatatcaaaatagttcgaatatggtggtataatcgaagacactaaaatttcaaactgcttacgacattcagaaaaaaatataaatgatcaaagtttggtacgtttacaacatttcgaaccgacatcctgtcgtacagttagaatgcttcaactatgacagatcatagtagtagagtgatcaaagtgaaagtactaagattgtaatagtcgcatacattcaatttgatatattttggtcatacactaagctacgataattaaccaaaaaccatctaccaatatgagacagaatttctttgccacgcttgaagtgcttccaggaaaaatggcaagatatgtagattgtccaaaaatacgttaccgaaaagggtagatggttgcttgtcttccagaactaagcaatcagttatctcgtggacatgaaaacggaattttgaaccattcttctggtgggatgttgagctttatctcaaacgatgatactaccgcttcagtttcagcatcccgctcttcaaacagcaagtgtgtgtcagggttttgggggctcttgtcaacacgcaagtaggtgttgccagtttgcagcttaaaccattggtcaaatcttgtaccgtcctcttgagtgacatatccattgagtgacatgattagctctgctgtggagctggtttgaatatgtagatttgaatttgctcgtgcatggtggctgtttaagttgttctttgacagtctagtgagtagaacactactccgttaattccttctttttgtggtccgttctatgttgcgcatgcattcctgtacttgcttacatgagctcaatctggttcctacaaaagtactacactatcactccaagaaaagtcttgaaacttgactatacgaatcaagtgagggtatgccgtgttgttttgcttctgatctagatgaatagtaggtatggcatttttattggaaatattggatctgtttgacaatgtttctggaatctcaaaaaacattttgaaaaggaatgcatatttgggctgtgtttttacgcttcttatggtacaattaaattgctagggggaaacatacattttttcttttagaagccaataaatacaagttaaagagctttgatgtgattccactggttagtatgcagattaattgtaattgagcatagatttttgacctctcgtacgtttttaacaaagagaatactacattgagaccgataaaagccattctaggtccaagaatggtatataaacagtcaaatctctataaccggaattcatgaccgtatgcattcagtgcactgcatatgcatatcttggcagttgacaactgacagggatcactacactaactcaaaatctgtcaaccctttagagaaattgtatataaacagtggcgaaaactgacaattgcaaagcataatcatttaattacagttttatctttggataccattcttttactgtgacttttgcgaaatctcaattcaaactattaaaaacatgtcgctcgcactcaatgatctggtgaactcttacgacgctctcactttcggtatgtggatcgcagaacaaccaggtgccacctatttaagctggggccagagcactatgaaccctgattctcatctgttaatcaaagctttggatgcagaaactgaagagctggtttcatcttttgagttgaagatagacggatcgccttcggaatggttagatggcatctacaaacttgaagaagagaatcaagacgaagagtcttcaatggaggatgaaaaccttgaaacaagagcgtcaaggtgtggtcagtattgcagcaacacccctggctgtcgtgaccctgtgtgccctgcttgttccgctgtagaaagaggtgattggaggaagagatgtaccattttttggctaaatcgctagattcagtaagagttttgccaacatttggcaacttgagttgagtagtcagttttccaaaacttttctcttttgaataagttagttacatgagttttaccatgcttcatttccgggatccacttggagatgtttaagagaattaaattgtcattatatgtagtttaaagggcaaacattcaacttttcaaacctgtagacactccgaaaattatcattcagaaaatatcaattgctcacttcgaaaaaaaaattaacattaactactacgtggacatgaaaatcgaatcttaaaccattcttctggtgggatgttgagctttatctcaaacgatgatactaccgcttcagttttagcattccgtgcttcaaacatcaagtgtgtgtcaggattttgggggctcttatcaacatgcaaatagatgttgtcacgatgctgcctaaaccacttgtcaaatcttgtaccgtcctcgttagtgacatatccattgagtgacatttttagttctgtggctgaactggttcgaaaatgtttagtataatttgctagttgtaccccttacttaagtattttatttttcacaatgagcaagaccactcagttaattccaatcactctttttccatttcaactaggtacaaactaaacatccaaaaaccctttccttcacgagatagaaagtctatgtaagaaacagattttgattatagagcagtcattatgacctaaagacataacagaatcttgcccaatctttgaaacaaaaatatcaactcacacaaaatatttgatcagattaaggacgccaaagcggttggaaaatcaacccccagagtatcttcatctctgtttggcccaaaaagtcaaagaaacacagcattcgtttaaagaaatttgttgatagaaaaaccggcagagagactaatgggatttagctagtcatcaaaaattcaggctcattagtattgcccttgtaataagctgcacaactagtgagcactcatgttcaataaagtggccttagttaccaccggactcacaatggggtaaaatagtttgtcatttacgtacttgccatttattgaaagttgattctatttgaacttcgacagtcgaggcttgcccacaatattttggttatgcccaaacgtgcatttacatgcatgatggctcgatgcacagaataaataaagaattgagccttatggagccgaactgccatataaagtatcaagttcaagtacaacgagggagaacaccgggaaggatcaccttatatggttggacagaatatgttcagatctgtgcagacatggtcacctcttcttcatgttgtcgtctactcggtaatcagaactacattcggtaagtaaataagcgctttaagctacttattgtcacaactatgaaaacaaacatctaggccctgaacctaaagtcaagtctctttcacccatctaagccttcgctaaataaactattcaaggtgaatgaatttatcacataattttggtttgagctgaaatattaacacacaccccccccttcataatggtataggggcctagagcttatcctgaaaaatatataaccattgtccaatgagggaggcgttaatcaaacatatttagctatatctacgaactcctgccaatttcagcagtttatctgataattcaggcttttcgagaggttcagatctgttctccggatctggctcatagtttggcaataacgggatatccttccctcttaacacaatattatcatgcgcccaatgagtagttccagaccaggactcaaacactttttttttcagctccaaaaactgcgtcgtggcgaactttgcagggctgtatgaaacgtatacagcagaacgaatatgctctgagcctggatcagcaccacctccataatgaatcgttctagaatcccataccaatagatcaccggggttcacggataacttgatttcctcaacatctggcttacttaagaaccaatcgcgttcagactccgtcaaggaatagtaatcgactgaggtccaaccatttttctctgtctgtgtgtcaaaaaactcgtcaaagtacttgtgagaattactatagaccaccaaagaggcatctttgggatcagatgcgtcacccaagttggcaatcccttgcacacattgaagtcctcttttgaaaggagactgatccacatgggcccaagattttggtggtggaagatctggacgttcaggtagtatgaagctgaaaccatcaaatgatactaacaactcatccgttccccaaattttggagaaagcatcaattattccagcctcttgacgaatatcccacatgaatttctcgtggctacagcaatataggccatacacgtttatagggagatgtgcagggagattcttttctcgccaagtcgacctatcgttcaaattcaaatttttagtgtaactgaatgatctaatccagtcatgaatttgcgactcgtagtattgagctctatcttttggaattgcacctttcaagattgcataacctcgttcaatgaagctgtctctccaatcaccataaggtgctccatccatgaaggcatttgaagcggcttgaaatacctgtggttctattttgctcggcatctctacactgttcattttgtttccacttagctcacggggtctgacaatgctttgggtagaggcatcatgagcgttaacatcaattttgactgtctgaacggtactaaccatagttgtatagtttgactggatccgaaacttcagttaaagcgttaacccatatttatgttgtcaaattaagcattccagtctctctcattatctcgcgcgagactcgcacaggttatttctagcagattcaaaactctcaagattcgaaagatagctcaaagttgatctgttatcactctattgttatctcttcggtcatatccattaagcaagactaagcttacccacataaaattcttttcaatcgtcaaaaaacactcatattttgaataggatccgatcctatcaagaatgaataagcttgaattcgcgtaagttcttatcgctttttcactcctaaatttgtctccaaaaatcttaacgatatcatctatctcatctaagaatacgtgcaaaagtgattcagaacttgtatatataagggcacagatctgctcacattctaaggctgtgtatccccaaatgaactacgaatacaaacacatatccaaactagtccctcgccatagagtgcccttttttatttccatactgctcactacggttcttagccccgtgacaatggggtacgactctttgatgatgggtaacttgaatgcattaccacagtatttggattactttcatataagagatgatgcagctctcttgggttggatgtctgccgctgtatgggtcggaagtatactgtcatgcttcttaatgcaacaactctccgacaaattgggtcgtaaaaaatccatcgtgatttcggtcatcgttggacttgtgggtgttattcttcaaagtgctgcgaaaaatattgcgatgtttagtattggcagggtgattattggttttggaacgcaactgtcggtggcagcggctccgacactgatctccgagcttgcgctcccaaagcacagagggtttctaggtggacttgcattcacgtgtttccaagttggagccttgattgcttctggtgtcacctatggtacccgcaatataacaaccacttgggcctggagaattccttcgattattcagtgtgttccagcactcttttctattgcggctttggtcttcattcccgaatcgccccgctggctgataagtgtaggacaatttgacaaagcttctgaggttatatctattgccgagggaatcgatattgatgcgggcatgaaacgagttcaggaaattcaagttgttatagaagaagaaaaagcaagagtatcttccagtccatggaaagaaatcacaaaaggagtttacaattggaaaagactttttattatgcttactcagggtctagtgaccgagttggctgggtcctctgttgggacttactacttttccctgctgttgaatcaagctggtgttaccgatgttagcactgttctacaagtcggaatcatccaatcatcatggtgtttagtaatagctttaatagcgtgctttactttggatattgttggaagaaagccccaggcgctatttggtaccactggtatgattgtttcctttttcatcttgggtggtctcattaagaaatatggaaattcagacaacgtctctgggtcatatggagccattgcgtgtatgtttttgtttcaaggattctacaatctttgctggacaccaatgaacactctgtatcctccggaaatctggccgttcaaacttcgttcagctggagtaacagttttcaagttcttcaactgtggttttggtcttttcggaactttcatcttaccaataggtatgtcgaacttaggttggaagttttacatgctgaatgcaggatatgatatcatttttttgcccataatctattttgtgtgggttgagacgaagggtgtctcactcgaaactctagatgaattgattggttgtccagttgtgctggatgaagagtcactaagttctgtagagcttgtgcaggttgacggtagaggcaagtctgacaaacaatgagctgggcttattatatttatttgattttgatcgttttatttgtaaggtgtttaatctacatacctattgttgtttcatgtacaacgctaagtctactaactctttacttgagagcagcgcatcgtcaaaattcacctttcagctctttaggttgagccattggaatgtttaagggggtttcgttgaatttaaatattgtcgttacagcaccttgaagcattacgaaataattatggtaaaaatcttttttggcctgtttatacgtgggataaactatactattatcaaagtggaaaagattttgggatttacgatttgcctattagtttagagcttccacctctggcttcttccactgacgattgtttacagcaaccaccatggcaatgaaccatcttgctaggaatgcaggacaaattaagcaccacagtttgaagactgctgatatgggcaaagaatttctctatattatcaacgataaactgcaaagttggagaagttggtgggacaaaaagctaagacgacgtgattaaaatccactattagttgagcagatttctatgacatatcatgatagtgtgctatcactatacatcaaaatattaccaaaatatttgggcttcaagcttgaattttacagatcaatctcccatagcaccatattcctggtgcattgatcggagattttaacagtctttgaaccaatccagggaaagaatttgctgtttgttccttgatggctgaatttatctgagtttatccttgctatttatgtcgctataatcaacgtcactctgataaacggtggcctttatcatggacagtacacgtcgggttttcagaaggcaaagaatcttctgactcaattgaaagataaggcaagtgtgacgggggaatttgtctggactttaaaaatggtaagttacatgcgcgtattgaggtacaaagaatcgttgaacagcgtgacagatattggtattgaccacggtgctaataacgtcaagaaagctagtttttaacagtttgagaggaataaggaagaaatccaaaagcatattgacgagaacgaattgaaagtttttaaagatcagcatattagagatactgatgatattaaaagaggagagttgactataaggatgatattcagattcgtctggtgatttatttgccagcttaacgtagtttggtcaaagagtcaatgaaagctaatgttcacaataacaaaacgccaggaaggtataaaactgggtagagtgtgctttgcactctggtgacagcaagtgcctggctaagtttgagtttagttttttcaaatgaatgaatgctggaggattaacaagttcccacctgacaccagctactactgtgcaggaactggtacgtcaggcttcatgctgctaattgggtcaaggtcaataacgaaataatcacatgtaatagtttttcatgggtgctaacttgctttgcaatttatcaagaaataacttatataccgtcgacagcagtttccaacaactttgaactgagttcgattgttagcatgactgtttgtgtttaaaaacctgagcaataatgcaacgaattgttttcatgctagctagtatcagcttttaacttgggttctttggctgttttcttatggattgcgtcttctggaactcttttggataacccaacattcaaaggtaaagaaaagctatgtccataaattttttcctgttactgccaacctctacacaaatcaatcgaggagaaggttctaaaattgatgttttcagacaactctcaattcggcatgggtttacacttctgaaataaataattttgaggaaagacgcaattcttttgatacctcttttcacccacattcaatggtatctgtagtatcaatgaaactaactgttggaagttaattcgactagctggtcattgattttggagtggacctctaaaacagattttcttcaaggccagccccgtatttcctgaatccgtgatatttaacagaaaacacccctaattcaagtttaggcagccacgtaactagattaacttttggttgatagttgcctatttcattttggctagggaatgagacgacaattcggtattttttgggatccttgcatctaagatcgcgtgcatgtagaaatagccttgtataacgtattgaatatctgtacagcagcaaaatcatcaatcaacaactaagactctttgcaacactataaatgaatagatatcatttcagagaaatagcgactacccaccttactataaataaaactcgaagtatacttttacatttggctgtgaggatattgcagggtctaaagtgttactatttgttaccaatttcctacattaccagcatgaataatgcagttagtcacaactgttatcgttttcttttgagtttggccatttcagaagttgcatgatgcgcaaggtagatttacccgaatagtactattaattgaaaatgtggtgccatgccaagcatacgcgcagctgcaactaagaactagtaaatgtcttcaggtattcatgatcgtgtgaaagagtgttgttactaaagaacgcattgttccagactgtaagtataaccgcttttcaaatgctaggaccgattatggcttgaacaacaaagtggtcctaaatttggttgcctgtaactggatcaaactttcaggctgctttatccgttttattgttccggtgacgtaccagaaaaatcacttggtttagcctactgcaaatgctacaatacggacatacactatagcgcatctattatttaggaattttgctgcaatgcgaatttgtgtcattatgtcgtgctaattgctgttttcttcgtgattgaaaaagaaatggtaattactgaagtttccaggaaaatggcatggaagcgacgtgaatatagacagaattgaaaaacaattttcaaatatatcgaatacagcctgtcaactcaagatcccgaaaccagtacaaatgcatacgaatcatggaaattgtaaacgaaacattatcaatgatgaagagaaatctgcaaaattaaacatccacgtctaagaagaatagtagaggttattttttttttcctaaaagtagattttatgaggaatgtgtacagtaaggcgccactggtgcagattggagtgtgacatagaaatatctcactcgggcataatttgaacatcctttcgagaattccatatcaattctactcccagtttagaacccaatgctgcaactcttttgtagaaatatgcatgctggcgtcatacatggtacgcggcgacttgtctgattgtccgctacgtctaaaattgcgagctaatgtgcatgcagaaaggcaaagaactatttcttttgcagcacttagaccctaccactttcatttgagactcaataaatgtcgcttttaaaacttgtggccagtaacttactttttgagtagtaaagcagtcacctttttaattaacccctagacagacgataaaactagatgacttcattagtttgggggaaagctatcggattgtggttgagagaacgcgcttcttcgtatctgcatataaagacatgtagcaaaccgcgctatgcaaccaaaattcaatctagagtttccaagaaattttgagtcatcgaaagatggaaataagaagagaaattttttattctgcttcgtttgaaaaatttggctctcgtattcataactatagttcaatctaattgtttgctgttgcaattttgttgctagattcatccagttgaaccatgtagtaactttgcatagcccgctgcagagctggcttaagtttagaccattccaaaatctttatacacttgtcaaataatcgtggttttctgacgtcgtatgtgttaatacgatgggccagctctgcaaaataatcatcgttgcatgttggcaagaaaccttgtttcatggttttcctggacgaagaaactaggcgtttggaccagaactgagccaagttggatctcacacgccctctttcttttctcatttgatgaggatctgagattgaagagcttccgaccagtaattctataatctttatgacttcaacactggtgatatagtacttgcatccaaatgagtccttaaccatatcgcggttacggccatccaaatctttgttgacacagttctcctcgtcagactcgttgttgttggtaagacatcttagacacgaaacttccaacactttgacattaggattgaatacaggcctagtttccgggttctctacagcagacccgacaatggaaaaggaggctacgatttcattggagtcgaacagtctctcaatacgaatgattcttctactgtcttcgagttcatactcgttccattccggtagacacatatctttacagctactgtattccaatcgtagacgggcagtaacatagcgcgctccaggaaataatggtttcttgggcggtttgcagttgcttcctccgaaattacgtccacggatcagcgggatccatgaatgattgagaaattttgatgtcgcaacaacgatgtcactagaaacattgagactttcaatttcattttggtttctaagctgaaacattcgtcttttggtgttgacagctgtctccaatgagtttgtggatgttttcatgatgcttactgggtcacattttactaagggacatgctggcgattgtggttctttctcaaagttttggtcgtaagagtatagcttctcaaatgattggtcagaagatagacctaaagttgagtccacagacaatgaatttccttccggggcggcaccaccatcaacagcggaaaaggtgtttgtgtctataaacgattgcactgagcttatttgtgggatgctggagtagacaaacatagaagactgtgagttgaatatgtttttggtaagcatatcaggcaatagatacggttcttgctgatcttctgtttcaatcttgagttcctgatggcaactggattgattcttgtgtctttgttgtggtttctgggattgctccggatcagcatttattgaagaagatagcatagagtggagtgttgtgtcatcgaatgatgaattcacaaaatcggactccaagaggtctcctgaaagcttctctttgttatagcagctagaactgaatccattgctactatttgtcctgaaatagtccccaatctcagcaagcatctttgacgtatcggcgaacagagtgctcaaaatgaataaaactctacttggtgagattaatatagcctgtaggccgagagttgaagaagaattatttggggaaaacgcaggaaattggctgaatggtttttaattaggcttacgagttcagtaccacaattcagtagcgcatgtacaaaaaaaagggaccgggactagaaaaaaacaaattcaacttcaagaaaagtaaaatatgagaggaaaggcgtacatgaagtagcccaacttgttctggaaagcattaatacatcctatttgagcattatgcagtatgcacagcaatgttttcaattctttcttttcgcggtcactcgcacgtgaaaagtttttctctatctcacaagatgcatgtggatgattatgtcccactttgatagctgcatcggacagaaatccttagtggtttatttgtgatacttcttttctactgaaaatcatgaaattcttttatggggcaacaaagtcataattctcggctgtgatgtttagcgagttccgcttattctttgtacagatcgaagcagctacgtgaagaagttagttaatgtttgaccaatattttttttttatatgattttgtccgtgattggccagccacacgatattaagatgcagccaagagaaaattttattccaatccacgtgacagcattatctaatagataaacatcagttaaaagttaatctagtttattcgcggtacaagctacgctgagaggatagccatgccttggcatatccaatttaggtttaaaagtcaattcagagtcaaggtttattacttgcaggctgcatgcgaagtattatctgatgatatcacattccgcacccttcaatcggggatacacattagatattaaccgtggcgaaatcaagcggtaatattacatttgaggctcagcttatgtgccacctacccgggagttctcaaattggcattttgacttttcccggtagctatactcaatttttgattcccgtgttagtactgttgatcatcaggattagtcaaacaatatgttttgcttgtctacttctcgaatgtaggcgcgcgcgtctagaacttcgctggttacattcatgttagtctctgcgcactcaattaaattgttgccaccacttgaggttgcgtagatgatcatatgttgtttattcaacacttgcatgaaactaagtgtggattttaaaaagttcggttatatcctgttttgtaatgcctttatattgaaatctgctgatttacacgccacttccccaatctgtccttcgatcagcctgaactgcgcaaactcaggtgcatcaacttattatgcatgatgcatgtgatgcagtcttgaaattacagcgtataatctttgaatatatacggagactgtagatgagcataattactggacctaaaattgaaggctatagagatatcagtgccgcttttcaaaatgctatgactttgtgggtcaaacatgatacgtatgttttcactagaaacattgtactgcaacgcatctattgatttattacgaaaatgcagcaacccaatttaggtcatctgataatggtagttgtcaacttaaagttcagaatgaaaccccaatcgttcgattcccaaaaaatgctgcttgtaaatggcgggaaagtaaacaaaactacatcgaggaacccaagtaaacaattaattattgtgaatggaggtaatggagaattttttatctgaacatggtcttatttgttttctccttcgcactgtattcgttgtggtttagaagtcaggccagagttggacctattacaatgatataatcgtttcaaacctgttcaaaacaaatttctttcttgcgggtttgaggttcctttttttctgtcactggcttcaaaacaaaagtttaccgtataaagttccagcacttcctgtggttggctatgctacggtcaggacaaccgaagagaaccattaatttgaagagaccacaaaaaataaccctataagggaattaaattcggcatctgatttacgattggtatatagtttgatggatttctcatcttgtggctcacatatcaatctgcttgctagccatcttgaactgatgaaacagattctttttagtccgaagatacgaaagctttatttaaacatctggtattgacacaactgaggattatttcatcattattcgaaatttgcgttctttccaaaaattctacttaattctacttcatacgcactttggcctccgtagacaacaaaatcaaacacactaatggattgttccacaatctgaaaaagcctcaggactttctatcgcactgattttagcgccagcacaagtactgtatgacattgcaactaacattggctggttccatccctatcctgctaaataacttcattcagcttggtaacatctttaccaccattagctcattcctccttgctagcttctcaaccaaatagaatggtctaccgatacaataacatgccatttttctttcagcatcaactgttagtgaagtgaagttctgccaagaatatatactgcatacccttgccactctgtacaaaatagcggtcaagcctcttcgaaaagacagactaatcttaaaaagtcataggctagagttgcaagtactgtgtcaaactctgcctagaatcatcctgcaaatgactgtgctatccgcgcagcaatagacccatcaaaagaattggtcctgaactaattgatcaagaagatacttactgtttagtccccgaacgataagtttcttcccatatagacattaatgacaaggaaagaggtgtctgccattttaaaagacccaactacgcctattcgtagatagagagtatacaaatatagaagagtaagtagtggaaatgtttttcgtaagcatgtgtttatttaaggctctctcttgacaagtttgaaggagaatttactaagtattgcacaggaaatcacaattttccactatggtattactagcttagtctgtatttcatgtggtataaaagcagctatttgaccaataagtcatttagcgtactcttgttgccttttgttttctttgattcctgttgtgatcaatattcaaattgagatgcagccaagaagtactttcttttccggtacacgtgacacgaccacatagtttgaagtgtgtaggctgaaaagggtatgctgcagcacaaatataatttactcatttcttggcgggacaattgtttttgacgaatgctctgaaggatgattttgaaatctgcatgctgcatgcacaaagtacgtaacaattaattaagattacgtactcaaaactcagacgatcctattacctttatggcaatgaagtgcagatattacaagtagatctgaggttcactagaagcgactctagctcttgaaagttaattaagccggcgggtcattgaacgtgagtcgggactgtaaaaaaagagtttcattcatgttagccacgaatgctttgactctgtcacaataagcggagagaataactaatttgagtttatgcagcaatgaaattgaattactttttgataactagtttggcccattttgtttgtgcagggtaatgagacgacgattgtgaaatttctagaatcgttgcatttaagaatgccttgcgtgcaaccgtttactaccgcatggcgtattatatctatacagcagaaaaaattatcaaacaacaactaggtccctatttcttcataatgcatgaataaatataattgctcaaagataacaactacccgcctgacaagaagtaagattcgtacaatcgatatatttttccatctggccctggagttactgaagcgtctggagtatctactgaagtgttgatgtttgttagaacgcttcaaccatcatcggcaaaattcatgcaacagccaccactgttattcttcattcaaatctggcctattttagacggaatgcatgatgcaaaggtcgaattacccaaataatactcagatttttatatacggggctatggcaagcatgacgcacaaccgcagctaaaaagaaaagacctgtaaacatgtgacccggtctgggatttggatagacaacttcaagtatatatagagcgtttcaataaagaacgtattctctcggactatagatacaaccgcttttcaacatgagaccaattatgtcttgaacaacaaagtgatcataattttggcactctatgactattagtcaaactttcaggttggtctctcttttcattagtctggctgagtatactagagattcatttggttaaacctgctgcaaatgttgcatttgggaatacacatagcgcagtcatcaatttaagaatcagcaacaacgccaattttcgccctcttgtggtagtaattgccggttcagtaggtgcatgaaaatgaaatttcaagttgttttccattcaagtatggtagcatgtaaatagcgtgaatataagcagagtcgaaacaaaaataaatatcgaatacggtctattagatctagatctcgaaaacatagttcggaa

SEQ ID NO: 104 - DNA, 34581 bp, Pichia pastoris
cttctaaggcccctacctctcccaattccaatcccatacacaaattccacaaaaagtagccacaatgaccaaaaaaacaaacaaaatcacaaatacattatctgtcatgcagcatgacgcatacatacttctaaccagcaaaaaacatccggccatggccttatgcacccttcttgttccagaagcagacagtcgcaaattagacgcacttaccggcgatactagctgtcaatctcgaaccatggtacttctaaatgttgcacaaaaaactcaaagaagaactcacaaaagaaaaaaacttgaataccttcatagaactagcaaggagttctaaacgtccaacagacgaaaagccaactctaaaaaaatataaccactgacgatgattttggcgaaaacccgccatctacagaactcaacaactacctcaatttttttcaaaaactaattggcgaaaaagcatttactacatgtggattatgctattccaatactgaaaatagccttttcttcgtagatgaaaacggaggctacttctccgatattaccgatttagactacaatgtcgaaacaccacaatctaaccaccagtcctcgacactcaaccaacaaacttatgtcttgcgcgctgcattaggttctaactgtactgatcttatcaaagaatgcgcgcttaatgcagccacgcataacttcaacaaacttaccgaacgtgaaagaagttcagtccacgagacctttgaagaccaactagcagcagcaattttccaggttacttctcacattccacaaaaagaaggacctgctattccgctgcaagctattgtgccacaaacgctcgtcgtcctacaaaatgcttatcgaaaaagacatcccattaacgtcaggatccgacgtatcatgatgacccccattgaacatacgcaaacacaaaacgaaaaaagccatcctccacaagagttcaactacatgattacaaatgcccgtaccttcataggaatgacaaacaagaagacatcccgctttaagctcaccagctctattccagaggaacagcaagaaacattaggaatgtgcttcgatctttttagttactacatcaaaaaccagaacggtacagggctatcaagtgccaatgacagcgagtattacgccgaaattgaaagcgataatctagatcccgtttgggccttgctcctacctagtctaattgcccacagccccttcagcggttatgcgaacgacaaaagtacaaaccatgacgcctactacaaaacactttgtccaccagcaaaagcacaaaaatatgaccgtatacaaaactattcctttagactcgaggctcctaatggtgaagacaacaggccatcactgtacgaactgattacctcctgccgagagctcatggctaaatataaccttggcgatatacgcgagttccatagagatgagactgcccgaggtgcttacgagcgccgaaagaagccgcatcaagccgcaattcgccacatctggattggttcttacagagaggtcaaagccgagggcgaaaaatttgtccacactcgtgtcgcgcatcctgacatcatctgtcgcggtccgctcttccgcatgggcgaaagatctgccagcttcaagacaatgtcggaagtcgaagaattcttaaaagtacgcagaagcagctccaagcgagccaagaagatgtacaaggcaagttatcctaagaattggtcatttcttgtcgctactggccaagtcaatcagtagtttataatgtttatgatgatccctagaaagtaccgggtttcctcgttttcagtacttgagtgatccttacattaacttaggcagatttctatagttgttagttttcttttcttttttttctagtattcattctgagagtgagagattaccgattgaaatgacaaaatgtcaacgtttccataaaaaacctttgtttcgattctataatcaagtctatagatgaagagattaattcaaccataactaatccgcttgaaaaacatccataaaagaggaacattaggtactaatatgcaagacattggtacccaagtagaagacgagttttttgattacttaactagatgcagaatctaaagtgatacataaaaatgcacaacttgatcaaatcatcaaactaacggaacattcatagccgagaaatgataatggtttatcttgggagtatgcggaaaacactagaagaaagaaatataaagttacaatgaatctctagataaaatgcttaatgtcttcttactcccgtcacgaggttattgtactatattttagaaatttgttcaattttatttacttttttcatagtttaagttctaccattttttttattgaaagctaattttttaacattctcatttgtttaagttagagctgcagggtacctagattaagatgtgatttattaaattattcaaaatttgtatttttctatttaattcatcatcgaataatatttttattttgcaagtgaatccttcggctggaaggcaatttcttcaaccagtagcaacttcagtctttcgcaattgaagactacctactatgcattaaccatgtccagtgtgtgataactttcgtagtttctccatttttaatgacagagttctgccttaatggcctgatctccacttttcatacgttctgttgtgcaactgatttttcactgtattcataaatctattcattccctaacgctgaaaacgtctttttttggttgtagtagcttatcaacgtttattgttcttaccaatactcttcacggagcttctatatttgacctttcaacggtttatgtctattatatttttctaggtcttgccagactccaactggtgtgggaggggcataaaccattaacctgtagaggaactgccttggctgaaattcgtgatagctggcaaattttgaattcagttgttttcacaaacaactgctcaagctcaaatcagacatttacttgctgccaagaagaagtgacgcgtgctcagcaaacagagaaacttttcatgccatcgcaggatcagtaagtcacttggttcttatacactgttcagatttgtttttaggtcccacggtttcctctacacctttgtatttacagtaaaatgatgtcgtgttcacctgttgtaaagtgtgaagcaatcgtaccaaccaacaccccggccaaaacttataatcgtcaaccttctgattatttatgaatttcaatgactcttttataccacagtacaagtttagtatcaagttagacagagccaaccaaacaccctgctgtcttaaaactgattgcatgcatataggcaagttccaacaaaaacggagattataactgtttgatccacttgaagtagagtaaaagggaaattttttagttaggtcaggattcttaagaccgggttgctgactctctgagctttgtaaaaaaactttatgtattcgtttcggtaaaaaccccaatgcttgatatgaatatctgttgatactagcataaactggcacattctgatcagaaaatccccatccgcaacagtagagaaaccaaatggttgttaatgtgataattggataagaacctagaagatttttcagaacatacaaaacacaaaatatcatggtgcaaatttttccaatgaaaacaatggagcaaatatctcacaacaaaacgttgataaatacggttgtccactaactggtacgatggtgtaaacagacaatgttgtcacttgcgaaactttagttgttctgatccaaaataacagctacgagaaaacacttcgagatccctcctctgtcttggtccatgctatcaattaaactattgctctctggtagttgtgttcagcaaacctctctatcatccggacttgcgatgagctggaagagaggtggcagccggtgaaaatggaggggcagacgacttagttcaacgattgtgcagcaagacaattctcgtctcggtgttggggatcatattttgccaacgaaataaccaaggagaacttcactgaaatctcaacatcttgtaatcatgtgccacttgaagtcttggttactaccagtgagtatgaaccagtagcaatagccatggcgctgctaagatagcagaaaaattgttcctaaaagtacgcgtcaaaaattacatctctttgtgtcaggcctcaacgagaatctcgtttgacacgaaatcaccgaagaggtgagccgcctttacaacaaaaatcaaaacatcatctaggtgtttaggctgcagctgacttcgaggttaacaacccatggtagcgggctcaaacggatatgagtttatcattaaccaactgacaattgtgtttgaagagaatcttagttacgttcacccccttcccccatttgaaattccgtgccaggcagttggggttgaatacaaacctatctctcaccctatccttgcaaagtatctgagactagagggactatcttgagcaaatcttctttggacgggtgtgatgactgaatcccactatcaacgttctccaaaatttatcaagatagttgacgcactccgagcctgagagacactaagtccatttcaaaggtggcacggtagaacattaaaggggatgaacacttatctattttaatatggttttcggaacgctttctctgtctacaacgcctgaaaatcttcgaatgactttggtcaataagtggaaacagtttagctatgcaatcagtatactccactagtaaaaaccagaaccaaactctcttattataagtaggggaacgaggagataaatacgtggttcatttgcatcaacaaaaaaacgtattgatgcccttacataacttgtacgacccagtgattcctacgctcccagcacggcacaaccttcagatctatgactacatcgagaaatcgtcatttttcatgatacaactgatatcaaggcatacaatcacaattagctggcccgagtacattgttggatttaatcttgtggtagcagcaggctactgtcggtgtacgaaaacatagagggatagcagtagaaaagaaagctgaaaagctcaatcctcacagtgcttttgtacctacgcttcttgcagtgactaaagcacaaataaatggcttagtgcccatcgattgcttatcaggcttctaatttgtgggtgtacgaaatgatcttttattctgcagctcaaaaatttcgtcagcaaatgacgcctgaaaaactgaaaaatggcttcctgtcatcgacaattgagtaaagtatgctattttgtagttttaaccgttgaaagttcttactcaggtccacagttgctttttgatgacggtaaaagtatacttcatctaatataacgggggctacctgtggaatattgcgttaacatctaatgctggagaaaaacaaaagtgactgactaatcaaccatcataccaactcattcctttggtcaaaagaagtgtatcgtaaaacagtaatttaatgtatccatgaaacattgctcccgttattatactgaatgaatgctgcttagctagtctgattattttgattacaaagaaaggaatagacacactgaaccatcgaattcgcgataaggtgggagcagcgctcgtgaaccacacacgcatatcctagaaatcatacgaatgcatgtaagttcctaagttctaaacaagctggtatgaaagagtcgcctaaatgcggaatatgtgattactcctatacgatccttactttaggggggatgagaactaagtcagaatctgttctcgtcggtctgatacctaccgtcaagtcttctcaccatggagcgaaactaatccccaacttgctatgctcaggatgtataaactataaactacttaaattggaaacaggtttggtagagttggtatctgaatcatcggaattggtataccgtatcaacaccgtgctaaaaaattgcttacattacaatttgcgtggtgagaatcaaattgaaagtgatttagctcatggagtgcagaacctatatttagggttattgcaggtggaaagccatataattttgggacggattctaaggattgaaagtaggtgctataagcaggagatacgcaattctcagttgaaacaacgaatcgagaagctactctctaagaaaagaatcagagaggcagatattattaatttgaggtcgtcagtagagaacgctcacaaaaaacgtaggatggaccaagagctgagcaaatgttatattcatcagaaacttgagtttttggaaaagtctaccagcatggccagaggaaacttattacaaactttggtaagtgtccttcaggtaagtaaaagttccaatacacagctgagaataaggcaagtccctgtgttacatatacaagatatactgctatatgatcgaaatacgactaatttgtcatttcaatctattttgatctttcagcaattgacttccaggtatttgggcataaagctccctttcggcataaagatatacagcttcgataatcagaaccaggagtgtgaatttcaaaccatgataggtagggagtcctattggtattttgctggcattccagaagaccatgaaccatccagagatactatacattgtctctctaaagccgtttcgtacattgttttaaacttcttaaccctcaacaaacaggagtctacttggaattcagatataaccctttatgacttattcgatataaactcctttatttggaggatcatcggtaacaaaatcgagtgcttgactgaagaaactaatggagagaaatccttacaaaggagctttggtttagttccaaaaccaagggaacctttgccagaggacactgaatctgagcaatgcctcaccgaaaacctataccacgataataaactttatttgaaatcaaaaatgatttcaataaaggaatgtggtgacttgccatcattgaatgccaaggtctacgatttctttcaacatcaattaaaagttattgatgatatgacagacaagtattctttgaaagacgtaagtaaaactgcaaattcatcgcgaattatcactgaggccactcctggtatcaaagttgttgcgtcattgaagcatacttcaggtgaagaggtcagcaatagtccaagatttcacttaaacagtaccttggaagctcctactaatgacttcaatgtttccaaggaatctgacagaattggggctgattccaatattttgaaggcacaagatgaaaaatgggagatagttgaacttcaatagttactccttctatgtaattcatggtacgtctgcgtaatttccatcctaagtcatcttgccagtgaagcagccatcgcaatctatacgaacaaatacaccgcagtgaattcaactccttattgttatcactgtttttgaaaagggacttcaataagaagcaatgctcaccgaccaggaactatgtaagcttctgttactatacttttctatctcctaatgatactaactagcgtttgagttgaaataaacaagaaggccgtggccgaagcatttaaggttaagcctcgtatcaattataatactgttggcggggttaatggccctttagtgatccttgaaaatgtcaaatttcctaggtttaatgaaattgttaaccttaccctacccgatggaactatcagagcaggacaggttctagaagtccgtggcaatagagcgattgttcaggtctttgaaggaacttctggcattgatgtcaagaaaactcgtgtcgagtttactggggacaatttgaaaatccctgtgtcagaagatatgctaggacgagtttttgatgggtctggtaggcccatagacaatggaccgaaggtttttgctgaagactttttagatataaacgggtctcccatcaatccctattctcgtatctatccagaggaaatgatttccacgggtatatcagctattgatactatgaattctatcgctcgggggcaaaagattcctattttttccgcttcagggttgcctcataacgaaattgcggctcagatttgtagacaggcaggtttggtcaggcctactaaggatgtacacgatggtcatgaagagaacttttctattgtttttgcggctatgggtgttaacttggaaacctcccggttcttcaaacaagactttgaggagaatgggtcactggaaagaacatcattgtttttgaacctggcaaacgatcccactatcgaaagaatcatcacacctcgtctagctcttacaacagctgaatatttggcatatcaaacagaaagacatgtgctaacaattttaacagatatgtcctcgtatgcagatgcgttgcgtgaagtttcggctgccagagaagaagttcccggccgtcgaggttatccggggtatatgtatacagatttatcaactatttacgagagagcagggcgagtggaaggtcgtaacggttccattactcaaatccccattttgaccatgccaaacgatgatatcacccatccaattcccgatcttactggttacattaccgaaggccagatatcagtcgatcgtcaactgcacaatcgaggtatctatccccctatcaacgtattgccatctttgtcccgcttaatgaagagcgctattggcgagggtatgacacgtaaggatcatggtgatgtttctaaccaattatacgctaaatacgctataggtcgtgatgccgctgcaatgaaagctgttgttggtgaagaggctttgtcgatcgaagacaaactctccttagagtttttagacaagtttgagaagacatttatttctcagggtgcctatgataacaggactgtctttgagtcgttagatcaagcttggtctctgttgagaatctaccctaaggaaatgctgaatagaatctcaccaaagattctggatgagttctacgatagagagcgccatggggaagaagaagatattgttaagagcgcagacaagactgataagtgataaatatgtagacagatttattgcaaaagctatgaagtggcacgtacaaccgtaaggaaactgaactgttgctcgtttttagctgcatacagtagtttcagtttcatctcctggaaattgttgcgcgacatttggtatgtagtataagtataactgacattcccctaccttgaaaatagcaagtgtctaaatatttttaccagttacctccttagtttcgtctctctcaacaaagcttctagactttcaggaaatggtggaaggaaatgttctagtcatctctaatagagttccagttacaatcaaaaaaggttctgacggcaactatcaatacaacatgtcaagtggtggattggttactgcgcttcaagggctaaagcaaaaatttcaatggtttggctggcctggtttggaagttccagctattgaccaggaaaaggtgaacagtgaccttaaagagaagttcaattgctttcctatctatctgagtgatgaaattgcagaattacactacaatggatttagcaactctattttgtggcccttgtttcattatcatccaggagaaatgaattttgatgaggctgcatgggcagcttacattgaggccaacagacagttctgcaaagttatagttggtaagatcgctgataacgatcttgtttggattcatgactaccatttaatgttactcccacaaatgcttcgacgtcaaattgatgaacaaggactcaagaatgtacgtttaggttttttcttgcacacgccattcccttcatcagagatttatcgtattcttcctgtacgtaaggagattctggaaggggtgttgagctgtgatttgattggattccacacctatgattacgctcgtcattttacgtcgtctgtggaacgaattctgggctgcagaacaactccaacaggtcttacgtatggttcccacaatgtgtccgttggagcgtatcctatcggaatagatgtggacaagttcactacagggatcaagcagcacttggtgcaggaacgaattcactcattacaaaaacgttttggtcaaggagtgaagttaatcgtcggggtggacaggcttgattatatcaagggagttccacaaaagctacatgcttttgaaatattcttgcaggagcatccagaatggattggcaaagttgtcttagttcaagttgctgtaccctcaagaggcgatgtagaggagtatcaaacacttcgtgccactgttaatgaacttgtgggacgtatcaatggccaatttggcaccatagaatttgttcctattcactttatgcacaagtctgttcccttcgaggagctgatctctttatacgctgtctcggatatctgtctcgtttcaagtacacgggatggaatgaatcttgtatcctacgagtatattgcatgccagcagcaaaagaagggatctctgatattgagtgagttcgctggagctgcccagtcattgaatggtgcaatcgtggttaatccgtggaatacagaagagttaagtgaagcaatttatgaagctctatccctacccgaagaaaagagagaatctagttttgagtctatgttcaagtatatcagcaaatacacagctgcatattggggagaaaacttcgtcaaggaactcacaagggtaggtaacaacatgtaagagagatttcgagttctcgtacctctatagatttttactttaattatcaatcaaactgcacttttgacttttgttccttaagtgatggcgattcacaatgatgttcgttgcttggttttaatagtggtgatgactgactgagttagatgttggatgcacttgcagtagtagtatatactagtaaacatttttacctcgtgttccagaagtgcttctggtttcttgcgcgatccataacatcatttagcctagcaacatcagcagttcagttatgggccaatttatatcacaacctgtaactgaaaagttcgttgagacatatggaaggccgcatatttccatggtagtcggtcagatgcaaggatatcgtgtttcaatggaggatgcccattgctgttggcataaaacccttgagatcacttccttcggtggcttcttgcaaaaatacgagattgatattgttggtgtttttgatggtcatgggggtaaaaatgctgcacaatatgtaggagaaagattaccacacatcatatttggacttctgaaggaacaattggtggagcacaagaacgctattggcactcgatatgcggaaactgactgtttagttgaaactataaatttcacccacataattaagaatgctttcttcaaatgtgactctgaactatactctcgaaggattaagtctggttctaccgcagttgttgtgattattttgaacggaattgtgtttaccgccaacataggcgactctcggtgtatactacacacaggcaagcatgacaccgtaaagaacttgtccttcgatcataaaccaaaacactacggtgaattatttcgtattcatagcgacggtggccacgttcaagccaacagggttgggggtgtattagcactaagccgagcatttggagattttacattcaaatgtttcaaccaagccaattatgcccgactattgaacaacaagaaaatgcaagcaagggctaaccttgagcaaagaaactacaataatatgagcgtttctttggaggcaacaaataaatcctcgttggagagtcttaccgttcctgaagaatttcaagtcactgctgaaccagacatagttatccatacgatcacatcggaagaccattttttaatcctagcgtgtgatggagtttgggattgctataataacgagcctttagtgcgccaaactcgacatttcctaagtttggatctgtctttgaacgttgttgtagaaaaactgctggacttatgcataagaaaagcgaacaccataactggagttgggtttgataacatgacgttaatcttggtcgcattgcatcctttaaggacagttaaccaatggcaaaagaagctttcgtctgaaatactagcagagaacacataatagggcgaatcttttattactacttatttcgtcctttacagaaggagtttcaggaaagggactttgatctgcctccttcgcgaatacctagttgtctatagcatctggcgtgacactctttccttgacagatgccatggaagtctcaacatgtggagactctttggtggatctactcagagatccgacgctgaattcagacaaagtgaagtgtcaaaagcttttccatatcatcaaagctacaaaggatcgcaaattgaagcatgtctgtttgaagggattccagaatttgcgggatctagagcacattgctcagcgattagacaattgggagttcaaaaccttggaataccatttggtagatggtatctatgtgtctaccgttggtgatgagaactcatcttatgatactgcgaaccataaaattgagcaggatttagttgaaagacagttttttcaaaaggaactagcaagcaaagtcctgaagacttgcatggaactttatgagcaattgaacgtatcaaacggagctgtagaaagaatcaatgagtttttattgaaaatgtcaccgtctgactatattagtgatctaggtacaattttggcacagttgacttttcgatgtctccgactacaaaagagtctagaatacaagttgcatattaagtattgcaagagtaagttagtggtaataggcatagatttggaacgcataatggcactaaatttgaacgaaagcctcacagagaaaactattttaggatacagaagctacataactgatcttctgaaacaggcggaagattgtatactcaacaatgacactattggaaccatggaatgtctctctgtggttaaagatgttgaaaggatgtttgatgctgttagacccaaagaatttctttacccaactgattctgtttcttctgaaattaattttgaacatgaccccaaaaatcatctcaagaccagagggaagagcaactcctctttcaatgctccatctgagaaaattatgagctctttgcaaagatccactatctcggaagagctaccctatttgatgggcgcttttgacgatgccaaaatggcacaggttgagctcctgggcgtagtttctggtaatgccgatactgttaacaatcagcgactccactctactggtgattcctcggttgttcattttccaagtactgagatgtctcacactatagatgatcttaaacggataagtttactaaaccagagcctcaccccaagaaccaaaatggacagctccattctaaagggaatcagcttgaggtcagaggtggtagacttacctaattatagtaatcttcagagcgcactccctttagcttcgaatatgctgagaatgtggaacccgaccctactagaacgtaatgctagcaaaccagaaactgaagaagtcgactgaaaaaataatatgatttgatcatatgatatacacatttacatatatacagagaatataaatattcgttaagagtccgttctagaaaaacatgatgcaatgtctaaggcccctttcgagtgggttaccttaaagacattagcacggactactcgtggatcattcctcaatgtcctcaaaatttcggactgaactgtgggagaggaatcaaacaacagcatgaaatgattgcctttgtaatgcttctcctgagtttttgtcataatctttggcagaaacttaatccccatgggattgatttctcttatcactcctttattatttattatcaactttccaactgttttgatcactctacatagtcagtaatgaacaatcaaaaatcaaaagtcatacgaacgctttaacatcctcattaggtgaagttctgatcaccctggtgattcccactaactcgtataacatcaccctttttaagtgaaagcgagaaagagctgcgaactattgaaaaaagagaacctctaaattagtggtgtactgctcttatggttgttagctttatctcctaatcgctgaatcgagcctccaagttgtcttttctacattgcagtttgctaactccagcgtctcatttaggttagccaagatgtttgaatggatgtttggcaaaaagcaaactccccaagagagattgcgcaagaaccagcgagctctggagaagactcaaagagaactcgatagagagcgattaaagttagagcaacaggagagaaaattaattggggaaataaagaaatctggtcgtaatggacaaatgagagcgtgtaagattcaggcaaaagatcttattaggacgaagaagaatatacagaagtttgcaaagatgaaggtgcaactccaagcaatttcactccgtatacaaacagttcgatcgaatgagcaaatgacacagtcaatgcgtaatgctgcgcaattacttggaacgatgaataaatctatgaatttgccccaaatagctcatatttctcaagaattctctaggcaaacggatatcatgagccagagagaggaaatgatggatgactctctggatgatttaatggatgaagagttagatgatgaagacgaagaggaggtagacgaaataatcagcaaggtactggacgaaattggggttgatttaagtaataatttgatcgatgttcctggagaagtcgttacagaaggacaaacaggagctagagtcgcagttaaggaagacgacgacttacaggcacgcttggacgatctccggagataaacgctgcgtctcccacttgtgagattattatcaatagcctaacaggtcatcgtgatcatttggaccatctacccgagcagagaagctcgtagctctgtttttggtaacgatcttagtacaggctactcattttgcgaatatttagcttacttagtgtcatttctgccttgcacttctttggacctgccaaactaccacccagcagagcaacttggctcaacaactttaccaggcgcacagagtctatgtaacaactatcaatgccatagataacaagctcattgaaagattcactgtgaacctgacgtaagtcctgaagcgcaactagcaccaagtataaggcagtcacttcatctggcttcaaaaatagaaacttagctccaccggaaatcagatgttcctcaatggtatcaactatagcaactgaggggcaattcacacatatcaataccaccagggttttccttttatttataccttccataatcatcttgaaatcaaccttgtcgtcatcattgctagacatcgatcataggggcaaaactgattacctttaaagttagataatcaagttctagaataaaaagccatcctttattcagaaagaaatttatcgcatttcgaaaagagaacacattgaaactaggcatgtttcgaaccttttctctcaatcgcaaattatttcatcataagaaagataaaaatagattagcaacttactaaaagactctgacaatcacacgagcctgaacatcgtcttttttcctgtagaacaaacacttattgaaacgagattcgagactctcaaagcgaatattctctagggctcaaccctggtcatgtgattggttcttgcgcgcttgttttttgcagtacaacaaaaaaaattattgtccttcttctatcaaccaaagtaaagatgtccgccccaaccgttgaagttgaagaattgaactggagactcgtggaagtcggtagagttgttttgatcaacaacaagcttgctgctattgtcgacatcatcgaccagaagagagttctcgttgatggaccatctactgatgttgaaagacaagttgctcgtcttcaagacatagaactaaccttcttagtgttggattccgtttccaggggagacaactccgatgctgtcaaggaggcatgggatgcttctgatatctcttctcaatgggcctcttctgactgggctaaggatattgctcaaaagcagagaagaagtgagctgaacgactttgagagatttcaagtgcagcttttgcaaaaacaaagaagccttgctatcggtagtgctgctaaatagggctactagtgtgtatgggttctagaagcattttagtatagtatgatcaggataagaattgatgcttgttgatattataagttggttacaaacactccaaaaagtctttgagacaacgagcttcttcgaacttcaaatatagtattcggaaacttgaacgacccaaaaactttttctggcacatctccctcctggtaaggtatcaagtatgcatctttaacagaatcccccttgccttgtatcactccaaatctgttacgattgtagaagtaattaaacaaccttatgaagttatttcggtgctcttcatctgttaatgcttctcctgattcgtctggaacaaattcaactatgagggtgtatttcttacggtccatacaatttttgaggtatgcgagcgctgttttacggttgagcctaccctcaatttgaagatacttatggatttgatgaaactgtcttatgattgaaatacattgttggctttctttgtcaaaatccattaacgttgaagaagttacaaagtaagcacatgctctgaaatttgaaatctctgaaaatattagttcaccagcccaaacaaaacccttacttctatcagtaataccagcttcatcaataggctgatcttcatcttggaaattgtctcctatgatggcactaatgctctcatcgaggatcatttgctggcgttcatgattaattccctcatcttcttctccagaatagtactcattgtgatatagagaaacattcttattatatggctctccccgttcagacaatttttcctgctcctcctctctctgatgagaaccttcttcttcgatgagatgctgcattcgttgcgggctatcttcttctcccctttcataatcagaaaattgatcttcattaaacagttcacttgttttcccttcatctgcctcaccaaaatctataatttcctctcctttgtgagttatcttcgctcgaggtttggagttcattccattctctataactgtttgacttatagccttcgtgtggacatccttggcaagttgcttgatgtcagaggtttgcatctcttcgggagtcaaattgcatagttgaacaaatgttagctctttgccaatgagccgttctaagagtttagtctttgggtttttaagattgaacataagagttcgagctttagaagtatagctgttcccaggaatgtgtactatcttgccacctttgccagttttcttgtctccacgagaaagcagtaattggtattcaagtttcagagcccattcttcggcattcttagcgttcgaaggtaacaaattgttgaacattttaaagaatgttttcactattccctttcttacaggattaaactcctcatccatgctcttgatctcgcaaccttcttgctcttgcccgaaagctttagtgtgttttgtgttgtgacctttttgtgttggttttgagtgaattaaatgttcctggtcgctctcctcagaaaaaaaactctcactatcatcctcaggaatttttgctattgactcttctgaataatcactatctggtgctttcttagccgcaacaatagactcttgaatatcaaagttgagtgctggtcccttaccatgcggggaaagagtctctcttttgagttgtttatactcacttaaactcatttcgaatttcaagttaccataagcttcattatgggggtcgcatacgttacaaatatatgattcaggaatagtattctcctgaaacatacaatggttatgctgccaggtgtgacaacgatcgcactggaccattgcttcgccatcatcttccgttgtaccacaaactaagcatctgacttcgtcttctaaatcctccatttccgaggatgtatgttttggttttcttctcctctgctttggtccgtaggtttcacctcgccgagttaactcagatttcctggaaagaaaatttcgtttcaaattttgcttttttctctcttcgactattaactcctcatccagtgtaagcgctcttttgccggcagtagccctctttgattttcttatttctgacatagtaatgccttgaccaacgaagtgtaattattagcgtataaaatgaagcactgatggaagcttaattcgcgctcgtttgggatgctccgagtacgtcaaacaaaacctaccaaaagtgcgtctaaagcttatagaagatctcgctaattatatgacattgcacgcattggcttttgaatctgtgatagtgcttttggtctttggcagtatacttgataaattgatattttccaatttggagtttctgtatcaactggctattaagctatattcgcgcttctgtttatttgtttattaagagcaggtcaagcaaggatctagactatcttcaaagaattgcaaaaacgtttcaatgtctgaaaataagaaatacctactagacctgccgaagctcacgtcagtagaatttccgttggtggttaataactcggcaagggcactggagatggttggcgggaaagaaaaacttcagaaatgtatcatatccaacgacatattggagaatcgcccttttctaagtttaggacaacagggcaacgctcttaatgaagcaactcttgagcttcgactgagagaagatccccatcatcatccaatcaactcttacattcatcagaatgagaatctattggtaaaggtacgagtccctaggaaggtatttcgaaagagaaatggaaacaacatagcagctacattgcgacactgcaagcagaatggctttagtactgagttcaacgttattggagtcttgaataagaacttcaaatttagggagttggcagattttcagtatatcacgaagagttctgcatttgcaagtaagttcagacaagggctattaaggggatatctgcctaatattaagggcattgccagtgatatcgaaaatgatataagcagacagcaaaacaacgatgatttggatttaccccctcctttgagattcaacagagtttcattgcctttcaattatggctacaagtccaacccgtactcatcaactatagtggatgagaacggacaaatatctttacagactcgatcaaaaagaattttattgtttagtactagtatagatttcggcgaagctacgccactgggtcctcctaatgaactgttgaacaatttagaagatttgagaaaagaggtgcagcaaatgcgcattgacaagagaaacagtgaagaattcatccgggaatctcctgctcagacacttttggatacgatagagctattgaatgtggcgtttagggttcgtcctatctggcttagaagtaatttggttaagctgttccctgacagatttaagtctagtatcaagtttgctctgccatatgtttcgtatctaatgagaaaaggaccatggagatcttcgcctatagttttcggatatgatcctcgcctagacccgagctcaaaagtataccaaatagagactttccgaactgtagagaggagcttcactgccgttgcagatctggaacaccaaccttctaatttcatctctgagtcccagttagttcccctaaactttctagactacaataacttgacagaagatgaaaaaaaatttgcatttattccaaaagatcaggttttcactggtgataccttcccatcagttgtaaccttccaggtgcacgctcttcaggaccctttgattaccaacatacttcacgctgcttctgtattagagaagccttctgagcgttatgggtggtttgatagattgtcactccaaaaagttcgctcaattataaagtataagctagatgctttaagtcaaggaaaggaggtaaacttgaataaagtagagaacatagtagaccgggttgcgtacaacttttcaactaaacaaggggttgacgaagatagcctagaacagcttgaggaagaggaggaagaaaatgatagagaagaatgtgaaggactatctaccgagcacaactttcctgggcctgaaataagtttcactggtgaacttcctgaaaagctcttacaagggcggcgacatttattaacgaagctggaattgtacaactctaatgaagtatccaaagtatctgaacttaatggaatcattaagcaagaggatttaatgtcttttgacttaggttccaatacaactgagtctacctatctgaactgaacaaaaattgttccttccagtgatgttgacagtaattgtttacgcctctagatgggtgccccggttcatttacttttggtttcagaagctgaacaatttcgcgaaagaaacaattttttcaagacctaatagccaaaactcaaaactatatatagttaactttttacttcatcaagtaactatgttgaagggtgtgaacttggcattgaaaagatttgcgagtagaccctccttagaacaaggagtttctatccccaatagacctttgaagaaaattcaaatcggtaaggcaagacctgcaatttattataagttcgattgtcaagtagaattatcagatggatcagtaattacccgcaaatcacagtaccccaaggtggaaatgcgaatgatttctgaccagagaaatagtcctttctggaatagtagtagaaaagatttagtttcgggtgacacaggcacaaggggtcgtttgaacaaattcaagcagagatactcgggatttgccgacaatagccaagaagatactgtccaaggtacacagagcgagaacgactttcttgatttgattggcagcaatcacgttgaacagaaattgggaggaaatattgcaagcaagaagagaaactccaagaagtagttggtggtggataaatagcgagccatcaattgctgtacaactaaaacaattatctcttgtaaataagtcagattgtatatttatacttcaactataagcttgtcgtggatcatcgttggagtaggctgaatcatgtgcactcttaaaccgagagacagaagcctccaacaagtttgaatagagccgctcgcttttgataagtttgtcgtttaaagacaacatttcttcttttctgttactatacttctcgatcagtcgtgtcagctgaggtctcaagggtgtaagactattgtataatttggatatggtttcatcttcgagaagatcgttgagggcatcgtagttgccagtatttgtcacaagggcatgtacttcagtcagtttattgagaaagaggtcaatctgtctagattgtttccagatacgatactctttagcggcttcttccatcgcttcatgaacggttaattctttgattggtgtaacatagttgagaggaaaaattcctactttgcctttcagagaacctttccaccagtctttgtaaacactagcgagaacggttatgatatcacctctgtgaaaagagagctcaccagcttcattactcaccaagtcatacaaagccctgactttagcgacctttgctatactacctgtattcactatttcactgagaggttcattatcctctacagaagttacactggaggatttaaacttaggatggctgtctactttctcatcgagcttctggtgagaatctgctgaggaccacttatacgagttatccaccgttacaaactcggggtttgatttcaatgtttcgttttttttcaacggcggagattcagttctattgtattcctccaaagaaagtttgagagccctgtcaagcatctcctgttctctctgtctatcgtcctgtgaaatctctctcttagaaggcttggaaggagctggagcaaatagatcagggtactgagatcttaacctcgagcaagtcttatcaattattgcaagtgaaggatcatcgatgaacgattctgaaagttgatgtagcatgttagcaatcttaagctttattgtgtggtgaattctggagtcttctattaatttcacaaaagttgaaatgaagcccttggtagcaatagcctgcttcattcttgaaccacaattttcggccattgcgataatcaatgacaatgagcgtaagagaacattggcatcctttatgctaagtcgcttgttgatgtaaataatagcagtcgctggtcctgtctcaggctcatcgttaatagtatcacatacttcaattatataaccccagttgtcacttgtcagtttctcatcagttgcttttataatacatgattccaacttggaaggcatagttacccaaaatgaaagaaccaattgaaagggggcggcggcaacagtggtagtgtagtcgcgcttgtctgattcttctatcaattcaaagttagaaatcgagcccgaagcgcgatatggcatgatcgaactagatttcaaaacatactccaattcatctatgtccataatctctgaatttgtccaagacattcctcctggggaagccaaacctgtaatccgagacttgaaactggttgctgcggaatttggtgcggaaatcaaaaatgaatttgaaacacatgtcctcaattctgattttcatttggttcaggatacctctcaaggattgttagctatagtttccaggtatactcaaagaggtactaaatttatagactatgcatccaacctgaagttccactatgattttgtagaccagaagtctatggatactgaagaatttagcgaagatattctccctgagtataattctgttgacaaggagctggagaagtacacccaagagcatttcccagactcctacaaggtagtgcttactccgtttgaggaaggattccatgtcattattgtggacgtccggtacaatgataagaatttttacaacggaaagtggcaatcgttctatacatttaacagggtcaaaggcttaatttcgggacaggtaagaataaaaatccactactatgaggacgggaatgtcacactcaatagtcacaaaagacttaatcccacagaaactacggttacagacattgtcaatcacatcaaatcttttgaggatgattaccaaagaaacctattgagtagtttcaataacttgaacgaaattgtgtttaggaatctgcgtaggcagcttccaattaacagatcaaaagttcaatggggaaagtctattggaacttataaactagggcaagacattggaggtggaagagaatagcagtatccgccagtatgtaagaaaagaatagtcatagcagtttaaacagtgtccaaaatattatgaataccagaagagacaatcctatgaccctactgatactctggttctgactaataaccctagcaaaccttgaagaggtcgatcgtacagaacttgccaatgagctgaagccgttcgataacgaatccattgtagagctatcttcgttagcctgaaaactaatgtcttgggtcaccctcctaaaactgttaagtttgtgagccagctggtcaagttgttgattgttttgctgctcgtaggacatttgtgttttgagatcgttaactgcgtttgtttttttgtttttttttttttttttttactacttctttaaaaatgtagctaataaagcttaaagaggaaggtagcattctttttcccattttctaccgcttagaatatgggttcgctgaaaattttactttctgcaacagcggtatgagcaacatgtcattggttcgaagaatcggtgtgctaaggtcttttgcctttaaaagaccatatagtatctcttcggacattgataaatcccatagctataaagacattgatcagcgcctgaagtatgatgaaatacgaggcaaaatacgagctcttggatccctttcagaagaacaagcaaatgacttattgacagagtacaatttggaccagaaggaccacgtagatttcaggaatatgcttaaggactttttggatgaatttctgaacaaggaagaaatcaaattgaatgttggaagttctaacattgggaccaacgtaagaaacagtaacaaatttcccttcttgaactccacccctccaaataaagaatattcgatacaagaactatttgtacgccaataccatcattcacagcaggtaaattctctcggtgcttctttaactaacgtttacaaaccccatgaagatgttttgaatcctaagaaagcaaatgagttgtctatcaaaactttactggctgcaggggtccatttaggacattcgacatccctttataggccatccacgcaacccttcatatatggtgagtacaaaggattacacattatagacttggaacagacattgatatacttaaagagagcttcaaaagttgttcaaggcgttgctgagaaaggcggcttgattttgtttttgggaaccagagatggacaaagaagatctttagaggaagctgcaagtagagtgaagggttactttgtgtcctcaagatggatacccgggactttgaccaactgcactgaaatcagtggcacctggcagagacatgaggtagacctagaagacactcctactggtagaaatttggaaggtgatgaattaagttcccttgtaaaacctgaccttattgtaattttaaaccctgttgagaacaggaatgctttgaaagaagcaatgtacgctcgtgttcctacgattggcatcgtggacacggactcagagccgtcactggttacttatccagttccaggcaatgatgattctaatcgatcaactgatttgattcttggggtcctctcaaaagctggtgaactaggacgccgtcggcgtctcgagaaagtccagcaatacaggcagcttatgtagggttttctgatagtttgtttgtaaatagagtgtaaccattcctacacatggttattggatgccattagcataaaaatttctaagcacatgcaagatttatgggtagcagcattcagtccacgagtattcactagcaaaggactgattgaaaaaaaagtgaatcgcctactctctttctaaaccgaaatgagcgcacgaactgtcttcagccatgttatatacctgcaaaatcttgcttacgtaatcagtagtgctaaactcactttagtttcttcctatgtgtgatcttcgcagtcgtgatcgaataagtatcaggaatatggtaatctctgcaaaaaactaaccatccgaattacatgtcacacaactccctcgtggcggaacctgattcagttgctgatcagccagaactttcagcttcatcaactttaaacgcagacctcccacgttttcctggcacgctgaatgtgaatgcgttagctgaagaacaggtattcaagatccagcctgactctgccttcaaggaggatgtagttcacaagctcaacaaaatatgttatgataatgagttggaaattttgaccccagttcttagatctaatgacacgttccaagacagctctgtgatgcccgttccaggcagtgcgccgaacgatggaaatcaggagtttgattttaggcagaaatctcttcaaagatcccttccagaaacagtattaaaggaactcaacaatattacggaaccaaaggagggtatagagaaaaactttgataaagagtcctcacaagtgggtacttccgatcactcttcgaattctactggggccgactttgcagaagttcacaacgacccttcctctaaatcttccttccaatcacgtgcattacaggcttcacccacaaatacaaatgtgcaggaaaccatgattcattctacgccagtatattcaccacaccatacctcaaaaacactctcacccactaaacagagggtaacttcaagttctcggcctcctagtagaaagcacaaagtgaaaggggtcctaagtagcttcgtgagctcaatcaagggtgaaaattatttgggatctcaatctaggagtttgaacttgaacggggtaattcaacattcaactgattctccttctttgagcatttccacaccttatggttacaagcatgtgcaatctgtaaagtatgataattccactggatcatttcaaggacttccagaatcctggcaacgcgtcctaagcgatagtgggatctcaaagacggagcagcagtctaaccctcaggcagtaatggatatcgttaacttttacaagaataacatgaacactgaagaggatcgtttcatgcagtttaacattgaccaagcctccaaacacagtttagattcgactcattctacttccaacgaagaaatttctgataattatgaagctttgggaatccaagagactagcttgaaaaggctgtcgactcccgttctatcccataagggaaaatttagttctagtttcgagttggcgtctcctgctcagatatatcctcctccagaagattcgactttcattccttctcgtcctcctccgaagccgccgtcttccaaaacccccattacaaaatctgcatcaacgttcgcaacttcagggtctcctagactgggtctacactacaatggcgtgccaaatgtacatccttctccaagttcatttattagctctttatcgcgtaagatctcaaccaagtctacaaaatcatcctcttcctcaccaagaaatgttgtcattggatctcctttggttcctaaggggcagtctcagttcacacaacaaaatctgcagccgcaacagcagctggaacacgaacaatcaaaccagcagcaacagcaagaacagccactatccaacactcgtataatgaggccgaacagaccggctccaccccctccagttgttagattgtcacccagaacagaaaaagtacctccaaccccgttgggtgcgaattcgggcaagcaaaggagctcaaaggaagttaaacaacgcagtgaacgaaaacaggaagaaaagaaatgtagagacaaattgatactcaataagttgaatagcatctgctctgcaggtgaccctactgctaagtacgaaaactttgtcaaagttgggaaaggagcttccggtgatgtttatactgcgaatgaaataggaacacggtcttgcgtggctataaaaaggatgtacttacaaaagcagcccaagaaagaactaataataaacgaaatcttggtaatgaaaggatccaaacacaagaatattgtgaactttattaattcctatgttcaggacaacaacctgtgggttgtgatggagtatatggaaggtggatccctgacggacattgtcacgcatagtgttatgtctgaagggcagatcggtgccgtttgtaaagagacgttagaaggtttgttgttcctgcattctaaaggcatcattcatcgcgatatcaagtctgataacattttactttcactaagtggagaaattaagatcacagattttgggttttgcgcgcagatcaaggaatacaacttaaagcgtacaacaatggtaggtactccttattggatggctccagaggttgtgtccagaaaagaatatggacctaaagtcgacctctggtctttaggaataatggttattgaaatgattgaaggtgaacctccttacttgaatgagacacctttgagggctttgtttttaataactactaacggaactcctaaattggaagagccagacattttgagtggcggtttgaagtcgttccttcaatcatgtttagaggttaatcctgaacgacgtgcggatgccatccagttgctgcagcatcctttcatactcaatgctgaccctatatcctcgttgattcctttagtgaatgctgctagattgcagaaattgtcagacgatgtatcggataacggtgatattaagggagatgctttgggagactagaatgtagagaaatttgggttttctaatgtataagtgaatataactagatgtatttttaccaattgatgcaataaacgagatggcaggtcatgtttgaagaatatcgtataccgactgaacttgatttctgagacaaacaaaggactatagtacttatacaactcttgattggtagttataaagattgaactccaaactttaaacttccttgatgatttacagctaaataaattagttgccgttgataacttccaaatcttcttattgtgaaaaaacactaaaaccgtcttaggtgaacttattttgtactcaaagagcttgtaaaagttaattgctgtcattttttcactttttcatttccaattgttaatagtgcagagctgttgctccttttttctcttttgacttccaccctatcaaatattaggcctatatggagtttattgtgtcgttttttcagcaaagtaaaagggagaataatgagtatagcaacaaaagctgcggtaaagtacacctgtacactttgcttgaactttattatctgtgtggcgtaatggtcaaagcgattgtcttactgtcaaaagattgtgcttcgaatcccatcgcgagtatattttgatcaactcaactgttataaatgttcctgaacatattggctacatcttaaacaaatactgaagcgtataatactgacaagcactacggttatggcatgactaggtacctgctgctatagtagtgttcggaccgcttcaagatttgcttgcttttgtactctgtatcttcgaaacaggattgtcgcacctaacgcagtctattaatcatctagaaaattttctattagtgaaacaatcaaagcaattgttgagatgagacctatagtcatctatatcttagtcatctcttctatctgctttaagatcaatgctttttcgatgacgaaacatactgggaacaaggcctttgaagattacccacaaaaggcaacaactccaagcagagatttgttggctgtattggacaccaaagtgtcgactggggaacgacctaaaagcaaaagcatccctcaaaagtgttcaaaacctgagcatatcatccgcaacgaaggagatatgaaacagcttgaagattgcacaacaatagagggagatattgtggtcgatggatacaccgacaccgtgttagattttggcgccacaaaacatgtctggggagatatcaaggttcaaaacagctccaatgtggcaagggttgagggcttagaactggaacgcatcggcggtagttcctcctttctgtttttaaccgcattgtcaactattcgtttaccgcggctaaaaactatgcagtccataaattggcaggttctgcccattctgagtagcgtttcgttcaatagtgaggtcagctcgcttgaaaccattattatttcagatacagcgttgacacactttacaggatttgatacacagagccttaacgtcttgaatatcaacaataataggtatatggaacttgtggaatctgacgtagaagagattactggcgagctttcaatcacttccaatgccaaaaacgttcaaataaatcttccaaacttaaagaatgctaaaaatattacagtcagagatgctgaatcagttgatctaaggaacttgaaaaatgtggaagtttcggcaggattcatagaaaactccttcaaagaattacatttaccgaaactacaacatgtggggggaacatttggtattatgaagaatgatatggttcagattttagattttccagaacttagcgaaattgaaggaggcctcattattgctaataacacaagaattcagagtatcagttttttccctgaactaaaaggtattgggggtgcaattcgttttgaaggcgaattttcagatatccagctagaagagttgcaggtggttagagggtcagccttggttcgtacctcatctggaacattcgactgtaataattggctgaagttcggggcctcctcaatcgttcgagggggagtgatcgaatgcttctcgaacaaacattcacagaccattcatgtaaacgaagagggtagagtcgtgaagaatataaccgatattaactctttctcttccaaatcaaatgccgcaaatctaaaatacagcctgttttccctttttatggccctgctgatgattcctgggttataaattaagtagtctttctatttagataaatgttgctttgtccgcgaaatgttatcccaacactaaaagaaatcgatctcccaaactggtagatatggtcaaaggctaaaggctagacctgcatagacgaaaacctccagcatggaacaccgtaagcttctagatgaaaatgaagcaaagcatagtgcagataatatttcatttaagaggcattcaacacggcatgatgctctcttagcatccatgagcagcagaagctttgttgaagaagcggccaggtttgaaaaggatcaagagagagatacggatagggcccaaaccaatcagcacaatgaatatagaggagcaaaaaatgaccgtaaggttctgagtttcgatcggaattctggagttgatggcaaagatcatgctgaaggatcattacatcaaccgcttcaacccactaacagcgtggaaaaaacctcaaacccttgtaaagaaaggaaaagaaggagagccctcagttgccaatcatgtcgaaagcttaagacaaggtgtgattttgaactagagcttggcaaatgtcataggtgcgctaagcttcgacttagctgttccttgacccaagaaaatgaaaccgaaattaaggccattcgaaacacaatgaagccagaaacttttaacatggacttgagattagaaaaaatgcaaatagcaatagatgaattgagaacccaattgacctcagtgctctggaagctagaaaatcacgctgagagattgagtccacctatgagacgacgcgaagagtcttttatcgacactttgaacttcacgaagaacatatcttggacagaggattatctggatcagtttatagaagattctccactgcaaattatcaaacaaatagaccactctcttttcaaaagagtcacgaggtatgatcctttacagttagcgtgtgaggagtttcttaagttctaccttgaaaacgagaaactttgtctggaactggtcaaactctactttgaggttgctcatttttggattataccaggaggcattactgagatcaacagagagtacgtgttagagcacccattcatcacatgtgtttttgttgccttggcgatgtgctttgatgaacgttatacttatacttcgcagcaaaaacaattgtactggcttacatcaaagctgcttggtgtagttgccataactgagccacttactgaccatgatattgaaggaatattgtacctttgtctttacaacgttgcccgcaagcccaagcagcctcaactagatggatggttgttatctggaatcggaatcaaacatttgatgatatctttcaatttcaaggagattgttaccagagttgaaaaggagaagaagtttgaagccgacgacttgtaccatctgcgaatatggaatgccatgtgtgcggtccattttcagcattccattggatcaggacgcccaataatgatcactaacgatttttactcggtacacaagcttactatcatgtatccgaaggctactattggggatgcgatcaaagttagtgagctccagctttacctaatttttcaacgactattcgagtcaccgggctggaccaagacgtttacacatgacgacaatgcaatattcgtattttatgatttggacgactggaaaactcggtggatagcattgattgatcgagatattagtggtttgctttcttttacttacgaatttctttacgtggtattatcgagaagatacatcaagttgtgcacaccgaagaaaagtaccataactcaggttttcagggattctcatagacttcctaacctagtatatgcattcaacacagttacgaaattttcgatgaaaattttagaaagacttttgaagctaccaactactttgattcggggatccccttcgttccaatggtctcaaattatttatgcaagtttatcattatttgagtttttacctataatgaatcaagaacagaaatctttttccttgaatttgatttctaaagtatattggtttttgaacgagataggagaaggatcaaatgaagcaaccgactctgtgggtaaaattctcaagaacattgtagacaaagcaagcaaagttagtacaccatcacaaaagcatgctgactttaggactgatgagttagatgagaaggattcagagagtttatcgccgactgttaatctttattctcataagatacggaacggctcttccgctgtggattttcaggaacagatgttacaagcggcaattcctacagaaagtgtttgcaaagttcctaatctcggtttgtcaccaagtcacttttctacgaaccctgagtttcctcacgaggaatcaagttttgaaatgcccgatttgtcgcagtttgatagttttgatgaattttttaatggaatctttccagaatttaaaagagtcaagaatatttaacttgtgagcgaacgaacatgaaaaccgaaagaatagttgatgatgatgttgaagcaatgcaagtaccatataaattaggagaagtcctttgtgtattggcgattccttttgatgcaagtgagcgtaaatggttaacaggctgatacatttactcaagctagtagtgaaagccattgcgaaatcagtttatcatagtagtggacgtcacaatggaactcatctctgcgaatcgttgtagaataactgtaggtaaatatgcaattctaacttctggtctaaaatgttcagtgacaatgcttatttctgtagtcgcgaagaattgcttctgaggagacggagcgagccatgtattctcgccaacttgacaagaacgccgccacgccatgaaagtttctacgaccaaatttctggctgtgttcttattagttagactcgtttgcgctgttgattcaggtcaattaaggattggtacgtagttacttgagttccacaattacgtgtgctaataagtgtttttaggaatcactaggaaagtaccaccagatgagtgtgtccaaaagactcaatcaggagacacagttgctatacactatgaagggtctctggaggacggcaccatttttgattcatcttatgaacgtgatcaaccattggagtttgttttaggatctggacaagttatcagaggttgggatcaaggtttacaaaagtacgtgattttgagcttcttttctttctcaacttttttactgaatactaatattaagcatgtgtattggagagcagagaaagctaacaattcctcctgatttaggttacggcagccgcggaataggcccaattccagcaaatgctgtactaggtgagtctattatttggattgatttgaaaaaagatactaactccgctagttttcaaggcagaattggtggatatcaagaaaagagatgagctttaaccaacgaatctattgatgccctgacatgattatggtatattgttatttaactttcgaaaagtagtatttgcggttcatatcgacgggcctttcaggtgtgtttcagtattcaactgcaactgctcaatataagagatgtaccttttttaaacttgccaaaccaatttgccaatgttttaagaatcagtagacaacgactttgtcaatctcaattctactggaatcaagaggatgagtgtctctttgaacgaagttcgggcccttgattccaatggttcaaactagacaacctaagcttggtcacgttttaacagaaccactttcgtcgacatttgtagatcgtggatttgtacgcttgaagactcgttcttggtgtctagttagaatactcacctatcattagagcaactgtgatcaaaaagatggggattacaaactcatgacagatatataagcatcaacacacttgctccgtcagcttgaataagcccctgaaatagaacgtagtcttgaatgctcagttagcaagtctgttactatctattttataacgcaactcaatgtttttgtttctctcgacgaaacgtttttgcttagcatttcggtatcttaaaccgtgtgattttaagtctcataaccttttacatacaggatcaataataatattattgttgatacaatataggattagaatacatagattctgatgttcgaatcaatcaatgtcttaatattcacgtacttgtataccctctgattccacattggtccaacggaatcttctagcaacagccagttgcactagatgtggttctccaccagaaattatagtactgacagattttttggtttacggtgagaggctccaatttccaaagctaaaccaatttcttcataagcaacctccacgcgcgcttttagtatgatgtagaaactggacctaaagatcgaccaa
